United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 19

SEQ ID NO: 20862 - DNA, 5487 bp, Homo sapiens
atggcctcgggagccggaggagtcggagggggcggtggcggcaagatccggacgcggcgttgccaccaggggccaattaagccttaccagcaggggcgacaacagcatcagggcattcttagcagggttacagaatctgttaagaatattgtgccagggtggctacaaagatacttcaacaagaatgaagatgtatgcagctgttcaacagacacaagcgaggttccacgctggccagaaaataaagaggaccatctggtatatgccgatgaggagagctctaatattactgatgggagaatcacacctgagccagcagtcagtaatacagaagaaccttcaacaactagtactgcttcaaattatccagatgtgttaacaaggccttctcttcatcggagccatctgaatttttccatgttggaatcccctgcattacactgtcagccatctacatcctcggcattcccaattggcagttcgggattttcccttgtaaaggaaattaaagattctacctctcagcatgatgatgataacatctcaactaccagtggtttttcttcaagagcttctgataaagatataactgtttcaaagaacacttcattgccacctctgtggtccccagaagctgaacgttctcactcactctcacagcacactgccaccagctcaaaaaaaccagcattcaacttgtctgcctttggaacactttccccttcacttgggaattcttcaatccttaaaaccagtcagcttggagattctcctttttatcctggaaaaacaacatacggtggggcagcagctgctgtaagacagtctaaactacgaaatacaccttatcaggcaccagttagaagacaaatgaaagctaagcaactcagtgcacaatcttacggtgtgaccagttcaacagctcggcgaatattgcagtctttagagaagatgtcaagccctttagcggatgcaaaaagaattccatccattgtttcttctcctctgaattctcctcttgataggagtgggatagatatcacagattttcaggccaaaagagaaaaggtggattctcaatatcctcctgttcagagacttatgaccccaaagccagtttccatagcaacaaatcgaagtgtttattttaaaccatctctgactccttctggtgaattcaggaagactaatcaaagaatagataacaagtgcagtactggatatgaaaaaaatatgacacccggacaaaatagagaacaacgagaaagtggcttttcatatccaaatttcagtttgcctgcagccaatggtttatcttctggagtaggtggtggaggtggcaagatgagacgagaaagaacacgctttgttgcttctaaacctctggaggaggaggaaatggaagttccagtattaccgaaaatctctctaccgatcaccagttcttcactgcctacctttaattttagttcccctgagatcacaacttcctctccatcacccatcaattcgtctcaagcattaacaaacaaggtacaaatgacctctccgagcagcactggcagtcccatgtttaaattttcatctccaatcgtaaaatctactgaggcaaatgtactacctccatcatctattggatttacatttagtgtgcctgttgcaaaaacagcagaactttctggttctagtagtactttagaaccaattataagtagttcagctcatcatgtcactacagtgaacagtacaaattgtaagaagacaccacctgaagattgtgagggtccttttagacctgcagaaatcctgaaagaaggaagtgttctagatattctgaaaagccctggtttcgcatcgccgaagatagattctgttgctgctcagcccaccgcaacaagcccagtagtttatacaagaccagcaataagtagcttttcttctagtggaattgggtttggggagagtttaaaagctgggtcatcatggcagtgtgatacatgtctactccagaacaaagttacagacaacaaatgcatagcctgtcaagcagcaaaattgtcacccagagatactgctaaacagactggaattgaaacaccaaataaaagtggcaaaacaactctttctgcatcagggacaggctttggagacaaatttaaaccagtgataggcacttgggattgtgatacctgtttagtgcaaaataaacctgaagcaataaaatgtgtagcctgtgaaacaccgaaacctggaacttgtgtgaagcgagcccttacattgacagtggtttcggaaagtgctgagactatgactgcttcatcttccagctgcactgtaaccactggtaccttaggatttggagataaattcaaaaggcccattggatcttgggagtgttcagtatgctgtgtttctaataatgcagaagacaataagtgtgtgtcctgtatgtctgagaaaccaggaagttcagtacctgcttcaagtagcagcactgtacctgtctctctgccttctggaggctctctaggattggaaaagttcaagaaacccgagggaagctgggactgtgaattgtgcctagtgcagaataaggcagactctaccaaatgtttggcatgtgaaagtgcaaagccaggcacaaaatctgggtttaaaggctttgacacatcttcctcatcttcgaactcagcagcctcctcatccttcaaatttggtgtctcatcatcctcttctgggccttctcagactttaacaagcactggaaattttaaatttggagatcagggaggattcaaaataggtgtgtcatccgattctgggtctataaaccccatgagtgaaggctttaaattttctaaaccaataggagattttaaatttggagtttcatctgaatctaagcccgaagaagttaaaaaagatagtaagaatgataattttaagtttggactttcttctggtttaagcaacccagtttctttaactccatttcaatttggggtatctaatcttggacaggaagaaaagaaagaggaactgcccaaatcttcctctgcaggttttagctttggtacaggtgttattaactccacccctgctcctgctaacaccatagtgacctctgagaacaagagcagcttcaaccttggaaccatagaaaccaagagtgcttcagtggctcctttcacatgtaagacatcagaagctaaaaaagaagaaatgcctgccaccaaaggaggattctcttttggcaacgtggagcctgcctctctgccatctgcctcagtgtttgttttgggaaggacagaagagaaacagcaagagcctgtcacttctacttccctagtttttgggaagaaagctgacaatgaagagccaaagtgtcaaccagtgttttcctttgggaattcagagcaaaccaaagatgagaattcttcaaagtccacatttagttttagtatgacaaaaccatctgagaaggaatctgaacagccagcaaaagccacttttgcctttggagctcaaactagtactacagctgatcaaggtgcagcaaagccagtttttagtttcttgaacaacagttcctctagttcaagtacaccagccacttctgctggtggtggcatatttggtagttccacctcttcctccaatccacctgtggctacctttgtgtttggacagtccagcaatcctgtgagcagctctgcctttggtaacactgctgaatccagcacctctcagtctttgctattttctcaagatagcaaactagcaaccacatccagcacaggtacagctgtcaccccatttgtctttggtccaggagccagcagtaataatactaccacctctggtttcggctttggagccacaaccacatctagctctgcaggatcctcctttgtatttggaactggaccctcagcaccatctgccagtccagcatttggtgctaaccagaccccaacatttggacaaagtcaaggtgccagccagcccaatcccccaggctttggatctatatcatcttccacagcattatttcccactggttctcagcctgcaccacctacttttgggacagtgtcaagcagtagccagccccctgtgtttggacagcaacctagtcagtctgcatttggctctggaacaactcctaattctagttcggctttccagtttggcagcagcactacaaatttcaacttcacaaacaacagtccatcaggagtgttcacatttggtgcaaattctagcacacctgcagcctcagcccagccttcaggctcggggggctttccatttaaccagtctccagcagcatttacagtggggtcaaatgggaaaaatgtgttctcttcttctggaacttcattctctggtcgcaagataaagactgctgttagacgcaggaaataaaggtcacattggtgttgtactcaattttaacaacagctggtgccctgctttcagatactggattgtactttgtgctggggttatctgaagtcagatctgcctaaggacttctttaattttggaattttcctcctttctctttcgttacagaagccccaccctgcctcacccacccttttttaaataaataaatagctagactggtgactgattcttcagcaaaaatattttatgatccagcagattattcactgatttgacatagtctggctgtacccaggaatggagcctgcacggtgaatggctttgtatagaacctctttgtctacaccattatgtgcgctgataagcgttcatggaacgcgttgaaattgtaattatatctgaggaattctgtatagattagaattctgtatagattagagagtgttgaaacggatgatttctatgctgagtttgtgctggtgtatgtgtgaagtgagtgagttgggtgtattgtgcgctaaacttttctgatagaggaagcctgattaaagaatggtccgtgctaaggacttgttagatctagttcactctccatttaataattatatgctatttctatattttcattctcctatcacctgtcttgcctttttcattattttattatgaaacttgtgtaaatacaattttgtttctgtactttttggcataacataaatctgtgaacttgaaatttgaattttgtgttagagatttttttgttgtttgtttagtcttgtctcagattttattatgtaaatcccattattcaaagttgcctaaatccatttggaaatctttaaaaaaaaaattggggattcttaaagttgaatttattggcttttctgatccagttttgtttggaccaaaaaccagtattgtacaaagtattaagcatatatttttatatttactaaaatggactgtggtgactttggataataaggaaaagtttaatattaaagccatgtttattacagtataattaacatgttaaaccatgggataaatgccatcaataaaaaattatgacat

SEQ ID NO: 20863 - DNA, 5561 bp, Homo sapiens
ttccccgctgccagcactcaccctctctccgctcctgctcgcaacctcgcggttcctggggtgcttgtgcccactgtgtggacagcgcgggcggacttttgggccggggccgggcggcgggggaggctctctaaggcctccgcctctgcctctcccgcccccttacccgccccggagcgggaagcggcggaggctccgccatggcctcgggagccggaggagtcggagggggcggtggcggcaagatccggacgcggcgttgccaccaggggccaattaagccttaccagcaggggcgacaacagcatcagggcattcttagcagggttacagaatctgttaagaatattgtgccagggtggctacaaagatacttcaacaagaatgaagatgtatgcagctgttcaacagacacaagcgaggttccacgctggccagaaaataaagaggaccatctggtatatgccgatgaggagagctctaatattactgatgggagaatcacacctgagccagcagtcagtaatacagaagaaccttcaacaactagtactgcttcaaattatccagatgtgttaacaaggccttctcttcatcggagccatctgaatttttccatgttggaatcccctgcattacactgtcagccatctacatcctcggcattcccaattggcagttcgggattttcccttgtaaaggaaattaaagattctacctctcagcatgatgatgataacatctcaactaccagtggtttttcttcaagagcttctgataaagatataactgtttcaaagaacacttcattgccacctctgtggtccccagaagctgaacgttctcactcactctcacagcacactgccaccagctcaaaaaaaccagcattcaacttgtctgcctttggaacactttccccttcacttgggaattcttcaatccttaaaaccagtcagcttggagattctcctttttatcctggaaaaacaacatacggtggggcagcagctgctgtaagacagtctaaactacgaaatacaccttatcaggcaccagttagaagacaaatgaaagctaagcaactcagtgcacaatcttacggtgtgaccagttcaacagctcggcgaatattgcagtctttagagaagatgtcaagccctttagcggatgcaaaaagaattccatccattgtttcttctcctctgaattctcctcttgataggagtgggatagatatcacagattttcaggccaaaagagaaaaggtggattctcaatatcctcctgttcagagacttatgaccccaaagccagtttccatagcaacaaatcgaagtgtttattttaaaccatctctgactccttctggtgaattcaggaagactaatcaaagaatagataacaagtgcagtactggatatgaaaaaaatatgacacccggacaaaatagagaacaacgagaaagtggcttttcatatccaaatttcagtttgcctgcagccaatggtttatcttctggagtaggtggtggaggtggcaagatgagacgagaaagaacacgctttgttgcttctaaacctctggaggaggaggaaatggaagttccagtattaccgaaaatctctctaccgatcaccagttcttcactgcctacctttaattttagttcccctgagatcacaacttcctctccatcacccatcaattcgtctcaagcattaacaaacaaggtacaaatgacctctccgagcagcactggcagtcccatgtttaaattttcatctccaatcgtaaaatctactgaggcaaatgtactacctccatcatctattggatttacatttagtgtgcctgttgcaaaaacagcagaactttctggttctagtagtactttagaaccaattataagtagttcaggtttcgcatcgccgaagatagattctgttgctgctcagcccaccgcaacaagcccagtagtttatacaagaccagcaataagtagcttttcttctagtggaattgggtttggggagagtttaaaagctgggtcatcatggcagtgtgatacatgtctactccagaacaaagttacagacaacaaatgcatagcctgtcaagcagcaaaattgtcacccagagatactgctaaacagactggaattgaaacaccaaataaaagtggcaaaacaactctttctgcatcagggacaggctttggagacaaatttaaaccagtgataggcacttgggattgtgatacctgtttagtgcaaaataaacctgaagcaataaaatgtgtagcctgtgaaacaccgaaacctggaacttgtgtgaagcgagcccttacattgacagtggtttcggaaagtgctgagactatgactgcttcatcttccagctgcactgtaaccactggtaccttaggatttggagataaattcaaaaggcccattggatcttgggagtgttcagtatgctgtgtttctaataatgcagaagacaataagtgtgtgtcctgtatgtctgagaaaccaggaagttcagtacctgcttcaagtagcagcactgtacctgtctctctgccttctggaggctctctaggattggaaaagttcaagaaacccgagggaagctgggactgtgaattgtgcctagtgcagaataaggcagactctaccaaatgtttggcatgtgaaagtgcaaagccaggcacaaaatctgggtttaaaggctttgacacatcttcctcatcttcgaactcagcagcctcctcatccttcaaatttggtgtctcatcatcctcttctgggccttctcagactttaacaagcactggaaattttaaatttggagatcagggaggattcaaaataggtgtgtcatccgattctgggtctataaaccccatgagtgaaggctttaaattttctaaaccaataggagattttaaatttggagtttcatctgaatctaagcccgaagaagttaaaaaagatagtaagaatgataattttaagtttggactttcttctggtttaagcaacccagtttctttaactccatttcaatttggggtatctaatcttggacaggaagaaaagaaagaggaactgcccaaatcttcctctgcaggttttagctttggtacaggtgttattaactccacccctgctcctgctaacaccatagtgacctctgagaacaagagcagcttcaaccttggaaccatagaaaccaagagtgcttcagtggctcctttcacatgtaagacatcagaagctaaaaaagaagaaatgcctgccaccaaaggaggattctcttttggcaacgtggagcctgcctctctgccatctgcctcagtgtttgttttgggaaggacagaagagaaacagcaagagcctgtcacttctacttccctagtttttgggaagaaagctgacaatgaagagccaaagtgtcaaccagtgttttcctttgggaattcagagcaaaccaaagatgagaattcttcaaagtccacatttagttttagtatgacaaaaccatctgagaaggaatctgaacagccagcaaaagccacttttgcctttggagctcaaactagtactacagctgatcaaggtgcagcaaagccagtttttagtttcttgaacaacagttcctctagttcaagtacaccagccacttctgctggtggtggcatatttggtagttccacctcttcctccaatccacctgtggctacctttgtgtttggacagtccagcaatcctgtgagcagctctgcctttggtaacactgctgaatccagcacctctcagtctttgctattttctcaagatagcaaactagcaaccacatccagcacaggtacagctgtcaccccatttgtctttggtccaggagccagcagtaataatactaccacctctggtttcggctttggagccacaaccacatctagctctgcaggatcctcctttgtatttggaactggaccctcagcaccatctgccagtccagcatttggtgctaaccagaccccaacatttggacaaagtcaaggtgccagccagcccaatcccccaggctttggatctatatcatcttccacagcattatttcccactggttctcagcctgcaccacctacttttgggacagtgtcaagcagtagccagccccctgtgtttggacagcaacctagtcagtctgcatttggctctggaacaactcctaattctagttcggctttccagtttggcagcagcactacaaatttcaacttcacaaacaacagtccatcaggagtgttcacatttggtgcaaattctagcacacctgcagcctcagcccagccttcaggctcggggggctttccatttaaccagtctccagcagcatttacagtggggtcaaatgggaaaaatgtgttctcttcttctggaacttcattctctggtcgcaagataaagactgctgttagacgcaggaaataaaggtcacattggtgttgtactcaattttaacaacagctggtgccctgctttcagatactggattgtactttgtgctggggttatctgaagtcagatctgcctaaggacttctttaattttggaattttcctcctttctctttcgttacagaagccccaccctgcctcacccacccttttttaaataaataaatagctagactggtgactgattcttcagcaaaaatattttatgatccagcagattattcactgatttgacatagtctggctgtacccaggaatggagcctgcacggtgaatggctttgtatagaacctctttgtctacaccattatgtgcgctgataagcgttcatggaacgcgttgaaattgtaattatatctgaggaattctgtatagattagaattctgtatagattagagagtgttgaaacggatgatttctatgctgagtttgtgctggtgtatgtgtgaagtgagtgagttgggtgtattgtgcgctaaacttttctgatagaggaagcctgattaaagaatggtccgtgctaaggacttgttagatctagttcactctccatttaataattatatgctatttctatattttcattctcctatcacctgtcttgcctttttcattattttattatgaaacttgtgtaaatacaattttgtttctgtactttttggcataacataaatctgtgaacttgaaatttgaattttgtgttagagatttttttgttgtttgtttagtcttgtctcagattttattatgtaaatcccattattcaaagttgcctaaatccatttggaaatctttaaaaaaaaaattggggattcttaaagttgaatttattggcttttctgatccagttttgtttggaccaaaaaccagtattgtacaaagtattaagcatatatttttatatttactaaaatggactgtggtgactttggataataaggaaaagtttaatattaaagccatgtttattacagtataattaacatgttaaaccatgggataaatgccatcaataaaaaattatgacat

SEQ ID NO: 20864 - DNA, 4613 bp, Homo sapiens
ttacccgccccggagcgggaagcggcggaggctccgccatggcctcgggagccggaggagtcggagggggcggtggcggcaagatccggacgcggcgttgccaccaggggccaattaagccttaccagcaggggcgacaacagcatcagggcattcttagcagggttacagaatctgttaagaatattgtgccagggtggctacaaagatacttcaacaagaatgaagatgtatgcagctgttcaacagacacaagcgaggttccacgctggccagaaaataaagaggaccatctggtatatgccgatgaggagagctctaatattactgatgggagaatcacacctgagccagcagtcagtaatacagaagaaccttcaacaactagtactgcttcaaattatccagatgtgttaacaaggccttctcttcatcggagccatctgaatttttccatgttggaatcccctgcattacactgtcagccatctacatcctcggcattcccaattggcagttcgggattttcccttgtaaaggaaattaaagattctacctctcagcatgatgatgataacatctcaactaccagtggtttttcttcaagagcttctgataaagatataactgtttcaaagaacacttcattgccacctctgtggtccccagaagctgaacgttctcactcactctcacagcacactgccaccagctcaaaaaaaccagcattcaacttgtctgcctttggaacactttccccttcacttgggaattcttcaatccttaaaaccagtcagcttggagattctcctttttatcctggaaaaacaacatacggtggggcagcagctgctgtaagacagtctaaactacgaaatacaccttatcaggcaccagttagaagacaaatgaaagctaagcaactcagtgcacaatcttacggtgtgaccagttcaacagctcggcgaatattgcagtctttagagaagatgtcaagccctttagcggatgcaaaaagaattccatccattgtttcttctcctctgaattctcctcttgataggagtgggatagatatcacagattttcaggccaaaagagaaaaggtggattctcaatatcctcctgttcagagacttatgaccccaaagccagtttccatagcaacaaatcgaagtgtttattttaaaccatctctgactccttctggtgaattcaggaagactaatcaaagaatagataacaagtgcagtactggatatgaaaaaaatatgacacccggacaaaatagagaacaacgagaaagtggcttttcatatccaaatttcagtttgcctgcagccaatggtttatcttctggagtaggtggtggaggtggcaagatgagacgagaaagaacacgctttgttgcttctaaacctctggaggaggagagacaaggtctcaccgtattgcccaagctgatctcgagctcctgcgctcaagcgatcatcccatcttggcctctcaaagtgctgagattacaggaaatggaagttccagtattaccgaaaatctctctaccgatcaccagttcttcactgcctacctttaattttagttcccctgagatcacaacttcctctccatcacccatcaattcgtctcaagcattaacaaacaaggtacaaatgacctctccgagcagcactggcagtcccatgtttaaattttcatctccaatcgtaaaatctactgaggcaaatgtactacctccatcatctattggatttacatttagtgtgcctgttgcaaaaacagcagaactttctggttctagtagtactttagaaccaattataagtagttcagctcatcatgtcactacagtgaacagtacaaattgtaagaagacaccacctgaagattgtgagggtccttttagacctgcagaaatcctgaaagaaggaagtgttctagatattctgaaaagccctggtttcgcatcgccgaagatagattctgttgctgctcagcccaccgcaacaagcccagtagtttatacaagaccagcaataagtagcttttcttctagtggaattgggtttggggagagtttaaaagctgggtcatcatggcagtgtgatacatgtctactccagaacaaagttacagacaacaaatgcatagcctgtcaagcagcaaaattgtcacccagagatactgctaaacagactggaattgaaacaccaaataaaagtggcaaaacaactctttctgcatcagggacaggctttggagacaaatttaaaccagtgataggcacttgggattgtgatacctgtttagtgcaaaataaacctgaagcaataaaatgtgtagcctgtgaaacaccgaaacctggaacttgtgtgaagcgagcccttacattgacagtggtttcggaaagtgctgagactatgactgcttcatcttccagctgcactgtaaccactggtaccttaggatttggagataaattcaaaaggcccattggatcttgggagtgttcagtatgctgtgtttctaataatgcagaagacaataagtgtgtgtcctgtatgtctgagaaaccaggaagttcagtacctgcttcaagtagcagcactgtacctgtctctctgccttctggaggctctctaggattggaaaagttcaagaaacccgagggaagctgggactgtgaattgtgcctagtgcagaataaggcagactctaccaaatgtttggcatgtgaaagtgcaaagccaggcacaaaatctgggtttaaaggctttgacacatcttcctcatcttcgaactcagcagcctcctcatccttcaaatttggtgtctcatcatcctcttctgggccttctcagactttaacaagcactggaaattttaaatttggagatcagggaggattcaaaataggtgtgtcatccgattctgggtctataaaccccatgagtgaaggctttaaattttctaaaccaataggagattttaaatttggagtttcatctgaatctaagcccgaagaagttaaaaaagatagtaagaatgataattttaagtttggactttcttctggtttaagcaacccagtttctttaactccatttcaatttggggtatctaatcttggacaggaagaaaagaaagaggaactgcccaaatcttcctctgcaggttttagctttggtacaggtgttattaactccacccctgctcctgctaacaccatagtgacctctgagaacaagagcagcttcaaccttggaaccatagaaaccaagagtgcttcagtggctcctttcacatgtaagacatcagaagctaaaaaagaagaaatgcctgccaccaaaggaggattctcttttggcaacgtggagcctgcctctctgccatctgcctcagtgtttgttttgggaaggacagaagagaaacagcaagagcctgtcacttctacttccctagtttttgggaagaaagctgacaatgaagagccaaagtgtcaaccagtgttttcctttgggaattcagagcaaaccaaagatgagaattcttcaaagtccacatttagttttagtatgacaaaaccatctgagaaggaatctgaacagccagcaaaagccacttttgcctttggagctcaaactagtactacagctgatcaaggtgcagcaaagccagtttttagtttcttgaacaacagttcctctagttcaagtacaccagccacttctgctggtggtggcatatttggtagttccacctcttcctccaatccacctgtggctacctttgtgtttggacagtccagcaatcctgtgagcagctctgcctttggtaacactgctgaatccagcacctctcagtctttgctattttctcaagatagcaaactagcaaccacatccagcacaggtacagctgtcaccccatttgtctttggtccaggagccagcagtaataatactaccacctctggtttcggctttggagccacaaccacatctagctctgcaggatcctcctttgtatttggaactggaccctcagcaccatctgccagtccagcatttggtgctaaccagaccccaacatttggacaaagtcaaggtgccagccagcccaatcccccaggctttggatctatatcatcttccacagcattatttcccactggttctcagcctgcaccacctacttttgggacagtgtcaagcagtagccagccccctgtgtttggacagcaacctagtcagtctgcatttggctctggaacaactcctaattctagttcggctttccagtttggcagcagcactacaaatttcaacttcacaaacaacagtccatcaggagtgttcacatttggtgcaaattctagcacacctgcagcctcagcccagccttcaggctcggggggctttccatttaaccagtctccagcagcatttacagtggggtcaaatgggaaaaatgtgttctcttcttctggaacttcattctctggtcgcaagataaagactgctgttagacgcaggaaataaaggtcacattggtgttgtactcaattttaacaacagctggtgccctgctttcag

SEQ ID NO: 20865 - DNA, 8143 bp, Homo sapiens
ctcccaacagcttcctcttcccaggccagaacggcgtcttccagttccccaccggatgaagcggaagtgcgtcatgtcgaggcgccaaggcgctcgtttggcgcgcgcgccctaggcggcggatctaagctaacttcttggatcttttcttgtttctccttggtttttgactttttctggaccctggtgtctacgatttccgagatgccgtcttctttgttgggcgcggcgatgccggcctctacatctgccgcagccctgcaggaagctctggaaaatgctggacggctcatcgaccgtcagttgcaagaggaccgcatgtacccggacctttccgagctgcttatggtgtctgccccaaataatcccaccgtttctggcatgtcagatatggattatcctttgcaaggacctggtttgctgtccgtacccaaccttccagagatcagttccatccgaagagttcctctcccacctgaacttgttgagcagtttggacatatgcagtgtaattgcatgatgggtgtgttccctcctatcagcagagcttggctcacaattgacagtgatatattcatgtggaactatgaggatggaggagaccttgcctattttgatggacttagtgagactattcttgctgtggggcttgtgaagccaaaagcaggcatctttcaacctcatgtgcgacacctcctggttttggcgacccctgtagacatagtaattcttggactcagctatgctaatttgcaaacaggttctggagttcttaatgatagtttgtctggtggaatgcagttgcttccagatcctttatattctcttcctactgataatacttaccttttaacaataacttccactgataatggcagaattttcttggctggaaaggatggctgtttatatgaagtagcctaccaggctgaagcagggtggtttagccaaagatgtaggaaaataaaccactcaaagagctcactttctttccttgttccttccttgctacaattcacgttctcagaagatgatcctattcttcaaattgcaattgataattctagaaatattttatatacacgatctgagaaaggagtaatacaggtgtatgatttgggacaagatggacaaggaatgagcagagttgcctctgtgtcacagaatgccattgtctctgctgctggtaacattgctaggaccatcgatcgttctgtttttaaaccaattgtccaaatagcagtgattgaaaattctgaatcactggactgtcagttattggctgtcacacatgcaggtgttaggttatattttagcacttgtccattcagacagccattagcacggcctaatacactgacgctggttcatgtccgcttacctcctggattctcagcatcttcaaccgtggaaaagccttcaaaagtacatagagctctttatagtaaaggtattctattgatggcagcctcagaaaatgaggataatgatattttatggtgtgtcaaccatgatacttttcctttccaaaagccaatgatggaaacccagatgacagctggtgttgatggtcattcctgggctctttctgcgatagatgaattgaaagtagataaaataattacacctttaaacaaggatcatattccaataactgattcaccagttgttgtacagcagcacatgttacctccgaagaaatttgttctcctctcagcacaggggagccttatgtttcataaacttagacctgtagatcaactgaggcatctacttgtgagtaatgtgggaggagatggagaagagattgaaagattctttaaattacatcaggaagaccaggcttgtgcaacttgccttattcttgcttgctccactgctgcctgtgatagagaagtatctgcctgggctactcgggctttctttaggtatggtggtgaagcacagatgagatttccaaccactcttccgcctccaagtaatgttggtcccatcttggggtctcctgtctattctagttctcctgttcctagtggtagtccctatccaaatccatcctttttgggaacaccgtctcatggtatacagcctcctgccatgtcaactccagtgtgtgctctgggaaacccagcaactcaggccacaaatatgagttgtgtgactggaccagagattgtgtactctggaaaacacaatggtatttgcatttacttttctcggatcatgggaaacatttgggatgcaagcttagttgtggagagaatattcaagagtggcaacagagagatcactgcaattgaaagtagtgttccctgccaactgctagagtcagtgctacaagaactaaagggtttgcaggaatttctagacagaaactcccagtttgcaggaggaccattaggaaatccaaatactactgctaaagtgcagcagaggctgataggattcatgcgtcctgaaaacggaaatccccagcaaatgcaacaggaactgcagaggaagtttcatgaggctcaactaagtgaaaagatttcacttcaggcaattcagcagttggttcgaaaatcatatcaggctctggctttatggaaacttctttgtgaacatcaattcactatcattgtggcagaacttcagaaggaacttcaagagcagctgaagatcaccacctttaaagatcttgtaatcagggacaaagaactcacaggggcattaattgcttctcttatcaactgctacatcagagataatgccgctgttgatggcattagtttacatttacaggatatctgcccacttctatatagcactgatgatgcaatttgttctaaggcaaatgagcttctccagcgttcccgacaagttcaaaataagactgaaaaagaaagaatgttaagggaatcattaaaggaatatcaaaaaattagcaatcaagtggacctttccaatgtttgtgctcagtatagacaagtgagattttatgagggtgtggtggaactttctcttacggctgcagagaaaaaagatcctcaaggtcttgggcttcatttctataaacatggagaaccagaagaagacatagttggacttcaggccttccaagaaagattaaacagttacaaatgcattacagacacacttcaagaactggtaaatcaaagtaaggccgctcctcagtctcccagtgtacccaaaaaacctggtcctccagtgttgtcatctgatccaaatatgctgagtaatgaagaagcaggacatcattttgaacaaatgcttaaattgtcacagcgatccaaggatgagctctttagtattgccctttataattggctaatacaagtcgaccttgcagataagctgctacaggttgcttctccatttctggagccacatctagtccgaatggccaaagttgatcaaaacagagttcgttatatggatttactctggcggtattacgagaagaacagaagtttcagtaatgctgctcgtgtactgtccagactggctgacatgcatagcacagaaatttcacttcagcagcgactagagtacattgctcgagccattcttagtgccaaaagttccactgccatttcatcaatagctgccgatggtgaatttcttcatgaattagaagaaaaaatggaggttgctaggatccaacttcagatacaggagacactacaaaggcagtattcccatcattcttctgtacaggatgcagtttctcagctggattctgagctgatggacataactaagctttatggggaatttgctgacccatttaaacttgcagagtgcaaacttgcaataattcattgtgccggttattcagaccctatattggtgcagacactttggcaagatatcatagagaaagaattgagtgacagtgtgacattgagctcctcggatagaatgcatgctcttagtctcaagattgttctccttggcaaaatttatgctggcacaccacgcttctttcctttagattttattgtacagtttttagaacagcaggtttgtactttgaactgggatgtgggcttcgtaatacagacaatgaatgaaattggagtaccattacctagactactagaagtttatgatcagttgttcaaatcacgggatccattctggaacagaatgaagaagccactgcaccttttggattgtatacatgtattattgataagatatgttgagaatcccagccaagttttaaattgtgaaaggagaagatttacaaatctctgcctggatgctgtttgtggttaccttgttgagctccagtctatgagctcgtcagtagcagtacaagccatcactgggaattttaaatctcttcaagctaaattagaacggcttcattaattactgtgatatactttcatccgttttatgatctgtaaaataaaaactcagctgggtccagatatcaggtgttctaaatctaagaatgtaagaacaatcttaatagaaatatgtttttaataagtggctaatatctacaaatagtacctttgctaaatgaattcttttttatgactattttgttttttagtaattgggtgaaaaaacaactgaaatgagattatttattattttaacataaggattaaaaaaatttagaaactcttattttgaattgtactgcaggcagaaatttcgaatttatattattcattttcaagttagtccaaggatattggcattaaaactccactaggcggccaggcacagtgacttacacctgtaatcccagcactttgggaggccaaggtgggcgaatcacgaggccaagagtttgagaccaacctggccaacatggtgaaaccccatctctactaaaaatacaaaaaaaaatagccaggcgtggtggcgggcgcctgtaatcccagctactcgggaggctgagggaggcgaatcacttgaacccgggaggcagaggtttcagtgagtcaaaatcgcaccattgcactccagcccaggcaacagggcgagactctgtctcaaaaaacaaaaaaacctcaaataggctaagcagatccattcccataatagtggattctaaaaccgtccttaaataggcaaataactgactttttcaaaactttttttaggtgttgggttcacccttgaaagaactgtcctctaacaactggttttgtcagttaaagcccttgagaattgacatagctatatacctggttgagcaggtgataaaacttgtaactaatgttgtgtcctgaaaacctacacagggaggtactgttttcccttagtgtctacctggctgcttggccttgtgactactgattccattagagcagtggttctcaaagtatgtgctccaaaccagaagcatcagcatcagcatcagcatcacctaggaatttgttagaaatgcaaattctcgagccccaacccagacctactgaatcaaaaacgtgggggatgaggccctgctttctatgttttaacaagctctccaggagattttggtgcatgtcaaatttgaaagccactgcagtaaaggatactgctaccttccatagtttatggactgagctacctatctggctcctcctctgtgaataaccacacacacaaattttgcccaaggcacacaatatataaagcaaaactgttagtaatgtactttttaattattccttaacaaaatagaataaccaaaccaaatgcttcaaagtaatagcaacaagagagaagaagagtgggaatgaccagagctaacaaaacactctattcctttctctcttttttttttttttggagacagaatctcaccctgtagcccagcctggagtgcagtggtgcgatcccggctcactgcaacctctgcctcacaggtttgaagcaatttgcctgcctcagcctctcgagtagctgggattgcaggtgtgcgccaccatacccagctaatttttgtatttttagtagagatgggtttcaccatgttggccaggctggtcttgaactcctgacctcaagtgatctgcccgcctccacctcccaaagtgttgagattacagacgtgagccaatgtgcctggcctattcccttctctctttatgctaccacaaataattaccttctgtttattgtaagtgatgcatgtctaacaatttgtacaatacattttgaatatatttttccttccattattgtcttttcccaagaccatagggttgccttctctacatttgttctcttagaattcagctcccttttccctataatcttctaatgtagaatatttaatagaatgccagaacgtcactcagtgggtactactacctcttatttttcaacttttcagtttcttaagtttagcgttttttgaatatgtaaagtgaatgtatgcgatacattaattcgttttataaatttaaaattctgtcatgtctacttaaaaggaaggccttgtctgaatgttgtaatttaggtgtgactccagttctgctagagataagaacttcatttttgttttaagcacatttacatactagcaatatgttgttatatatactcagctcacaacattgaaagtacatgttttaaaagggctgtaggcttccatggttagatggtctgttagagtcagaaatctgaacactgtccttttattcacacagcatgctttgagaggttttaggaattccagccccacaacagatgcttgcaataccttttggggggtaagattcctaagagagaagaaattaggtcccctcatttttacccttggaacagtgtttctaaaactttcacattcagaacaatcagccggatagcctgttatgacagattcttgagttccatctgtagtgtcatgctgatcctggcagtcagtggatcagagttggagtagcatttatccactgtattagtatactttgtacttggtgtttgttcaacgcattacttttttgaatttttttgttttttgaagacaagggcttgccctggagtgcagtggcatgatcttggctcactgcagcctcgagctcctgggctcaactcagtcttcccacctcatcctcttaaatagctgggactacaggcacgtgctgctacaccctgctattgtctgtttgtttgtttgagactgagttttgctcttgttgcccaggctggagtgcaatggcacaatcttggctcaccacagccttttttatgagactgagttttgctcttgttgcccaggctggagtgcaatggcacgatcttggctcaccacaacctccacttcctgggttcaagcaattcttctgcctcagcctcccgagtagctgagattacaggcatgcgccaccatgcctggctaattttttttttttgtatttttagtagagatggggtttcaccgtgttggtcaggctggtcttgaactcctgacctcaggtgatccaccccccttggcctcccaaagagctgggattacaggcatgagccactgcgcctagccccaccccccctactttttttttttttttttttttaattttttgtgtagccaaaagatctcactctgttgcccagactgctctcaaaactcctggccttaagtgattcccctgcctcagtctcccaaagtgctgggattataggcatgagccaccatgcctgtccattatttctttatagtgactattatatgtaggcaatgtataattggtagaacatagtctatgaaacagtgcgttaattgtgggcagtgaagaatcattgaagttgtgaaatttgtattttaactagatcattgtagtatggcaaaacggttaggaaagagaaagctatcttgactaactgtttatgctatgagatactgactgatgtacatgtacatttagtgtttctttaggtatacctgacttattcattgaacacctatccactgatctcaaaagtattcctcagggtagtctccattcctgtcatttttcctcctattcatgagacggaaaaattatgaccatggtacagagttgtatcaaggaaatgaagaactagaacattgaattgaaaggttttgaaagggttcacaatttcttttcattttctattaatgtcttcttttaaattctcttaagaataaaacttttttctaata

SEQ ID NO: 20866 - DNA, 4200 bp, Homo sapiens
gactctcgcctgacttcctaatttgctacttatccccagcgttggtcccggcgaggatatgctgagatttatggcactgttggctgcatttttggagaacagcaagcagcttcttttcagataatcccaccgtttctggcatgtcagatatggattatcctttgcaaggacctggtttgctgtccgtacccaaccttccagagatcagttccatccgaagagttcctctcccacctgaacttgttgagcagtttggacatatgcagtgtaattgcatgatgggtgtgttccctcctatcagcagagcttggctcacaattgacagtgatatattcatgtggaactatgaggatggaggagaccttgcctattttgatggacttagtgagactattcttgctgtggggcttgtgaagccaaaagcaggcatctttcaacctcatgtgcgacacctcctggttttggcgacccctgtagacatagtaattcttggactcagctatgctaatttgcaaacaggttctggagttcttaatgatagtttgtctggtggaatgcagttgcttccagatcctttatattctcttcctactgataatacttaccttttaacaataacttccactgataatggcagaattttcttggctggaaaggatggctgtttatatgaagtagcctaccaggctgaagcagggtggtttagccaaagatgtaggaaaataaaccactcaaagagctcactttctttccttgttccttccttgctacaattcacgttctcagaagatgatcctattcttcaaattgcaattgataattctagaaatattttatatacacgatctgagaaaggagtaatacaggtgtatgatttgggacaagatggacaaggaatgagcagagttgcctctgtgtcacagaatgccattgtctctgctgctggtaacattgctaggaccatcgatcgttctgtttttaaaccaattgtccaaatagcagtgattgaaaattctgaatcactggactgtcagttattggctgtcacacatgcaggtgttaggttatattttagcacttgtccattcagacagccattagcacggcctaatacactgacgctggttcatgtccgcttacctcctggattctcagcatcttcaaccgtggaaaagccttcaaaagtacatagagctctttatagtaaaggtattctattgatggcagcctcagaaaatgaggataatgatattttatggtgtgtcaaccatgatacttttcctttccaaaagccaatgatggaaacccagatgacagctggtgttgatggtcattcctgggctctttctgcgatagatgaattgaaagtagataaaataattacacctttaaacaaggatcatattccaataactgattcaccagttgttgtacagcagcacatgttacctccgaagaaatttgttctcctctcagcacaggggagccttatgtttcataaacttagacctgtagatcaactgaggcatctacttgtgagtaatgtgggaggagatggagaagagattgaaagattctttaaattacatcaggaagaccaggcttgtgcaacttgccttattcttgcttgctccactgctgcctgtgatagagaagtatctgcctgggctactcgggctttctttaggtatggtggtgaagcacagatgagatttccaaccactcttccgcctccaagtaatgttggtcccatcttggggtctcctgtctattctagttctcctgttcctagtggtagtccctatccaaatccatcctttttgggaacaccgtctcatggtatacagcctcctgccatgtcaactccagtgtgtgctctgggaaacccagcaactcaggccacaaatatgagttgtgtgactggaccagagattgtgtactctggaaaacacaatggtatttgcatttacttttctcggatcatgggaaacatttgggatgcaagcttagttgtggagagaatattcaagagtggcaacagagagatcactgcaattgaaagtagtgttccctgccaactgctagagtcagtgctacaagaactaaagggtttgcaggaatttctagacagaaactcccagtttgcaggaggaccattaggaaatccaaatactactgctaaagtgcagcagaggctgataggattcatgcgtcctgaaaacggaaatccccagcaaatgcaacaggaactgcagaggaagtttcatgaggctcaactaagtgaaaagatttcacttcaggcaattcagcagttggttcgaaaatcatatcaggctctggctttatggaaacttctttgtgaacatcaattcactatcattgtggcagaacttcagaaggaacttcaagagcagctgaagatcaccacctttaaagatcttgtaatcagggacaaagaactcacaggggcattaattgcttctcttatcaactgctacatcagagataatgccgctgttgatggcattagtttacatttacaggatatctgcccacttctatatagcactgatgatgcaatttgttctaaggcaaatgagcttctccagcgttcccgacaagttcaaaataagactgaaaaagaaagaatgttaagggaatcattaaaggaatatcaaaaaattagcaatcaagtggacctttccaatgtttgtgctcagtatagacaagtgagattttatgagggtgtggtggaactttctcttacggctgcagagaaaaaagatcctcaaggtcttgggcttcatttctataaacatggagaaccagaagaagacatagttggacttcaggccttccaagaaagattaaacagttacaaatgcattacagacacacttcaagaactggtaaatcaaagtaaggccgctcctcagtctcccagtgtacccaaaaaacctggtcctccagtgttgtcatctgatccaaatatgctgagtaatgaagaagcaggacatcattttgaacaaatgcttaaattgtcacagcgatccaaggatgagctctttagtattgccctttataattggctaatacaagtcgaccttgcagataagctgctacaggttgcttctccatttctggagccacatctagtccgaatggccaaagttgatcaaaacagagttcgttatatggatttactctggcggtattacgagaagaacagaagtttcagtaatgctgctcgtgtactgtccagactggctgacatgcatagcacagaaatttcacttcagcagcgactagagtacattgctcgagccattcttagtgccaaaagttccactgccatttcatcaatagctgccgatggtgaatttcttcatgaattagaagaaaaaatggaggttgctaggatccaacttcagatacaggagacactacaaaggcagtattcccatcattcttctgtacaggatgcagtttctcagctggattctgagctgatggacataactaagctttatggggaatttgctgacccatttaaacttgcagagtgcaaacttgcaataattcattgtgccggttattcagaccctatattggtgcagacactttggcaagatatcatagagaaagaattgagtgacagtgtgacattgagctcctcggatagaatgcatgctcttagtctcaagattgttctccttggcaaaatttatgctggcacaccacgcttctttcctttagattttattgtacagtttttagaacagcaggtttgtactttgaactgggatgtgggcttcgtaatacagacaatgaatgaaattggagtaccattacctagactactagaagtttatgatcagttgttcaaatcacgggatccattctggaacagaatgaagaagccactgcaccttttggattgtatacatgtattattgataagatatgttgagaatcccagccaagttttaaattgtgaaaggagaagatttacaaatctctgcctggatgctgtttgtggttaccttgttgagctccagtctatgagctcgtcagtagcagtacaagccatcactgggaattttaaatctcttcaagctaaattagaacggcttcattaattactgtgatatactttcatccgttttatgatctgtaaaataaaaactcagctgggtccag

SEQ ID NO: 20867 - DNA, 4224 bp, Homo sapiens
gaggcgccaaggcgctcgtttggcgcgcgcgccctaggcggcggatctaagctctggaaaatgctggacggctcatcgaccgtcagttgcaagaggaccgcatgtacccggacctttccgagctgcttatggtgtctgccccaaataatcccaccgtttctggcatgtcagatatggattatcctttgcaaggacctggtttgctgtccgtacccaaccttccagagatcagttccatccgaagagttcctctcccacctgaacttgttgagcagtttggacatatgcagtgtaattgcatgatgggtgtgttccctcctatcagcagagcttggctcacaattgacagtgatatattcatgtggaactatgaggatggaggagaccttgcctattttgatggacttagtgagactattcttgctgtggggcttgtgaagccaaaagcaggcatctttcaacctcatgtgcgacacctcctggttttggcgacccctgtagacatagtaattcttggactcagctatgctaatttgcaaacaggttctggagttcttaatgatagtttgtctggtggaatgcagttgcttccagatcctttatattctcttcctactgataatacttaccttttaacaataacttccactgataatggcagaattttcttggctggaaaggatggctgtttatatgaagtagcctaccaggctgaagcagggtggtttagccaaagatgtaggaaaataaaccactcaaagagctcactttctttccttgttccttccttgctacaattcacgttctcagaagatgatcctattcttcaaattgcaattgataattctagaaatattttatatacacgatctgagaaaggagtaatacaggtgtatgatttgggacaagatggacaaggaatgagcagagttgcctctgtgtcacagaatgccattgtctctgctgctggtaacattgctaggaccatcgatcgttctgtttttaaaccaattgtccaaatagcagtgattgaaaattctgaatcactggactgtcagttattggctgtcacacatgcaggtgttaggttatattttagcacttgtccattcagacagccattagcacggcctaatacactgacgctggttcatgtccgcttacctcctggattctcagcatcttcaaccgtggaaaagccttcaaaagtacatagagctctttatagtaaaggtattctattgatggcagcctcagaaaatgaggataatgatattttatggtgtgtcaaccatgatacttttcctttccaaaagccaatgatggaaacccagatgacagctggtgttgatggtcattcctgggctctttctgcgatagatgaattgaaagtagataaaataattacacctttaaacaaggatcatattccaataactgattcaccagttgttgtacagcagcacatgttacctccgaagaaatttgttctcctctcagcacaggggagccttatgtttcataaacttagacctgtagatcaactgaggcatctacttgtgagtaatgtgggaggagatggagaagagattgaaagattctttaaattacatcaggaagaccaggcttgtgcaacttgccttattcttgcttgctccactgctgcctgtgatagagaagtatctgcctgggctactcgggctttctttaggtatggtggtgaagcacagatgagatttccaaccactcttccgcctccaagtaatgttggtcccatcttggggtctcctgtctattctagttctcctgttcctagtggtagtccctatccaaatccatcctttttgggaacaccgtctcatggtatacagcctcctgccatgtcaactccagtgtgtgctctgggaaacccagcaactcaggccacaaatatgagttgtgtgactggaccagagattgtgtactctggaaaacacaatggtatttgcatttacttttctcggatcatgggaaacatttgggatgcaagcttagttgtggagagaatattcaagagtggcaacagagagatcactgcaattgaaagtagtgttccctgccaactgctagagtcagtgctacaagaactaaagggtttgcaggaatttctagacagaaactcccagtttgcaggaggaccattaggaaatccaaatactactgctaaagtgcagcagaggctgataggattcatgcgtcctgaaaacggaaatccccagcaaatgcaacaggaactgcagaggaagtttcatgaggctcaactaagtgaaaagatttcacttcaggcaattcagcagttggttcgaaaatcatatcaggctctggctttatggaaacttctttgtgaacatcaattcactatcattgtggcagaacttcagaaggaacttcaagagcagctgaagatcaccacctttaaagatcttgtaatcagggacaaagaactcacaggggcattaattgcttctcttatcaactgctacatcagagataatgccgctgttgatggcattagtttacatttacaggatatctgcccacttctatatagcactgatgatgcaatttgttctaaggcaaatgagcttctccagcgttcccgacaagttcaaaataagactgaaaaagaaagaatgttaagggaatcattaaaggaatatcaaaaaattagcaatcaagtggacctttccaatgtttgtgctcagtatagacaagtgagattttatgagggtgtggtggaactttctcttacggctgcagagaaaaaagatcctcaaggtcttgggcttcatttctataaacatggagaaccagaagaagacatagttggacttcaggccttccaagaaagattaaacagttacaaatgcattacagacacacttcaagaactggtaaatcaaagtaaggccgctcctcagtctcccagtgtacccaaaaaacctggtcctccagtgttgtcatctgatccaaatatgctgagtaatgaagaagcaggacatcattttgaacaaatgcttaaattgtcacagcgatccaaggatgagctctttagtattgccctttataattggctaatacaagtcgaccttgcagataagctgctacaggttgcttctccatttctggagccacatctagtccgaatggccaaagttgatcaaaacagagttcgttatatggatttactctggcggtattacgagaagaacagaagtttcagtaatgctgctcgtgtactgtccagactggctgacatgcatagcacagaaatttcacttcagcagcgactagagtacattgctcgagccattcttagtgccaaaagttccactgccatttcatcaatagctgccgatggtgaatttcttcatgaattagaagaaaaaatggaggttgctaggatccaacttcagatacaggagacactacaaaggcagtattcccatcattcttctgtacaggatgcagtttctcagctggattctgagctgatggacataactaagctttatggggaatttgctgacccatttaaacttgcagagtgcaaacttgcaataattcattgtgccggttattcagaccctatattggtgcagacactttggcaagatatcatagagaaagaattgagtgacagtgtgacattgagctcctcggatagaatgcatgctcttagtctcaagattgttctccttggcaaaatttatgctggcacaccacgcttctttcctttagattttattgtacagtttttagaacagcaggtttgtactttgaactgggatgtgggcttcgtaatacagacaatgaatgaaattggagtaccattacctagactactagaagtttatgatcagttgttcaaatcacgggatccattctggaacagaatgaagaagccactgcaccttttggattgtatacatgtattattgataagatatgttgagaatcccagccaagttttaaattgtgaaaggagaagatttacaaatctctgcctggatgctgtttgtggttaccttgttgagctccagtctatgagctcgtcagtagcagtacaagccatcactgggaattttaaatctcttcaagctaaattagaacggcttcattaattactgtgatatactttcatccgttttatgatctgtaaaataaaaactcagctgggtccag

SEQ ID NO: 20868 - DNA, 4088 bp, Homo sapiens
gcgcgcgcgccctaggcggcggatctaagctaacttcttggatcttttcttgtttctccttggtttttgactttttctggaccctggtgtctacgatttccgagatgccgtcttctttgttgggcgcggcgatgccggcctctacatctgccgcagccctgcaggaagctctggaaaatgctggacggctcatcgaccgtcagttgcaagaggaccgcatgtacccggacctttccgagctgcttatggtgtctgccccaaataatcccaccgtttctggcatgtcagatatggattatcctttgcaaggacctggtttgctgtccgtacccaaccttccagagatcagttccatccgaagagttcctctcccacctgaacttgttgagcagtttggacatatgcagtgtaattgcatgatgggtgtgttccctcctatcagcagagcttggctcacaattgacagtgatatattcatgtggaactatgaggatggaggagaccttgcctattttgatggacttagtgagactattcttgctgtggggcttgtgaagccaaaagcaggcatctttcaacctcatgtgcgacacctcctggttttggcgacccctgtagacatagtaattcttggactcagctatgctaatttgcaaacaggttctggagttcttaatgatagtttgtctggtggaatgcagttgcttccagatcctttatattctcttcctactgataatacttaccttttaacaataacttccactgataatggcagaattttcttggctggaaaggatggctgtttatatgaagtagcctaccaggctgaagcagggtggtttagccaaagatgtaggaaaataaaccactcaaagagctcactttctttccttgttccttccttgctacaattcacgttctcagaagatgatcctattcttcaaattgcaattgataattctagaaatattttatatacacgatctgagaaaggagtaatacaggtgtatgatttgggacaagatggacaaggaatgagcagagttgcctctgtgtcacagaatgccattgtctctgctgctggtaacattgctaggaccatcgatcgttctgtttttaaaccaattgtccaaatagcagtgattgaaaattctgaatcactggactgtcagttattggctgtcacacatgcaggtgttaggttatattttagcacttgtccattcagacagccattagcacggcctaatacactgacgctggttcatgtccgcttacctcctggattctcagcatcttcaaccgtggaaaagccttcaaaagtacatagagctctttatagtaaaggtattctattgatggcagcctcagaaaatgaggataatgatattttatggtgtgtcaaccatgatacttttcctttccaaaagccaatgatggaaacccagatgacagctggtgttgatggtcattcctgggctctttctgcgatagatgaattgaaagtagataaaataattacacctttaaacaaggatcatattccaataactgattcaccagttgttgtacagcagcacatgttacctccgaagaaatttgttctcctctcagcacaggggagccttatgtttcataaacttagacctgtagatcaactgaggcatctacttgtgagtaatgtgggaggagatggagaagagattgaaagattctttaaattacatcaggaagaccaggcttgtgcaacttgccttattcttgcttgctccactgctgcctgtgatagagaagtatctgcctgggctactcgggctttctttaggtatggtggtgaagcacagatgagatttccaaccactcttccgcctccaagtaatgttggtcccatcttggggtctcctgtctattctagttctcctgttcctagtggtagtccctatccaaatccatcctttttgggaacaccgtctcatggtatacagcctcctgccatgtcaactccagtgtgtgctctgggaaacccagcaactcaggccacaaatatgagttgtgtgactggaccagagattgtgtactctggaaaacacaatggtatttgcatttacttttctcggatcatgggaaacatttgggatgcaagcttagttgtggagagaatattcaagagtggcaacagagagatcactgcaattgaaagtagtgttccctgccaactgctagagtcagtgctacaagaactaaagggtttgcaggaatttctagacagaaactcccagtttgcaggaggaccattaggaaatccaaatactactgctaaagtgcagcagaggctgataggattcatgcgtcctgaaaacggaaatccccagcaaatgcaacaggaactgcagaggaagtttcatgaggctcaactaagtgaaaagatttcacttcaggcaattcagcagttggttcgaaaatcatatcaggctctggctttatggaaacttctttgtgaacatcaattcactatcattgtggcagaacttcagaaggcaaatgagcttctccagcgttcccgacaagttcaaaataagactgaaaaagaaagaatgttaagggaatcattaaaggaatatcaaaaaattagcaatcaagtggacctttccaatgtttgtgctcagtatagacaagtgagattttatgagggtgtggtggaactttctcttacggctgcagagaaaaaagatcctcaaggtcttgggcttcatttctataaacatggagaaccagaagaagacatagttggacttcaggccttccaagaaagattaaacagttacaaatgcattacagacacacttcaagaactggtaaatcaaagtaaggccgctcctcagtctcccagtgtacccaaaaaacctggtcctccagtgttgtcatctgatccaaatatgctgagtaatgaagaagcaggacatcattttgaacaaatgcttaaattgtcacagcgatccaaggatgagctctttagtattgccctttataattggctaatacaagtcgaccttgcagataagctgctacaggttgcttctccatttctggagccacatctagtccgaatggccaaagttgatcaaaacagagttcgttatatggatttactctggcggtattacgagaagaacagaagtttcagtaatgctgctcgtgtactgtccagactggctgacatgcatagcacagaaatttcacttcagcagcgactagagtacattgctcgagccattcttagtgccaaaagttccactgccatttcatcaatagctgccgatggtgaatttcttcatgaattagaagaaaaaatggaggttgctaggatccaacttcagatacaggagacactacaaaggcagtattcccatcattcttctgtacaggatgcagtttctcagctggattctgagctgatggacataactaagctttatggggaatttgctgacccatttaaacttgcagagtgcaaacttgcaataattcattgtgccggttattcagaccctatattggtgcagacactttggcaagatatcatagagaaagaattgagtgacagtgtgacattgagctcctcggatagaatgcatgctcttagtctcaagattgttctccttggcaaaatttatgctggcacaccacgcttctttcctttagattttattgtacagtttttagaacagcaggtttgtactttgaactgggatgtgggcttcgtaatacagacaatgaatgaaattggagtaccattacctagactactagaagtttatgatcagttgttcaaatcacgggatccattctggaacagaatgaagaagccactgcaccttttggattgtatacatgtattattgataagatatgttgagaatcccagccaagttttaaattgtgaaaggagaagatttacaaatctctgcctggatgctgtttgtggttaccttgttgagctccagtctatgagctcgtcagtagcagtacaagccatcactgggaattttaaatctcttcaagctaaattagaacggcttcattaa

SEQ ID NO: 20869 - DNA, 5376 bp, Homo sapiens
gtggaagcctcgcaacgaagggccggagccgcctttctgctcccggaatgcttcacctgtccgcagctccgcccgccccacccccggaagtgacggcgaccgcgcggccctgcctttgttccgttgggcgtcgcggcgacggcgggaagatggcggcggcgggagccctggaacggagcttcgtggagctaagcggagctgagcgcgaaaggccgaggcactttcgggaattcacagtctgcagcattgggactgcaaatgccgtggctggcgccgtaaaatacagtgaaagcgcgggaggcttttactacgtggagagtggcaagttgttctccgtaaccagaaacaggttcattcattggaagacctctggagatacattggagctgatggaggagtcactggacataaatctgttgaataatgccattcgcctaaaattccaaaattgcagtgttttacctggaggggtttatgtctctgagactcagaatcgtgtgataatcttgatgttaaccaatcaaacagtgcacaggttacttttaccacacccctcccggatgtataggagtgagttggtagttgacagtcagatgcagtcaatattcactgacattggaaaagttgatttcacagatccttgcaactatcagttaattccagcagtacctggaatatctcctaattccaccgcctctacagcctggctcagcagtgatggggaggccctgtttgccttaccatgtgcttctgggggaatctttgttcttaagctacctccttatgacatacctggtatggtgtcagtcgtggaactgaaacagagttcagtaatgcaacgattgcttacaggctggatgccaacagctatcaggggtgaccagtcgccttcagatcgtcccctcagtcttgctgttcattgtgtggagcatgatgccttcatctttgctttgtgtcaggatcataaactacgaatgtggtcttacaaggagcaaatgtgcctaatggtagctgacatgctggagtatgtccctgtgaagaaagaccttcggcttactgctggaactggacacaaattacggcttgcttattcccccaccatgggactctacctggggatatacatgcatgcaccaaaacgaggacagttctgcattttccagttggtgagcactgagagtaatcgctatagtctcgatcatatttcttcactgttcacttctcaggagacactgattgactttgccttaacttccacggatatctgggccctgtggcatgatgctgagaaccaaacagtagtgaaatacatcaactttgaacataatgttgcaggtcagtggaatccagtttttatgcagcctctgccagaggaagagattgtcatcagagatgatcaagaccccagagagatgtatctgcaaagtctttttacaccaggacaattcacaaatgaagctttatgtaaggctttacagattttctgccgaggaactgagaggaatttggatctttcctggagtgaactgaagaaagaagttactttagctgttgaaaatgagcttcaaggaagtgtaacagagtatgaattctcccaggaggagtttcgaaatttacaacaagaattctggtgcaagttctatgcctgttgtcttcagtatcaagaagccctctctcaccctcttgccctacatttgaatccacacacaaacatggtgtgcctgctgaaaaaagggtacctgtctttccttattccctcatccttagtggatcatttgtatctcctgccttatgagaaccttttgacagaagatgagacaaccatatctgatgatgtggacatcgctcgggatgtcatatgtcttataaaatgcctccggctgattgaagagtcagtaactgtggatatgtcagttataatggaaatgagttgttataacctacagtctccggaaaaggctgcagagcagattctggaagatatgatcactattgatgtagaaaatgtgatggaggatatttgtagtaaactgcaagagattaggaacccaatccatgcaattggactacttatacgggaaatggattatgaaacagaagtggaaatggaaaagggattcaatccagctcagcctttgaatattcgaatgaatcttacccagctctatggtagtaacacagcagggtatattgtgtgcagaggggtgcataaaatcgccagtactcgtttcctgatctgcagagatcttttgatcttacagcagctgttaatgaggcttggagatgctgtgatttggggaactggtcagctctttcaagctcagcaagacctactacatcgaacagctcccctactcttatcttattacctcattaaatggggaagtgagtgcttggcaactgatgttccacttgacacactggagtctaatctccaacacttatcagtactggaattaacagactctggtgctttaatggcaaataggtttgtatctagtcctcagactattgtggagttattcttccaagaagttgcaagaaaacacattatatctcacctcttctctcagccaaaggcacctctgagccaaactggattgaattggcctgaaatgattactgcaattaccagttatttattgcagcttttatggcctagcaatcctggttgtctctttctagaatgtttgatgggaaattgccaatatgtacaattgcaggattatattcaactgctacatccctggtgtcaagtcaatgttggttcctgtcgatttatgctgggaaggtgttacctagttacaggagaaggacagaaggctctggaatgtttttgtcaggcagcatctgaagtaggcaaagaggaattcttggatcgcttgattcgctcagaggatggggagatcgtgtctacccccaggctgcagtattatgacaaggttttacgactactagatgtcattggtttgcctgaactggttattcagttggctacatcagccataactgaagcaggtgatgactggaaaagtcaggctactctaaggacatgtattttcaaacatcatttggatttgggtcacaatagccaagcatatgaagccttaacccaaattcctgattccagcaggcaattagattgtttacggcagttggtggtagttctttgtgaacgctcacagctacaggatcttgtagagtttccctatgtgaatctgcataatgaggttgtgggaataattgagtcacgtgctagagctgtggaccttatgactcacaattactatgaacttctgtatgcctttcacatctatcgccacaattaccgcaaggctggcacagtgatgtttgagtatggaatgcggcttggcagagaagttcgaactctccggggacttgagaaacaaggcaactgttatctggctgctctcaattgtttacgacttattcgtccagaatatgcgtggattgtgcagccagtgtctggtgcagtgtatgatcgccctggagcatcccctaagaggaatcatgatggagaatgcacagctgcccccacaaatcgacaaattgaaatcctggaactggaagatctggagaaagagtgttccttggctcgcatccgcctcactttggctcagcatgatccatcagcggttgcagttgctggaagttcatcagcagaggaaatggtcactctcttggttcaggcgggcctctttgacactgccatatcactctgtcagacttttaagcttcccttaacgccagtctttgaagggcttgccttcaaatgcatcaaattgcaatttggaggagaggcagcacaagcagaagcctgggcctggctagcagccaatcagctctcatctgtcatcactactaaggagtctagtgctacagatgaagcatggcgactattatccacttacctggagaggtacaaagtccagaataacttgtatcaccactgtgtaatcaacaagctcttgtctcatggagtgcctctgcctaattggcttataaacagttacaagaaggttgatgctgctgaattgcttcgtttatacttaaactatgaccttttagaagaagctgtggatttggtgtcagaatatgtggatgctgtattgggaaaaggacatcaatacttcggaattgagtttccactgtccgcaacagccccaatggtgtggcttccatactcctctattgatcagcttctccaagctctgggagagaacagtgccaacagtcacaacatcgcactgtcccagaaaatacttgacaaattggaggactaccagcaaaaagttgataaggcaacacgggatttattatatcgtcggaccttgtgatttggattgtcacctagcctttgtaaccgcttggtgcctcttaggacttaagactaccctacaggaaccctgtactcaaggccgatttttgtaactgtaaatgatgtgtacaacattcaagtctgcattctgcacaagataggagggcggaagagtcagaggaccctgtgcttgctggtggtgctaacacaatttctggtgttcaaccttggtctcaaatagctgcttttgtatatgattcacgagcttttttagagtttatatttttttaaactaccgaagacattcattatctgcaaattaagactcaccttcactttccaaaatagctgagggttgttggcttgttgtagctgaccaccaaaagcagtcactgcaaatcttttaattcttccctatcaccttttgtattttaatgcaattattttggtccagaactgacctgtattttctgtattgtacacaaaagctaataattttgtgtactttttatttattttggaggttttatatgatcttcaattgagtattaaataatttgcctagattaagcctaaaatgatgaccagctaattaaagaagatattttgaatctggttctgagctaaagttgagtaaattcttagctaagaaaaaattggaaatccatcatctatattagcaacagattctcagagtaaattgttaacttctatgatttatgataatcaagctggacttgatcatacaagttagtctcataatgtattggaccaaaatgtaaacttcattggtcagatttagaagcattcatgctcacaagttttgggaaagtgaaaaataataaaatcatcttggattttattctgtatattaaaatttatcttttaaggaaacaatctgtatactacttgcttgtatagccttttgacccttcttgagtttttcagaagcctttaatttttatactttcaataccatatttacattatatactttaattaacaatgtgagtttctctgtggtactgttgttgata

SEQ ID NO: 20870 - DNA, 5503 bp, Homo sapiens
ctcttctggattcctcgctgcccaccctcattctcccggtggaagcctcgcaacgaagggccggagccgcctttctgctcccggaatgcttcacctgtccgcagctccgcccgccccacccccggaagtgacggcgaccgcgcggccctgcctttgttccgttgggcgtcgcggcgacggcgggaagatggcggcggcgggagccctggaacggagcttcgtggagctaagcggagctgagcgcgaaaggccgaggcactttcgggaattcacagtctgcagcattgggactgcaaatgccgtggctggcgccgtaaaatacagtgaaagcgcgggaggcttttactacgtggagagtggcaagttgttctccgtaaccagaaacaggttcattcattggaagacctctggagatacattggagctgatggaggagtcactggacataaatctgttgaataatgccattcgcctaaaattccaaaattgcagtgttttacctggaggggtttatgtctctgagactcagaatcgtgtgataatcttgatgttaaccaatcaaacagtgcacaggttacttttaccacacccctcccggatgtataggagtgagttggtagttgacagtcagatgcagtcaatattcactgacattggaaaagttgatttcacagatccttgcaactatcagttaattccagcagtacctggaatatctcctaattccaccgcctctacagcctggctcagcagtgatggggaggccctgtttgccttaccatgtgcttctgggggaatctttgttcttaagctacctccttatgacatacctggtatggtgtcagtcgtggaactgaaacagagttcagtaatgcaacgattgcttacaggctggatgccaacagctatcaggggtgaccagtcgccttcagatcgtcccctcagtcttgctgttcattgtgtggagcatgatgccttcatctttgctttgtgtcaggatcataaactacgaatgtggtcttacaaggagcaaatgtgcctaatggtagctgacatgctggagtatgtccctgtgaagaaagaccttcggcttactgctggaactggacacaaattacggcttgcttattcccccaccatgggactctacctggggatatacatgcatgcaccaaaacgaggacagagacggggtttcgccatgttgcctggtctcaaactcctgagttcaagcagtccacccacctcggcttcccaatgtgctgggattacaagtgtgaaccacagcacccagcctgaatttttcttctgcattttccagttggtgagcactgagagtaatcgctatagtctcgatcatatttcttcactgttcacttctcaggagacactgattgactttgccttaacttccacggatatctgggccctgtggcatgatgctgagaaccaaacagtagtgaaatacatcaactttgaacataatgttgcaggtcagtggaatccagtttttatgcagcctctgccagaggaagagattgtcatcagagatgatcaagaccccagagagatgtatctgcaaagtctttttacaccaggacaattcacaaatgaagctttatgtaaggctttacagattttctgccgaggaactgagaggaatttggatctttcctggagtgaactgaagaaagaagttactttagctgttgaaaatgagcttcaaggaagtgtaacagagtatgaattctcccaggaggagtttcgaaatttacaacaagaattctggtgcaagttctatgcctgttgtcttcagtatcaagaagccctctctcaccctcttgccctacatttgaatccacacacaaacatggtgtgcctgctgaaaaaagggtacctgtctttccttattccctcatccttagtggatcatttgtatctcctgccttatgagaaccttttgacagaagatgagacaaccatatctgatgatgtggacatcgctcgggatgtcatatgtcttataaaatgcctccggctgattgaagagtcagtaactgtggatatgtcagttataatggaaatgagttgttataacctacagtctccggaaaaggctgcagagcagattctggaagatatgatcactattgatgtagaaaatgtgatggaggatatttgtagtaaactgcaagagattaggaacccaatccatgcaattggactacttatacgggaaatggattatgaaacagaagtggaaatggaaaagggattcaatccagctcagcctttgaatattcgaatgaatcttacccagctctatggtagtaacacagcagggtatattgtgtgcagaggggtgcataaaatcgccagtactcgtttcctgatctgcagagatcttttgatcttacagcagctgttaatgaggcttggagatgctgtgatttggggaactggtcagctctttcaagctcagcaagacctactacatcgaacagctcccctactcttatcttattacctcattaaatggggaagtgagtgcttggcaactgatgttccacttgacacactggagtctaatctccaacacttatcagtactggaattaacagactctggtgctttaatggcaaataggtttgtatctagtcctcagactattgtggagttattcttccaagaagttgcaagaaaacacattatatctcacctcttctctcagccaaaggcacctctgagccaaactggattgaattggcctgaaatgattactgcaattaccagttatttattgcagcttttatggcctagcaatcctggttgtctctttctagaatgtttgatgggaaattgccaatatgtacaattgcaggattatattcaactgctacatccctggtgtcaagtcaatgttggttcctgtcgatttatgctgggaaggtgttacctagttacaggagaaggacagaaggctctggaatgtttttgtcaggcagcatctgaagtaggcaaagaggaattcttggatcgcttgattcgctcagaggatggggagatcgtgtctacccccaggctgcagtattatgacaaggttttacgactactagatgtcattggtttgcctgaactggttattcagttggctacatcagccataactgaagcaggtgatgactggaaaagtcaggctactctaaggacatgtattttcaaacatcatttggatttgggtcacaatagccaagcatatgaagccttaacccaaattcctgattccagcaggcaattagattgtttacggcagttggtggtagttctttgtgaacgctcacagctacaggatcttgtagagtttccctatgtgaatctgcataatgaggttgtgggaataattgagtcacgtgctagagctgtggaccttatgactcacaattactatgaacttctgtatgcctttcacatctatcgccacaattaccgcaaggctggcacagtgatgtttgagtatggaatgcggcttggcagagaagttcgaactctccggggacttgagaaacaaggcaactgttatctggctgctctcaattgtttacgacttattcgtccagaatatgcgtggattgtgcagccagtgtctggtgcagtgtatgatcgccctggagcatcccctaagaggaatcatgatggagaatgcacagctgcccccacaaatcgacaaattgaaatcctggaactggaagatctggagaaagagtgttccttggctcgcatccgcctcactttggctcagcatgatccatcagcggttgcagttgctggaagttcatcagcagaggaaatggtcactctcttggttcaggcgggcctctttgacactgccatatcactctgtcagacttttaagcttcccttaacgccagtctttgaagggcttgccttcaaatgcatcaaattgcaatttggaggagaggcagcacaagcagaagcctgggcctggctagcagccaatcagctctcatctgtcatcactactaaggagtctagtgctacagatgaagcatggcgactattatccacttacctggagaggtacaaagtccagaataacttgtatcaccactgtgtaatcaacaagctcttgtctcatggagtgcctctgcctaattggcttataaacagttacaagaaggttgatgctgctgaattgcttcgtttatacttaaactatgaccttttagaagaagctgtggatttggtgtcagaatatgtggatgctgtattgggaaaaggacatcaatacttcggaattgagtttccactgtccgcaacagccccaatggtgtggcttccatactcctctattgatcagcttctccaagctctgggagagaacagtgccaacagtcacaacatcgcactgtcccagaaaatacttgacaaattggaggactaccagcaaaaagttgataaggcaacacgggatttattatatcgtcggaccttgtgatttggattgtcacctagcctttgtaaccgcttggtgcctcttaggacttaagactaccctacaggaaccctgtactcaaggccgatttttgtaactgtaaatgatgtgtacaacattcaagtctgcattctgcacaagataggagggcggaagagtcagaggaccctgtgcttgctggtggtgctaacacaatttctggtgttcaaccttggtctcaaatagctgcttttgtatatgattcacgagcttttttagagtttatatttttttaaactaccgaagacattcattatctgcaaattaagactcaccttcactttccaaaatagctgagggttgttggcttgttgtagctgaccaccaaaagcagtcactgcaaatcttttaattcttccctatcaccttttgtattttaatgcaattattttggtccagaactgacctgtattttctgtattgtacacaaaagctaataattttgtgtactttttatttattttggaggttttatatgatcttcaattgagtattaaataatttgcctagattaagcctaaaatgatgaccagctaattaaagaagatattttgaatctggttctgagctaaagttgagtaaattcttagctaagaaaaaattggaaatccatcatctatattagcaacagattctcagagtaaattgttaacttctatgatttatgataatcaagctggacttgatcatacaagttagtctcataatgtattggaccaaaatgtaaacttcattggtcagatttagaagcattcatgctcacaagttttgggaaagtgaaaaataataaaatcatcttggattttattctgtatattaaaatttatcttttaaggaaacaatctgtatactacttgcttgtatagccttttgacccttcttgagtttttcagaagcctttaatttttatactttcaataccatatttacattatatactttaattaacaa

SEQ ID NO: 20871 - DNA, 1537 bp, Homo sapiens
ccggccactggaaggttcccgcagatagagtctgcctcccctgcccccttctcttctggattcctcgctgcccaccctcattctcccggtggaagcctcgcaacgaagggccggagccgcctttctgctcccggaatgcttcacctgtccgcagctccgcccgccccacccccggaagtgacggcgaccgcgcggccctgcctttgttccgttgggcgtcgcggcgacggcgggaagatggcggcggcgggagccctggaacggagcttcgtggagctaagcggagctgagcgcgaaaggccgaggcactttcgggaattcacagtctgcagcattgggactgcaaatgccgtggctggcgccgtaaaatacagtgaaagcgcgggaggcttttactacgtggagagtggcaagttgttctccgtaaccagaaacaggttcattcattggaagacctctggagatacattggagctgatggaggagtcactggacataaatctgttgaataatgccattcgcctaaaattccaaaattgcagtgttttacctggaggggtttatgtctctgagactcagaatcgtgtgataatcttgatgttaaccaatcaaacagtgcacaggttacttttaccacacccctcccggatgtataggagtgtaagttggctaagtgcaatatcttttatttcccaaattactctgggtgtcacaaatgtagtgctggagcgatgtcttttggaattgaaggaaatttggattctcgttatccctcaccaagcatactttgatagctaccgcttaaaatgatcaggcatacattttaagttgagaattagttttcattaagaagaatagctttcttaaacttgacagttttttactttaaaaacttttttagcaatagagaggaactgagcaaaattctggttattttgatttaatagatttttctttttaattactcaacaggagttggtagttgacagtcagatgcagtcaatattcactgacattggaaaagttgatttcacagatccttgcaactatcagttaattccagcagtacctggaatatctcctaattccaccgcctctacagcctggctcagcagtgatggggaggccctgtttgccttaccatgtgcttctgggggaatctttgttcttaagctacctccttatgacatacctggtaagaatgggaactgagcatggatttaactttaaacaaggaatgttaacattgaaacagttcaacctcgtcatccaatgcagggattgcatctctactgccccggaactggtcattcattattgcttgcctaatgagtccctaatgctttacttttatacagtggataaggaactataaagcatattggagcacggaaaaacaaatagacaagtataagacagcctattctaaatcttgtagtagagatgggttgcctaattgtctgccctgagatggaggcattataacattataattaaattaattgaaacaaagacattaaataccctgcaccaagtt

SEQ ID NO: 20872 - DNA, 6266 bp, Homo sapiens
aagggctctgttagtgcgcctctaagatggcgacgcctttggcggtaaattcggctgctagtctatggggtccttacaaagacatttggcataaagtgggaaatgctctttggagaagacaacctgaagctgttcaccttcttgataagattttgaagaaacacaaacctgacttcatctcattgttcaaaaatccgccaaaaaatgttcaacagcatgagaaggttcagaaagccagtacagagggagtcgccattcagggtcaacagggaactcgacttcttcctgaacagctcattaaagaagcctttattctcagtgacctttttgatattggagaattggcagctgttgagcttcttcttgctggagagcatcaacagccacattttcctggccttaccagaggattagtagctgttcttctgtactgggatggaaagcgatgcattgcgaattccttgaaagccttgatacagtctagacggggaaagacatggaccctagaactcagtccagagctggcttccatgacaacacgctttacagatgagctgatggagcaaggattgacttataaagttcttacgctggtgtcacagattgatgtgaataatgagtttgagaaactacagcgagagagaggtttgggcagtgaaaaacatcgcaaagaggtttctgatctcattaaggagtgcaggcagtctcttgcagaaagcctttttgcctgggcttgccagtcacctttaggcaaagaagacactctcctcctcattggacatttggaaagagtgacagttgaggctaatggctcactggatgcagtgaatctggctcttcttatggcgcttctatactgttttgatatcagttttatagagcaaagcacagaggaacgagatgatatgattcatcaacttccactgttgacagaaaaacagtacattgcaacaattcactctcgtcttcaggactcacagctttggaaactgcctgggctccaagccactgttagacttgcctgggcgctggcattgaggggaatatcccagctacctgatgtgacagctctggcagaattcacagaggcagatgaagcaatggcagaactcgcaattgctgacaacgttttcctgttcctcatggaatctgtagtggtatcagaatacttttatcaggaagaattttatattcgcagagtccataatctcatcacagatttccttgcacttatgccaatgaaggtgaaacagctgaggaatcgggcagatgaagatgctcgaatgattcacatgagtatgcagatgggtaatgaaccccccatttcacttagaagggacctggaacacttaatgcttttgattggcgagctatataaaaagaacccttttcatctggagcttgctctagaatattggtgtcccacagagcctcttcagactccgactatcatgggctcttatctaggggtggctcatcagcggccccctcaacgccaggttgtcttgtcaaagtttgttaggcaaatgggtgacctgttgcctccaactatttatattccttatttgaagatgctccagggattggccaatgggcctcagtgtgcccactactgtttcagcctgctcaaagtcaatggtagtagtcatgttgaaaatattcagggagcaggtggcagtcctgtttcctgggaacatttctttcactccttgatgctttaccacgaacaccttcggaaggatcttccaagtgcagatagtgtccagtaccgtcaccttccttcccgtggcatcacccagaaggagcaagatggattgattgcttttttgcagctcacgtctaccatcattacttggagtgaaaatgctcgcttggcactctgtgaacaccctcagtggacccctgttgtggtgattctgggactcctccaatgcagtattccccctgtcctaaaagctgagctactgaagacactcgcagcttttggaaaatctcctgaaattgctgcttccctctggcagtcattggaatacactcagatactgcagaccgtgaggattccaagccaaaggcaagctattggtattgaggttgaactaaatgaaatagaatcccggtgtgaagaatacccattgactcgggccttttgccagcttattagtactctggtggagagctcatttccttctaatttgggtgctggactgcggccccctggctttgacccttatttgcagttccttagagactctgtgtttctacgattccgtacaagagcttaccggagagcagctgaaaagtgggaagttgctgaggtggttttggaggtgttttataaattgctcagagattatgagcctcagcttgaagattttgtagaccagtttgtggaactacaaggagaagaaatcatagcctataagccacctggatttagtctgatgtatcatctgctgaatgagtcaccaatgttggagcttgctctcagtttactggaagaaggagttaagcagcttgacacctatgccccctttcctgggaaaaaacacctggagaaagcagtacagcattgccttgcacttctcaatcttactctgcaaaaggaaaatctttttatggaccttctaagagagagtcaactggctctaatagtctgtcctttagaacagcttttgcagggaattaatcccagaactaagaaggcagataatgtggtaaacattgccagatacctatatcatggcaatactaatccagaattggcttttgaaagtgccaagatcctctgttgtatctcttgcaactctaatattcagataaagttggttggagatttcacacatgaccagagtataagtcagaaactaatggctggatttgtggagtgtttggattgtgaagatgcagaagaatttgtacgtctggaagagggatcagaacttgaaaagaaattagttgcaattcgtcatgaaacaagaatccacatcttgaatcttctcattacctctctggaatgcaatccacccaatcttgctctctacctgttgggctttgaattgaaaaaacctgtcagtactacaaacctacaagatccaggagtgttaggttgccctcggacatgccttcacgccattctaaacatcttggagaaaggaacggaagggagaacaggcccagtggcggtgcgagaatctcctcagctggctgagctatgttaccaggtcatatatcagttatgtgcatgctctgatacatctggtcctactatgaggtacttgagaaccagccaggatttcttattttcccagttgcagtatctaccattttctaacaaagaatatgaaatatctatgctgaaccagatgtcatggcttatgaaaactgcctcaatagagctaagggtaacctctctgaatcgtcagcggtcacatacccagaggctcctacacctcttactggatgacatgccagtgaaaccatactcagatggtgaaggaggaatagaagatgaaaacaggtctgtttctgggttccttcactttgacactgctacaaaagtacgtcgaaaaattctaaatattcttgactcgattgacttcagtcaggagatccctgagcctttgcagttggatttttttgatcgggcccagattgaacaagttattgctaactgtgaacacaagaatttacggggacagacagtctgcaatgtcaagcttcttcatagggttcttgtagctgaagtaaatgcccttcagggtatggcagccataggacagagacctctactaatggaggaaatcagcactgtacttcagtatgtggtaggaagaaataaattgctgcagtgtcttcatgcaaaacgtcatgctctggagtcgtggaggcaactagtagaaattatactgacagcttgtccccaggacctcattcaggcagaggatcgacaactgattattcgtgatattttacaagatgtgcatgataagatactggatgatgaagctgcgcaagagttaatgcctgtggtcgccggggcagtgttcacactgactgctcacctaagccaggccgtcctcactgaacagaaggaaacatcagtcttgggaccagcagaggcccattacgcttttatgcttgatagttgcttcacctcacctcctcctgaagagaacccattagtgggttttgcttctattggagattcttcactttacatcatattgaagaaactgttagacttcattttgaagacaggtggtggattccaacgagtgaggactcacttgtatggctctctgctttattacttacagattgcccagagacctgatgaaccagacaccttagaagcagccaagaaaaccatgtgggaaaggctgacagcccctgaagatgtatttagcaaattacagcgagaaaacatagccattattgaaagttatggcgccgccctcatggaagtggtctgtcgagatgcttgtgatggtcatgagattggaaggatgctggccctggctctacttgatagaattgtctccgtggataaacagcagcagtggcttttgtatctttctaacagtggctacttgaaggtcctcgtagacagcttggtagaagatgaccgtactttgcagagcttactcaccccacagcctccccttttaaaagcactttatacttatgaatctaaaatggcatttctcacaagagtggcaaagatacagcagggtgcattagagctgctaagatcaggggtgattgtgagactagctcaatgccaagtctatgacatgcgcccagaaacggacccgcagagcatgtttggcatgagagaccctccaatgttcatccctaccccagtggatcgctaccgccagattctcctcccagctctccagctgtgccaggtcatcctcacatctagtatggcccagcacttgcaggcagcagggcaggtattgcagtttcttatttcacattctgataccatacaagcaattctgcgctgtcaggatgttagtgctgggtctttgcaggaattggctctgctgacaggaattataagtaaagcagcacttcctggaatattaagtgaacttgacgttgatgtaaatgaagggtctctaatggagctacagggacatattggaagattccagcgccagtgcttaggactactaagtcgctttggtggctctgacagactgcgtcagtttaaatttcaagacgataatgtggagggagataaagtaagcaagaaagatgagattgaactggctatgcagcagatttgtgccaatgtaatggaatattgccagtcactcatgttacagagttcccctaccttccagcatgctgtgtgtctcttcactcctagcctttcagaaacagttaatagagatggaccgcggcaagatacccaagctccagtggttccatactggcgcctgcctggtttaggcattatcatctacctgctgaaacagagtgctaatgatttcttcagctattatgacagtcatcgacagagtgtcagcaagctacaaaatgtagagcagcttcccccagatgagataaaagagttgtgtcagtctgtgatgcctgctggtgttgataaaatctccactgctcagaaatatgttctagcaagacggcgcttggtgaaggtgatcaacaatcgagctaaactgctttccctttgttcttttatcatagagacctgcctatttattctttggcgccatctggagtactacttgttacattgcatgcccacggattctcaagattccttatttgcctcgagaaccttgtttaaaagcagaagactgcaagattccttcgcctcagaaaccaatctagattttagaagtgggctggctatagtgagccaacatgatttagaccagcttcaggctgatgcaatcaacgcttttggagaatcactacaaaagaaacttctggacattgaaggattatattcaaaagttcgatctcgatatagtttcatacaggctcttgtcagacgtatccgtggcctcttgaggatatcaaggaactgagagcccgtgcttatgctcttctatgagagagatgaattggggagaattgtctccattttatagattagtttctttctaaattatgaccaaaaatattttgctatttctttctttgtatatggacatcttttctgtaaacttcttcccctagttccatcctcactagtaaaaaataaatactttttaaaaaaacaaaacaaa

SEQ ID NO: 20873 - DNA, 1638 bp, Homo sapiens
agtgcgcctctaagatggcgacgcctttggcggtaaattcggctgctagtctatggggtccttacaaagacatttggcataaagtgggaaatgctctttggagaagacaacctgaagctgttcaccttcttgataagattttgaagaaacacaaacctgacttcatctcattgttcaaaaatccgccaaaaaatgttcaacagcatgagaaggttcagaaagccagtacagagggagtcgccattcagggtcaacagggaactcgacttcttcctgaacagctcattaaagaagcctttattctcagtgacctttttgatattggagaattggcagctgttgagcttcttcttgctggagagcatcaacagccacattttcctggccttaccagaggattagtagctgttcttctgtactgggatggaaagcgatgcattgcgaattccttgaaagccttgatacagtctagacggggaaagacatggaccctagaactcagtccagagctggcttccatgacaacacgctttacagatgagctgatggagcaaggattgacttataaagttcttacgctggtgtcacagattgatgtgaataatgagtttgagaaactacagcgagagagaggtttctgatctcattaaggagtgcaggcagtctcttgcagaaagcctttttgcctgggcttgccagtcacctttaggcaaagaagacactctcctcctcattggacatttggaaagagtgacagttgaggctaatggctcactggatgcagtgaatctggctcttcttatggcgcttctatactgttttgatatcagttttatagagcaaagcacagaggaacgagatgatatgattcatcaacttccactgttgacagaaaaacagtacattgcaacaattcactctcgtcttcaggactcacagctttggaaactgcctgggctccaagccactgttagacttgcctgggcgctggcattgaggggaatatcccagctacctgatgtgacagctctggcagaattcacagaggcagatgaagcaatggcagaactcgcaattgctgacaacgttttcctgttcctcatggaatctgtagtggtatcagaatacttttatcaggaagaattttatattcgcagagtccataatctcatcacagatttccttgcacttatgccaatgaaggtgaaacagctgaggaatcgggcagatgaagatgctcgaatgattcacatgagtatgcagatgggtaatgaaccccccatttcacttagaagggacctggaacacttaatgcttttggtaagcaagctattggtattgaggttgaactaaatgaaatagaatcccggtgtgaagaatacccattgactcgggccttttgccagcttattagtactctggtggagagctcatttccttctaatttgggtgctggactgcggccccctggctttgacccttatttgcagttccttagagactctgtgtttctacgattccgtacaagagcttaccggagagcagctgaaaagtgggaagttgctgaggtggttttggaggtgttttataaattgctcagagattatgagcctcagcttgaagattttgtagaccagt

SEQ ID NO: 20874 - DNA, 7191 bp, Homo sapiens
gcgcgcgcgcgggcgggagcggagggcaacggggcggcgcgggcggccgggcgcagggtcgcgggaggtgacgcgcggcgaggatggcggcgcggggccgggggctgctgctgctgacgctgtcggtgctgttggcggcgggcccctccgccgctgcggccaagctcaacatccccaaagtgctgctgcccttcacgcgggccacgcgcgttaacttcacgctggaggcctcggagggctgctaccgctggttgtccacccggccggaggtggccagcatcgagccgctgggcctggacgagcagcagtgctcccagaaggcagtggtgcaggcccgcctgacccagcctgcccgcctcaccagcatcatcttcgcagaggacatcaccacaggccaggtcctgcgctgtgatgccattgtggacctcatccatgacatccagatcgtctccaccacccgcgagctctacctggaggactcccccctggagctgaagatccaggccctggactccgaagggaacaccttcagcactctggctggactggtcttcgagtggacgattgtgaaggactccgaggcggacaggttctcagactcccacaatgcgctgcgaatcctcactttcttggagtctacgtacatccctccttcttacatctcagagatggagaaggctgccaagcaaggggacaccatcctggtgtctgggatgaagaccgggagctccaagctcaaggctcgcatccaggaggctgtctacaagaatgtacgccctgcagaagtcaggctgctgattttggaaaacatccttctgaacccggcctatgacgtctacctgatggtgggaacctccattcactacaaggtgcagaagatcaggcaagggaaaattacagaactctccatgccttccgatcagtacgagttgcagcttcagaacagcatcccgggccccgaaggagacccagcccggccggtggctgtcttggcccaggacacgtcgatggtcactgcactgcagctgggacagagcagcctcgtccttggccacaggagtattcgcatgcaaggtgcttctaggttacccaacagcactatctacgtggtcgaacctggatacctagggttcactgttcaccctggtgacaggtgggtgctggagaccggccgcctgtatgaaatcaccatcgaagtttttgacaagttcagcaacaaggtctatgtatctgacaacatccgaattgaaactgtgcttcctgctgagttcttcgaggtgctctcgtcctcccagaatgggtcataccatcgcatcagggcactaaagaggggacagacggccattgacgcggccctcacctctgtggtggaccaggatggaggggtccacatactacaggtgcctgtgtggaaccagcaggaggtggaaattcacatcccgatcaccctgtatcccagcatcttgacatttccgtggcaaccaaagacgggcgcctatcagtacacaataagggcccacggtggcagtgggaacttcagctggtcttcgtcaagccacctggttgccacagttactgtcaagggcgtgatgaccacaggcagtgacatcgggttcagtgtgatccaggcacatgatgtgcagaacccactccatttcggtgagatgaaggtgtatgtgatcgagccccacagcatggagtttgccccgtgccaggtggaggcacgtgtgggccaggccctggagctgcccctgaggatcagtggcctcatgcccggcggggccagtgaggtggtcaccttgagcgactgctcccactttgacttggctgtcgaggtggagaaccagggtgtgttccagccactcccagggaggctgccgccaggctctgagcactgcagcggcatccgggtaaaggccgaggcccagggctctaccacgcttcttgtgagctacagacacggccacgtccacctgagtgccaagatcaccattgctgcctacctgcccctcaaggctgtggatccctcctctgttgccttggtaaccctgggctcctcaaaggagatgctgtttgaaggaggtcccagaccttggatcctcgagccgtccaaattcttccagaacgtcaccgctgaggacactgacagcatcggcctggctctctttgccccccattcctcccggaattatcagcaacactggatccttgtgacctgtcaggccttgggtgagcaggtcatcgccctgtcggtggggaacaagcccagcctcaccaacccctttcctgcggtggagcctgccgtggtgaagttcgtctgcgccccaccgtccaggctcaccctcgcgcctgtctacaccagcccccagctggacatgtcctgtccgctgctgcagcagaacaagcaggtggtcccagtgtccagccaccgcaacccccggctggacctggctgcttacgaccaggagggccgccggttcgacaacttcagctctctgagcatccagtgggagtccaccaggccagtgttggccagcatcgagcctgagctgcccatgcagctggtgtcccaggacgatgagagtggccaaaagaagctgcacggtttgcaggccattttggttcacgaggcatcaggaaccacagccatcactgccactgccactggctaccaggagtcccacctcagctctgccagaacaaagcagccgcatgaccctctggtgcctctgtcggcctccatagagctcatcctggtggaggacgtgagggtgagcccagaagaggtgaccatctacaaccaccctggcatccaggcagagctccgcatcagggaaggctcaggttacttcttcctcaacaccagcaccgcagatgttgtcaaggtggcctaccaggaggccaggggtgtcgccatggtgcaccctttgctcccgggctcatccaccatcatgatccatgacttgtgcctcgtcttcccggccccagccaaggctgtcgtttacgtgtcggacattcaggagctgtacatccgtgtggttgacaaggtggagattgggaagacagtgaaggcatacgtccgcgtgctggacttgcacaagaagcccttccttgccaaatacttcccctttatggacctgaagctccgagcagcctccccgatcattacattggtggcccttgatgaagcccttgacaactacaccatcacattcctcatccgcggtgtggccatcggccagaccagtctaactgcaagtgtgaccaataaagctggacagagaatcaactcagccccacaacagattgaagtctttcccccgttcaggctgatgcccaggaaggtgacactgcttatcggggccacgatgcaggtcacctccgagggcggcccccagcctcagtccaacatccttttctccatcagcaatgagagcgttgcgctggtgagcgctgctgggctggtacagggcctcgccatcgggaacggcactgtgtctgggctcgtgcaggcagtggatgcagagaccggcaaggtggtcatcatctctcaggacctcgtgcaggtggaggtgctgctgctaagggccgtgaggatccgcgcccccatcatgcggatgaggacgggcacccagatgcccatctatgtcaccggcatcaccaaccaccagaaccctttctcctttggcaatgccgtgccaggcctgaccttccactggtctgtcaccaagcgggacgtcctggacctccgagggcggcaccacgaggcgtcgatccgactcccgtcacagtacaactttgccatgaacgtgctcggccgggtaaaaggccggaccgggctgagggtggtggtcaaggctgtggaccccacatcggggcagctgtatggcctggccagagaactctcggatgagatccaagtccaggtgtttgagaagctgcagctgctcaaccctgaaatagaagcagaacaaatattaatgtcgcccaactcatatataaagctgcagacaaacagggatggtgcagcctctctgagctaccgcgtcctggatggacccgaaaaggttccagttgtgcatgttgatgagaaaggctttctagcatcagggtctatgatcgggacatccaccatcgaagtgattgcacaagagccctttggggccaaccaaaccatcattgttgctgtaaaggtatcccctgtttcctacctgagggtttccatgagccctgtcctgcacacccagaacaaggaggccctggtggccgtgcctttgggaatgaccgtgaccttcactgtccacttccacgacaactctggagatgtcttccatgctcacagttcggtcctcaactttgccactaacagagacgactttgtgcagatcgggaagggccccaccaacaacacctgcgttgtccgcacagtcagcgtgggcctgacactgctccgtgtgtgggacgcagagcacccgggcctctcggacttcatgcccctgcctgtcctacaggccatctccccagagctgtctggggccatggtggtgggggacgtgctctgtctggccactgttctgaccagcctggaaggcctctcaggaacctggagctcctcggccaacagcatcctccacatcgaccccaagacgggtgtggctgtggcccgggccgtgggatccgtgacggtttactatgaggtcgctgggcacctgaggacctacaaggaggtggtggtcagcgtccctcagaggatcatggcccgtcacctccaccccatccagaccagcttccaggaggctacagcctccaaagtgattgttgccgtgggagacagaagctctaacctgagaggcgagtgcacccccacccagagggaagtcatccaggccttgcacccagagaccctcatcagctgccagtcccagttcaagccggccgtctttgatttcccatctcaagatgtgttcaccgtggagccacagtttgacactgctctcggccagtacttctgctcaatcacaatgcacaggctgacggacaagcagcggaagcacctgagcatgaagaagacagctctggtggtcagtgcctccctctccagcagccacttctccacagagcaggtgggggccgaggtgcccttcagcccaggtctcttcgccgaccaggctgaaatccttttgagcaaccactacaccagttccgagatcagggtctttggtgccccggaggttctggagaacttggaggtgaaatccgggtccccggccgtgctggcattcgcaaaggagaagtcttttgggtggcccagcttcatcacatacacggtcggcgtcttggaccccgcggctggcagccaagggcctctgtccactaccctgaccttctccagccccgtgaccaaccaagccattgccatcccagtgacagtggcttttgtggtggatcgccgtgggcccggtccttatggagccagcctcttccagcacttcctggattcctaccaggtcatgttcttcacgctcttcgccctgttggctgggacagcggtcatgatcatagcctaccacactgtctgcacgccccgggatcttgctgtgcctgcagccctcacgcctcgagccagccctggacacagcccccactatttcgctgcctcatcacccacatctcccaatgcattgcctcctgctcgcaaagccagccctccctcagggctgtggagcccagcctatgcctcccactaggccgcgtgaaggttcccggaggatgggtctcagccgagcctcgtgcacccccaagatggaacatccctgctgcattcacactggaacaagcccctccagatgagtgccccggccccaggccagcttcactgccgtctcttcacacagagctgtagtttcggctctgcccattagctcattttatgtaggagttttaaatgtgtgtttttttcctttcaagtcttacaaagctaagactttttggctcattcctttttgcatggttgtctagggtttctggacaatgtgctgttgcatttttattttcctagccttgctaaaatctttcccttctcaagactttgagcagttagaagtgctctttagaagttgtctgtgggtgatgttactgtagtggtctcagggaaaggattgtccagttactttagggggtttttggtggggtttttccccctgtgaaaacttactttgcccctagtctggctgctgctaggacttctgaggagcaatgggacatgagtgtccctgtatctgcgccactgccgcaagggaagcctcaggaaccagcacctggaggccaggatagccaagccctgggtgagcgagaggctggagaacacaggagctcacccagggctgctgcccaaccatgggccactgtgaacagacttcagtcctctgtttttgtttcataagccgttgagacatctgatggacttggcttaggccctgctgggacatcccacgtgtgatccctttcactccatcaggacaccaggactgtccttaggaaaatgtccttgagatggcagcaggagtcatattttctgtgtgtgtgtttcggaaagccgctgtgtcctgcctcagcacaaagacccagtgtcatttgctcctcctgttcctgtgccactccagaacctcagcagatctgagccaccgcctgccagtgtgagaggcggccactttcatggcagctcatcaggcgcagggccccagacagcttcccagcaggccctagagcccggcctgggccaatgatggagggcggccgccagcccagggcctgcccatccagaagggactccccagggcctgggggaggagacccttggaaaagtcctctcttcccagctcctgattctggatctgagattctcagatcacaggcccctgtgctccaggccgaggctgggctaccctcagggagatccagagactcatgcccatggccatccatgcgtggacgctgtgtggagagtccaggatgacgggatcccgcacaagctcccttcagtccttcagggctgggccatgtggttgatttttctaaagctggagaaaggaagaattgtgccttgcatattacttgagcttaaactgacaacctggatgtaaataggagcctttctactggtttatttaataaagttctatgtgatttttt

SEQ ID NO: 20875 - DNA, 7600 bp, Homo sapiens
cgtcaccaaagcgcgccggaaatgcgaggtcaactgcgcgccgctggcgctgaggggaggaagtttgctgtcgagcggcctgggttccgtgggcaaggccgtgggaggcagcgttggctgcttcgacacactgagggcggcgcgatgggagacgagatggatgccatgattcccgagcgggagatgaaggattttcagtttagagcgctaaagaaggtgagaatctttgactcccctgaggaattgcccaaggaacgctcgagtctgcttgctgtgtccaacaaatatggtctggtcttcgctggtggagccagtggcttgcagatttttcctactaaaaatcttcttattcaaaataaacccggagatgatcccaacaaaatagttgataaagtccaaggcttgctagttcctatgaaattcccaatccatcacctggccttgagctgtgataacctcacactctctgcgtgcatgatgtccagtgaatatggttccattattgctttttttgatgttcgcacattctcaaatgaggctaaacagcaaaaacgcccatttgcctatcataagcttttgaaagatgcaggaggcatggtgattgatatgaagtggaaccccactgtcccctccatggtggcagtttgtctggctgatggtagtattgctgtcctgcaagtcacggaaacagtgaaagtatgtgcaactcttccttccacggtagcagtaacctctgtgtgctggagccccaaaggaaagcagctggcagtgggaaaacagaatggaactgtggtccagtatcttcctactttgcaggaaaaaaaagtcattccttgtcctccgttttatgagtcagatcatcctgtcagagttctggatgtgctgtggattggtacctacgtcttcgccatagtgtatgctgctgcagatgggaccctggaaacgtctccagatgtggtgatggctctactaccgaaaaaagaagaaaagcacccagagatatttgtgaactttatggagccctgttatggcagctgcacggagagacagcatcattactacctcagttacattgaggaatgggatttagtgctggcagcatctgcggcttcaacagaagttagtatccttgctcgacaaagtgatcagattaattgggaatcttggctactggaggattctagtcgagctgaattgcctgtgacagacaagagtgatgactccttgcccatgggagttgtcgtagactatacaaaccaagtggaaatcaccatcagtgatgaaaagactcttcctcctgctccagttctcatgttactttcaacagatggtgtgctttgtccattttatatgattaatcaaaatcctggggttaagtctctcatcaaaacaccagagcgactttcattagaaggagagcgacagcccaagtcaccaggaagtactcccactaccccaacctcctctcaagccccacagaaactggatgcttctgcagctgcagcccctgcctctctgccaccttcatcacctgctgctcccattgccactttttctttgcttcctgctggtggagcccccactgtgttctcctttggttcttcatctttgaagtcatctgctacggtcactggggagcccccttcatattccagtggctccgacagctccaaagcagccccaggccctggcccatcaaccttctcttttgttcccccttctaaagcctccctagcccccacccctgcagcgtctcctgtggctccatcagctgcttcattctcctttggatcatctggttttaagcctaccctggaaagcacaccagtgccaagtgtgtctgctccaaatatagcaatgaagccctccttcccaccctcaacctctgctgtcaaagtcaaccttagtgaaaagtttactgctgcagctacctctactcctgttagtagctcccagagcgcacccccgatgtcgccattctcttctgcctccaagccagctgcttctggaccactcagccaccccacacctctctcagcaccacctagttccgtgccattgaagtcctcagtcttgccctcaccatcaggacgatctgctcagggcagttcaagcccagtgccctcaatggtacagaaatcacccaggataacccctccagcggcaaagccaggctctccccaggcaaagtcacttcagcctgctgttgcagaaaagcagggacatcagtggaaagattcagatcctgtaatggctggaattggggaggagattgcacactttcagaaggagttggaagagttaaaagcccgaacttccaaagcctgtttccaagtgggcacttctgaggagatgaagatgctgcgaacagaatcagatgacttgcatacctttcttttggagattaaagagaccacagagtcgcttcatggagatataagtagcctgaaaacaactttacttgagggctttgctggtgttgaggaagccagagaacaaaatgaaagaaatcgtgactctggttatctgcatttgctttataaaagaccactggatcccaagagtgaagctcagcttcaggaaattcggcgccttcatcagtatgtgaaatttgctgtccaagatgtgaatgatgttctagacttggagtgggatcagcatctggaacaaaagaaaaaacaaaggcacctgcttgtgccagagcgagagacactgtttaacaccctagccaacaatcgggaaatcatcaaccaacagaggaagaggctgaatcacctggtggatagtcttcagcagctccgcctttacaaacagacttccctgtggagcctgtcctcggctgttccttcccagagcagcattcacagttttgacagtgacctggaaagcctgtgcaatgctttgttgaaaaccaccatagaatctcacaccaaatccttgcccaaagtaccagccaaactgtcccccatgaaacaggcacaactgagaaacttcttggccaagaggaagaccccaccagtgagatccactgctccagccagcctgtctcgatcagcctttctgtctcagagatattatgaagacttggatgaagtcagctcaacgtcatctgtctcccagtctctggagagtgaagatgcacggacgtcctgtaaagatgacgaggcagtggttcaggcccctcggcacgcccccgtggttcgcactccttccatccagcccagtctcttgccccatgcagcaccttttgctaaatctcacctggttcatggttcttcacctggtgtgatgggaacttcagtggctacatctgctagcaaaattattcctcaaggggccgatagcacaatgcttgccacgaaaaccgtgaaacatggtgcacctagtccttcccaccccatctcagccccgcaggcagctgccgcagcagcactcaggcggcagatggccagtcaggcaccagctgtaaacactttgactgaatcaacgttgaagaatgtccctcaagtggtaaatgtgcaggaattgaagaataaccctgcaaccccttctacagccatgggttcttcagtgccctactccacagccaaaacacctcacccagtgttgaccccagtggctgctaaccaagccaagcaggggtctctaataaattcccttaagccatctgggcctacaccagcatccggtcagttatcatctggtgacaaagcttcagggacagccaagatagaaacagctgtgacttcaaccccatctgcttctgggcagttcagcaagcctttctcattttctccatcagggactggctttaattttgggataatcacaccaacaccgtcttctaatttcactgctgcacaaggggcaacaccctccactaaagagtcaagccagccggacgcattctcatctggtgggggaagcaaaccttcttatgaggccattcctgaaagctcacctccctcaggaatcacatccgcatcaaacaccaccccaggagaacctgccgcatctagcagcagacctgtggcaccttctggaactgctctttccaccacctctagtaagctggaaaccccaccgtccaagctgggagagcttctgtttccaagttctttggctggagagactctgggaagtttttcaggactgcgggttggccaagcagatgattctacaaaaccaaccaataaggcttcatccacaagcctaactagtacccagccaaccaagacgtcaggcgtgccctcagggtttaattttactgcccccccggtgttagggaagcacacggagccccctgtgacatcctctgcaaccaccacctcagtagcaccaccagcagccaccagcacttcctcaactgccgtttttggcagtctgccagtcaccagtgcaggatcctctggggtcatcagttttggtgggacatctctaagtgctggcaagactagtttttcatttggaagccaacagaccaatagcacagtgcccccatctgccccaccaccaactacagctgccactccccttccaacatcattccccacattgtcatttggtagcctcctgagttcagcaactaccccctccctgcctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactagtcttgtagcactttctgcagaggctaccccagccaccacgggggtccctgatgccaggacggaggcagtaccacctgcttcctccttttctgtgcctgggcagactgctgtcacagcagctgctatctcaagtgcaggccctgtggccgtcgaaacatcaagtacccccatagcctccagcaccacgtccattgttgctcccggcccatctgcagaggcagcagcatttggtaccgtcacttctggctcatccgtctttgctcagcctcctgctgccagttctagctcagctttcaaccagctcaccaacaacacagccactgccccctctgccacgcccgtgtttgggcaagtggcagccagcaccgcaccaagtctgtttgggcagcagactggtagcacagccagcacagcagctgccacaccacaggtcagcagctcagggtttagcagcccagcttttggtaccacagccccaggggtctttggacagacaaccttcgggcaggcctcagtctttgggcagtcggcgagcagtgctgcaagtgtcttttccttcagtcagcctgggttcagttccgtgcctgccttcggtcagcctgcttcctccactcccacatccaccagtggaagtgtctttggtgccgcctcaagtaccagtagctccagttccttctcatttggacagtcttctcccaacacaggaggggggctgtttggccaaagcaacgctcctgcttttgggcagagtcctggctttggacagggaggctctgtctttggtggtacctcagctgccaccacaacagcagcaacctctgggttcagcttttgccaagcttcaggttttgggtctagtaatactggttctgtgtttggtcaagcagccagtactggtggaatagtctttggccagcaatcatcctcttccagtggtagcgtgtttgggtctggaaacactggaagagggggaggtttcttcagtggccttggaggaaaacccagtcaggatgcagccaacaaaaacccattcagctcggccagtgggggctttggatccacagctacctcaaatacctctaacctatttggaaacagtggggccaagacatttggtggatttgccagctcgtcgtttggagagcagaaacccactggcactttcagctctggaggaggaagtgtggcatcccaaggctttgggttttcctctccaaacaaaacaggtggcttcggtgctgctccagtgtttggcagccctcctacttttgggggatcccctgggtttggaggggtgccagcattcggttcagccccagcctttacaagccctctgggctcgacgggaggcaaagtgttcggagagggcactgcagctgccagcgcaggaggattcgggtttgggagcagcagcaacaccacatccttcggcacgctcgcgagtcagaatgcccccactttcggatcactgtcccaacagacttctggttttgggacccagagtagcggattctctggttttggatcaggcacaggagggttcagctttgggtcaaataactcgtctgtccagggttttggtggctggcgaagctgagggcgtgtcagcaggcctttcgatccctgggaccaaccgcatcctcagcttcttccccgagaaatgctggagcaggctgttcagaccgacgttgccatcaaaacacatacacccagaaagaaacaacagaaaccaaaactcacaaggcgcatgattacttgttttatatttcatgttgggttttccctcccactattaaacagtctgtttccgtacagaacgtatgtgggttttttcagatcacagccaagaagattgccccgtttctgtggctctgagaagccagcagagcctccatcagccagaacactgtgtcttcaaggatggcatcagaagtcaccagcgtcgggtgttgataaacagcatcgaatgtgccgtggtctcacttggacctagcgccctccacatagggaagaggttgaatgctggtgggtcatctttttgaggctgaaacttggttatctcctctccttgttcttttagccattgtgtatcaggaccatccaaggacgcactctgcgattgagtggaggcagaggaagccactcatgccagcagcagttgagtttcagaagcagccatagcgcttttcagtacagtacaatagtagccagcgtgaggcaggacagtgctgcgccttagccggccttggctctcatctccatgtggctcttgggtgccatgtgtcctactccagagaggagggggccggtcacttgagaagacagcctttatattctgtatgtggcagtgacattggtagccacacctacccagtgtctactaaccacagtgcagatagcccttgggtagacccaggaagtgtgaagacagacactgctgttgccagacaacactagcagaacgatgctggatttgacaacagtgtttgctaggacggcccagagctcatcactgcagttttattagagtgcttctttatctttaatgcagtatctttgaggcctgtaacatcctagatagttgccatcaaacaaggaccgtctcgcattgaaaacagatgtaagaatttctctttcaggcccagaatctgacagtgctttggcttgggtcatgagcagcggggagttgggaagagatttttttttttagagttttacatattggcaggttgtatttttttaatgttttaataaaagtttgacatgacattaattcatca

SEQ ID NO: 20876 - DNA, 7538 bp, Homo sapiens
gaggtcaactgcgcgccgctggcgctgaggggaggaagtttgctgtcgagcggcctgggttccgtgggcaaggccgtgggaggcagcgttggctgcttcgacacactgagggcggcgcgatgggagacgagatggatgccatgattcccgagcgggagatgaaggattttcagtttagagcgctaaagaaggtgagaatctttgactcccctgaggaattgcccaaggaacgctcgagtctgcttgctgtgtccaacaaatatggtctggtcttcgctggtggagccagtggcttgcagatttttcctactaaaaatcttcttattcaaaataaacccggagatgatcccaacaaaatagttgataaagtccaaggcttgctagttcctatgaaattcccaatccatcacctggccttgagctgtgataacctcacactctctgcgtgcatgatgtccagtgaatatggttccattattgctttttttgatgttcgcacattctcaaatgaggctaaacagcaaaaacgcccatttgcctatcataagcttttgaaagatgcaggaggcatggtgattgatatgaagtggaaccccactgtcccctccatggtggcagtttgtctggctgatggtagtattgctgtcctgcaagtcacggaaacagtgaaagtatgtgcaactcttccttccacggtagcagtaacctctgtgtgctggagccccaaaggaaagcagctggcagtgggaaaacagaatggaactgtggtccagtatcttcctactttgcaggaaaaaaaagtcattccttgtcctccgttttatgagtcagatcatcctgtcagagttctggatgtgctgtggattggtacctacgtcttcgccatagtgtatgctgctgcagatgggaccctggaaacgtctccagatgtggtgatggctctactaccgaaaaaagaagaaaagcacccagagatatttgtgaactttatggagccctgttatggcagctgcacggagagacagcatcattactacctcagttacattgaggaatgggatttagtgctggcagcatctgcggcttcaacagaagttagtatccttgctcgacaaagtgatcagattaattgggaatcttggctactggaggattctagtcgagctgaattgcctgtgacagacaagagtgatgactccttgcccatgggagttgtcgtagactatacaaaccaagtggaaatcaccatcagtgatgaaaagactcttcctcctgctccagttctcatgttactttcaacagatggtgtgctttgtccattttatatgattaatcaaaatcctggggttaagtctctcatcaaaacaccagagcgactttcattagaaggagagcgacagcccaagtcaccaggaagtactcccactaccccaacctcctctcaagccccacagaaactggatgcttctgcagctgcagcccctgcctctctgccaccttcatcacctgctgctcccattgccactttttctttgcttcctgctggtggagcccccactgtgttctcctttggttcttcatctttgaagtcatctgctacggtcactggggagcccccttcatattccagtggctccgacagctccaaagcagccccaggccctggcccatcaaccttctcttttgttcccccttctaaagcctccctagcccccacccctgcagcgtctcctgtggctccatcagctgcttcattctcctttggatcatctggttttaagcctaccctggaaagcacaccagtgccaagtgtgtctgctccaaatatagcaatgaagccctccttcccaccctcaacctctgctgtcaaagtcaaccttagtgaaaatagctcccagagcgcacccccgatgtcgccattctcttctgcctccaagccagctgcttctggaccactcagccaccccacacctctctcagcaccacctagttccgtgccattgaagtcctcagtcttgccctcaccatcagcaggacgatctgctcagggcagttcaagcccagtgccctcaatggtacagaaatcacccaggataacccctccagcggcaaagccaggctctccccaggcaaagtcacttcagcctgctgttgcagaaaagcagggacatcagtggaaagattcagatcctgtaatggctggaattggggaggagattgcacactttcagaaggagttggaagagttaaaagcccgaacttccaaagcctgtttccaagtgggcacttctgaggagatgaagatgctgcgaacagaatcagatgacttgcatacctttcttttggagattaaagagaccacagagtcgcttcatggagatataagtagcctgaaaacaactttacttgagggctttgctggtgttgaggaagccagagaacaaaatgaaagaaatcgtgactctggttatctgcatttgctttataaaagaccactggatcccaagagtgaagctcagcttcaggaaattcggcgccttcatcagtatgtgaaatttgctgtccaagatgtgaatgatgttctagacttggagtgggatcagcatctggaacaaaagaaaaaacaaaggcacctgcttgtgccagagcgagagacactgtttaacaccctagccaacaatcgggaaatcatcaaccaacagaggaagaggctgaatcacctggtggatagtcttcagcagctccgcctttacaaacagacttccctgtggagcctgtcctcggctgttccttcccagagcagcattcacagttttgacagtgacctggaaagcctgtgcaatgctttgttgaaaaccaccatagaatctcacaccaaatccttgcccaaagtaccagccaaactgtcccccatgaaacaggcacaactgagaaacttcttggccaagaggaagaccccaccagtgagatccactgctccagccagcctgtctcgatcagcctttctgtctcagagatattatgaagacttggatgaagtcagctcaacgtcatctgtctcccagtctctggagagtgaagatgcacggacgtcctgtaaagatgacgaggcagtggttcaggcccctcggcacgcccccgtggttcgcactccttccatccagcccagtctcttgccccatgcagcaccttttgctaaatctcacctggttcatggttcttcacctggtgtgatgggaacttcagtggctacatctgctagcaaaattattcctcaaggggccgatagcacaatgcttgccacgaaaaccgtgaaacatggtgcacctagtccttcccaccccatctcagccccgcaggcagctgccgcagcagcactcaggcggcagatggccagtcaggcaccagctgtaaacactttgactgaatcaacgttgaagaatgtccctcaagtggtaaatgtgcaggaattgaagaataaccctgcaaccccttctacagccatgggttcttcagtgccctactccacagccaaaacacctcacccagtgttgaccccagtggctgctaaccaagccaagcaggggtctctaataaattcccttaagccatctgggcctacaccagcatccggtcagttatcatctggtgacaaagcttcagggacagccaagatagaaacagctgtgacttcaaccccatctgcttctgggcagttcagcaagcctttctcattttctccatcagggactggctttaattttgggataatcacaccaacaccgtcttctaatttcactgctgcacaaggggcaacaccctccactaaagagtcaagccagccggacgcattctcatctggtgggggaagcaaaccttcttatgaggccattcctgaaagctcacctccctcaggaatcacatccgcatcaaacaccaccccaggagaacctgccgcatctagcagcagacctgtggcaccttctggaactgctctttccaccacctctagtaagctggaaaccccaccgtccaagctgggagagcttctgtttccaagttctttggctggagagactctgggaagtttttcaggactgcgggttggccaagcagatgattctacaaaaccaaccaataaggcttcatccacaagcctaactagtacccagccaaccaagacgtcaggcgtgccctcagggtttaattttactgcccccccggtgttagggaagcacacggagccccctgtgacatcctctgcaaccaccacctcagtagcaccaccagcagccaccagcacttcctcaactgccgtttttggcagtctgccagtcaccagtgcaggatcctctggggtcatcagttttggtgggacatctctaagtgctggcaagactagtttttcatttggaagccaacagaccaatagcacagtgcccccatctgccccaccaccaactacagctgccactccccttccaacatcattccccacattgtcatttggtagcctcctgagttcagcaactaccccctccctgcctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactagtcttgtagcactttctgcagaggctaccccagccaccacgggggtccctgatgccaggacggaggcagtaccacctgcttcctccttttctgtgcctgggcagactgctgtcacagcagctgctatctcaagtgcaggccctgtggccgtcgaaacatcaagtacccccatagcctccagcaccacgtccattgttgctcccggcccatctgcagaggcagcagcatttggtaccgtcacttctggctcatccgtctttgctcagcctcctgctgccagttctagctcagctttcaaccagctcaccaacaacacagccactgccccctctgccacgcccgtgtttgggcaagtggcagccagcaccgcaccaagtctgtttgggcagcagactggtagcacagccagcacagcagctgccacaccacaggtcagcagctcagggtttagcagcccagcttttggtaccacagccccaggggtctttggacagacaaccttcgggcaggcctcagtctttgggcagtcggcgagcagtgctgcaagtgtcttttccttcagtcagcctgggttcagttccgtgcctgccttcggtcagcctgcttcctccactcccacatccaccagtggaagtgtctttggtgccgcctcaagtaccagtagctccagttccttctcatttggacagtcttctcccaacacaggaggggggctgtttggccaaagcaacgctcctgcttttgggcagagtcctggctttggacagggaggctctgtctttggtggtacctcagctgccaccacaacagcagcaacctctgggttcagcttttgccaagcttcaggttttgggtctagtaatactggttctgtgtttggtcaagcagccagtactggtggaatagtctttggccagcaatcatcctcttccagtggtagcgtgtttgggtctggaaacactggaagagggggaggtttcttcagtggccttggaggaaaacccagtcaggatgcagccaacaaaaacccattcagctcggccagtgggggctttggatccacagctacctcaaatacctctaacctatttggaaacagtggggccaagacatttggtggatttgccagctcgtcgtttggagagcagaaacccactggcactttcagctctggaggaggaagtgtggcatcccaaggctttgggttttcctctccaaacaaaacaggtggcttcggtgctgctccagtgtttggcagccctcctacttttgggggatcccctgggtttggaggggtgccagcattcggttcagccccagcctttacaagccctctgggctcgacgggaggcaaagtgttcggagagggcactgcagctgccagcgcaggaggattcgggtttgggagcagcagcaacaccacatccttcggcacgctcgcgagtcagaatgcccccactttcggatcactgtcccaacagacttctggttttgggacccagagtagcggattctctggttttggatcaggcacaggagggttcagctttgggtcaaataactcgtctgtccagggttttggtggctggcgaagctgagggcgtgtcagcaggcctttcgatccctgggaccaaccgcatcctcagcttcttccccgagaaatgctggagcaggctgttcagaccgacgttgccatcaaaacacatacacccagaaagaaacaacagaaaccaaaactcacaaggcgcatgattacttgttttatatttcatgttgggttttccctcccactattaaacagtctgtttccgtacagaacgtatgtgggttttttcagatcacagccaagaagattgccccgtttctgtggctctgagaagccagcagagcctccatcagccagaacactgtgtcttcaaggatggcatcagaagtcaccagcgtcgggtgttgataaacagcatcgaatgtgccgtggtctcacttggacctagcgccctccacatagggaagaggttgaatgctggtgggtcatctttttgaggctgaaacttggttatctcctctccttgttcttttagccattgtgtatcaggaccatccaaggacgcactctgcgattgagtggaggcagaggaagccactcatgccagcagcagttgagtttcagaagcagccatagcgcttttcagtacagtacaatagtagccagcgtgaggcaggacagtgctgcgccttagccggccttggctctcatctccatgtggctcttgggtgccatgtgtcctactccagagaggagggggccggtcacttgagaagacagcctttatattctgtatgtggcagtgacattggtagccacacctacccagtgtctactaaccacagtgcagatagcccttgggtagacccaggaagtgtgaagacagacactgctgttgccagacaacactagcagaacgatgctggatttgacaacagtgtttgctaggacggcccagagctcatcactgcagttttattagagtgcttctttatctttaatgcagtatctttgaggcctgtaacatcctagatagttgccatcaaacaaggaccgtctcgcattgaaaacagatgtaagaatttctctttcaggcccagaatctgacagtgctttggcttgggtcatgagcagcggggagttgggaagagatttttttttttagagttttacatattggcaggttgtatttttttaatgttttaataaaagtttgacatgacattaa

SEQ ID NO: 20877 - DNA, 5021 bp, Homo sapiens
gtgccaggcactgtggtagtcatcgcggcagccctacgaagtagtcgttaacgtagaggagtaagttgaggctcggaaagtaatttccctaaagtcacatttgacgcggggctgaaagccagcatcatttaagacctttgcgtctcctgtggctccatcagctgcttcattctcctttggatcatctggttttaagcctaccctggaaagcacaccagtgccaagtgtgtctgctccaaatatagcaatgaagccctccttcccaccctcaacctctgctgtcaaagtcaaccttagtgaaaagtttactgctgcagctacctctactcctgttagtagctcccagagcgcacccccgatgtcgccattctcttctgcctccaagccagctgcttctggaccactcagccaccccacacctctctcagcaccacctagttccgtgccattgaagtcctcagtcttgccctcaccatcaggacgatctgctcagggcagttcaagcccagtgccctcaatggtacagaaatcacccaggataacccctccagcggcaaagccaggctctccccaggcaaagtcacttcagcctgctgttgcagaaaagcagggacatcagtggaaagattcagatcctgtaatggctggaattggggaggagattgcacactttcagaaggagttggaagagttaaaagcccgaacttccaaagcctgtttccaagtgggcacttctgaggagatgaagatgctgcgaacagaatcagatgacttgcatacctttcttttggagattaaagagaccacagagtcgcttcatggagatataagtagcctgaaaacaactttacttgagggctttgctggtgttgaggaagccagagaacaaaatgaaagaaatcgtgactctggttatctgcatttgctttataaaagaccactggatcccaagagtgaagctcagcttcaggaaattcggcgccttcatcagtatgtgaaatttgctgtccaagatgtgaatgatgttctagacttggagtgggatcagcatctggaacaaaagaaaaaacaaaggcacctgcttgtgccagagcgagagacactgtttaacaccctagccaacaatcgggaaatcatcaaccaacagaggaagaggctgaatcacctggtggatagtcttcagcagctccgcctttacaaacagacttccctgtggagcctgtcctcggctgttccttcccagagcagcattcacagttttgacagtgacctggaaagcctgtgcaatgctttgttgaaaaccaccatagaatctcacaccaaatccttgcccaaagtaccagccaaactgtcccccatgaaacaggcacaactgagaaacttcttggccaagaggaagaccccaccagtgagatccactgctccagccagcctgtctcgatcagcctttctgtctcagagatattatgaagacttggatgaagtcagctcaacgtcatctgtctcccagtctctggagagtgaagatgcacggacgtcctgtaaagatgacgaggcagtggttcaggcccctcggcacgcccccgtggttcgcactccttccatccagcccagtctcttgccccatgcagcaccttttgctaaatctcacctggttcatggttcttcacctggtgtgatgggaacttcagtggctacatctgctagcaaaattattcctcaaggggccgatagcacaatgcttgccacgaaaaccgtgaaacatggtgcacctagtccttcccaccccatctcagccccgcaggcagctgccgcagcagcactcaggcggcagatggccagtcaggcaccagctgtaaacactttgactgaatcaacgttgaagaatgtccctcaagtggtaaatgtgcaggaattgaagaataaccctgcaaccccttctacagccatgggttcttcagtgccctactccacagccaaaacacctcacccagtgttgaccccagtggctgctaaccaagccaagcaggggtctctaataaattcccttaagccatctgggcctacaccagcatccggtcagttatcatctggtgacaaagcttcagggacagccaagatagaaacagctgtgacttcaaccccatctgcttctgggcagttcagcaagcctttctcattttctccatcagggactggctttaattttgggataatcacaccaacaccgtcttctaatttcactgctgcacaaggggcaacaccctccactaaagagtcaagccagccggacgcattctcatctggtgggggaagcaaaccttcttatgaggccattcctgaaagctcacctccctcaggaatcacatccgcatcaaacaccaccccaggagaacctgccgcatctagcagcagacctgtggcaccttctggaactgctctttccaccacctctagtaagctggaaaccccaccgtccaagctgggagagcttctgtttccaagttctttggctggagagactctgggaagtttttcaggactgcgggttggccaagcagatgattctacaaaaccaaccaataaggcttcatccacaagcctaactagtacccagccaaccaagacgtcaggcgtgccctcagggtttaattttactgcccccccggtgttagggaagcacacggagccccctgtgacatcctctgcaaccaccacctcagtagcaccaccagcagccaccagcacttcctcaactgccgtttttggcagtctgccagtcaccagtgcaggatcctctggggtcatcagttttggtgggacatctctaagtgctggcaagactagtttttcatttggaagccaacagaccaatagcacagtgcccccatctgccccaccaccaactacagctgccactccccttccaacatcattccccacattgtcatttggtagcctcctgagttcagcaactaccccctccctgcctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactagtcttgtagcactttctgcagaggctaccccagccaccacgggggtccctgatgccaggacggaggcagtaccacctgcttcctccttttctgtgcctgggcagactgctgtcacagcagctgctatctcaagtgcaggccctgtggccgtcgaaacatcaagtacccccatagcctccagcaccacgtccattgttgctcccggcccatctgcagaggcagcagcatttggtaccgtcacttctggctcatccgtctttgctcagcctcctgctgccagttctagctcagctttcaaccagctcaccaacaacacagccactgccccctctgccacgcccgtgtttgggcaagtggcagccagcaccgcaccaagtctgtttgggcagcagactggtagcacagccagcacagcagctgccacaccacaggtcagcagctcagggtttagcagcccagcttttggtaccacagccccaggggtctttggacagacaaccttcgggcaggcctcagtctttgggcagtcggcgagcagtgctgcaagtgtcttttccttcagtcagcctgggttcagttccgtgcctgccttcggtcagcctgcttcctccactcccacatccaccagtggaagtgtctttggtgccgcctcaagtaccagtagctccagttccttctcatttggacagtcttctcccaacacaggaggggggctgtttggccaaagcaacgctcctgcttttgggcagagtcctggctttggacagggaggctctgtctttggtggtacctcagctgccaccacaacagcagcaacctctgggttcagcttttgccaagcttcaggttttgggtctagtaatactggttctgtgtttggtcaagcagccagtactggtggaatagtctttggccagcaatcatcctcttccagtggtagcgtgtttgggtctggaaacactggaagagggggaggtttcttcagtggccttggaggaaaacccagtcaggatgcagccaacaaaaacccattcagctcggccagtgggggctttggatccacagctacctcaaatacctctaacctatttggaaacagtggggccaagacatttggtggatttgccagctcgtcgtttggagagcagaaacccactggcactttcagctctggaggaggaagtgtggcatcccaaggctttgggttttcctctccaaacaaaacaggtggcttcggtgctgctccagtgtttggcagccctcctacttttgggggatcccctgggtttggaggggtgccagcattcggttcagccccagcctttacaagccctctgggctcgacgggaggcaaagtgttcggagagggcactgcagctgccagcgcaggaggattcgggtttgggagcagcagcaacaccacatccttcggcacgctcgcgagtcagaatgcccccactttcggatcactgtcccaacagacttctggttttgggacccagagtagcggattctctggttttggatcaggcacaggagggttcagctttgggtcaaataactcgtctgtccagggttttggtggctggcgaagctgagggcgtgtcagcaggcctttcgatccctgggaccaaccgcatcctcagcttcttccccgagaaatgctggagcaggctgttcagaccgacgttgccatcaaaacacatacacccagaaagaaacaacagaaaccaaaactcacaaggcgcatgattacttgttttatatttcatgttgggttttccctcccactattaaacagtctgtttccgt

SEQ ID NO: 20878 - DNA, 6601 bp, Homo sapiens
ctgcgcgccgctggcgctgaggggaggaagtttgctgtcgagcggcctgggttccgtgggcaaggccgtgggaggcagcgttggctgcttcgacacactgagggcggcgcgatgggagacgagatggatgccatgattcccgagcgggagatgaaggattttcagtttagagcgctaaagaaggtgagaatctttgactcccctgaggaattgcccaaggaacgctcgagtctgcttgctgtgtccaacaaatatggtctggtcttcgctggtggagccagtggcttgcagatttttcctactaaaaatcttcttattcaaaataaacccggagatgatcccaacaaaatagttgataaagtccaaggcttgctagttcctatgaaattcccaatccatcacctggccttgagctgtgataacctcacactctctgcgtgcatgatgtccagtgaatatggttccattattgctttttttgatgttcgcacattctcaaatgaggctaaacagcaaaaacgcccatttgcctatcataagcttttgaaagatgcaggaggcatggtgattgatatgaagtggaaccccactgtcccctccatggtggcagtttgtctggctgatggtagtattgctgtcctgcaagtcacggaaacagtgaaagtatgtgcaactcttccttccacggtagcagtaacctctgtgtgctggagccccaaaggaaagcagctggcagtgggaaaacagaatggaactgtggtccagtatcttcctactttgcaggaaaaaaaagtcattccttgtcctccgttttatgagtcagatcatcctgtcagagttctggatgtgctgtggattggtacctacgtcttcgccatagtgtatgctgctgcagatgggaccctggaaacgtctccagatgtggtgatggctctactaccgaaaaaagaagaaaagcacccagagatatttgtgaactttatggagccctgttatggcagctgcacggagagacagcatcattactacctcagttacattgaggaatgggatttagtgctggcagcatctgcggcttcaacagaagttagtatccttgctcgacaaagtgatcagattaattgggaatcttggctactggaggattctagtcgagctgaattgcctgtgacagacaagagtgatgactccttgcccatgggagttgtcgtagactatacaaaccaagtggaaatcaccatcagtgatgaaaagactcttcctcctgctccagttctcatgttactttcaacagatggtgtgctttgtccattttatatgattaatcaaaatcctggggttaagtctctcatcaaaacaccagagcgactttcattagaaggagagcgacagcccaagtcaccaggaagtactcccactaccccaacctcctctcaagccccacagaaactggatgcttctgcagctgcagcccctgcctctctgccaccttcatcacctgctgctcccattgccactttttctttgcttcctgctggtggagcccccactgtgttctcctttggttcttcatctttgaagtcatctgctacggtcactggggagcccccttcatattccagtggctccgacagctccaaagcagccccaggccctggcccatcaaccttctcttttgttcccccttctaaagcctccctagcccccacccctgcagcgtctcctgtggctccatcagctgcttcattctcctttggatcatctggttttaagcctaccctggaaagcacaccagtgccaagtgtgtctgctccaaatatagcaatgaagccctccttcccaccctcaacctctgctgtcaaagtcaaccttagtgaaaagtttactgctgcagctacctctactcctgttagtagctcccagagcgcacccccgatgtcgccattctcttctgcctccaagccagctgcttctggaccactcagccaccccacacctctctcagcaccacctagttccgtgccattgaagtcctcagtcttgccctcaccatcagcaggacgatctgctcagggcagttcaagcccagtgccctcaatggtacagaaatcacccaggataacccctccagcggcaaagccaggctctccccaggcaaagtcacttcagcctgctgttgcagaaaagcagggacatcagtggaaagattcagatcctgtaatggctggaattggggaggagattgcacactttcagaaggagttggaagagttaaaagcccgaacttccaaagcctgtttccaagtgggcacttctgaggagatgaagatgctgcgaacagaatcagatgacttgcatacctttcttttggagattaaagagaccacagagtcgcttcatggagatataagtagcctgaaaacaactttacttgagggctttgctggtgttgaggaagccagagaacaaaatgaaagaaatcgtgactctggttatctgcatttgctttataaaagaccactggatcccaagagtgaagctcagcttcaggaaattcggcgccttcatcagtatgtgaaatttgctgtccaagatgtgaatgatgttctagacttggagtgggatcagcatctggaacaaaagaaaaaacaaaggcacctgcttgtgccagagcgagagacactgtttaacaccctagccaacaatcgggaaatcatcaaccaacagaggaagaggctgaatcacctggtggatagtcttcagcagctccgcctttacaaacagacttccctgtggagcctgtcctcggctgttccttcccagagcagcattcacagttttgacagtgacctggaaagcctgtgcaatgctttgttgaaaaccaccatagaatctcacaccaaatccttgcccaaagtaccagccaaactgtcccccatgaaacaggcacaactgagaaacttcttggccaagaggaagaccccaccagtgagatccactgctccagccagcctgtctcgatcagcctttctgtctcagagatattatgaagacttggatgaagtcagctcaacgtcatctgtctcccagtctctggagagtgaagatgcacggacgtcctgtaaagatgacgaggcagtggttcaggcccctcggcacgcccccgtggttcgcactccttccatccagcccagtctcttgccccatgcagcaccttttgctaaatctcacctggttcatggttcttcacctggtgtgatgggaacttcagtggctacatctgctagcaaaattattcctcaaggggccgatagcacaatgcttgccacgaaaaccgtgaaacatggtgcacctagtccttcccaccccatctcagccccgcaggcagctgccgcagcagcactcaggcggcagatggccagtcaggcaccagctgtaaacactttgactgaatcaacgttgaagaatgtccctcaagtggtaaatgtgcaggaattgaagaataaccctgcaaccccttctacagccatgggttcttcagtgccctactccacagccaaaacacctcacccagtgttgaccccagtggctgctaaccaagccaagcaggggtctctaataaattcccttaagccatctgggcctacaccagcatccggtcagttatcatctggtgacaaagcttcagggacagccaagatagaaacagctgtgacttcaaccccatctgcttctgggcagttcagcaagcctttctcattttctccatcagggactggctttaattttgggataatcacaccaacaccgtcttctaatttcactgctgcacaaggggcaacaccctccactaaagagtcaagccagccggacgcattctcatctggtgggggaagcaaaccttcttatgaggccattcctgaaagctcacctccctcaggaatcacatccgcatcaaacaccaccccaggagaacctgccgcatctagcagcagacctgtggcaccttctggaactgctctttccaccacctctagtaagctggaaaccccaccgtccaagctgggagagcttctgtttccaagttctttggctggagagactctgggaagtttttcaggactgcgggttggccaagcagatgattctacaaaaccaaccaataaggcttcatccacaagcctaactagtacccagccaaccaagacgtcaggcgtgccctcagggtttaattttactgcccccccggtgttagggaagcacacggagccccctgtgacatcctctgcaaccaccacctcagtagcaccaccagcagccaccagcacttcctcaactgccgtttttggcagtctgccagtcaccagtgcaggatcctctggggtcatcagttttggtgggacatctctaagtgctggcaagactagtttttcatttggaagccaacagaccaatagcacagtgcccccatctgccccaccaccaactacagctgccactccccttccaacatcattccccacattgtcatttggtagcctcctgagttcagcaactaccccctccctgcctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactagtcttgtagcactttctgcagaggctaccccagccaccacgggggtccctgatgccaggacggaggcagtaccacctgcttcctccttttctgtgcctgggcagactgctgtcacagcagctgctatctcaagtgcaggccctgtggccgtcgaaacatcaagtacccccatagcctccagcaccacgtccattgttgctcccggcccatctgcagaggcagcagcatttggtaccgtcacttctggctcatccgtctttgctcagcctcctgctgccagttctagctcagctttcaaccagctcaccaacaacacagccactgccccctctgccacgcccgtgtttgggcaagtggcagccagcaccgcaccaagtctgtttgggcagcagactggtagcacagccagcacagcagctgccacaccacaggtcagcagctcagggtttagcagcccagcttttggtaccacagccccaggggtctttggacagacaaccttcgggcaggcctcagtctttgggcagtcggcgagcagtgctgcaagtgtcttttccttcagtcagcctgggttcagttccgtgcctgccttcggtcagcctgcttcctccactcccacatccaccagtggaagtgtctttggtgccgcctcaagtaccagtagctccagttccttctcatttggacagtcttctcccaacacaggaggggggctgtttggccaaagcaacgctcctgcttttgggcagagtcctggctttggacagggaggctctgtctttggtggtacctcagctgccaccacaacagcagcaacctctgggttcagcttttgccaagcttcaggttttgggtctagtaatactggttctgtgtttggtcaagcagccagtactggtggaatagtctttggccagcaatcatcctcttccagtggtagcgtgtttgggtctggaaacactggaagagggggaggtttcttcagtggccttggaggaaaacccagtcaggatgcagccaacaaaaacccattcagctcggccagtgggggctttggatccacagctacctcaaatacctctaacctatttggaaacagtggggccaagacatttggtggatttgccagctcgtcgtttggagagcagaaacccactggcactttcagctctggaggaggaagtgtggcatcccaaggctttgggttttcctctccaaacaaaacaggtggcttcggtgctgctccagtgtttggcagccctcctacttttgggggatcccctgggtttggaggggtgccagcattcggttcagccccagcctttacaagccctctgggctcgacgggaggcaaagtgttcggagagggcactgcagctgccagcgcaggaggattcgggtttgggagcagcagcaacaccacatccttcggcacgctcgcgagtcagaatgcccccactttcggatcactgtcccaacagacttctggttttgggacccagagtagcggattctctggttttggatcaggcacaggagggttcagctttgggtcaaataactcgtctgtccagggttttggtggctggcgaagctgagggcgtgtcagcaggcctttcgatccctgggaccaaccgcatcctcagcttcttccccgagaaatgctggagcaggctgttcagaccgacgttgccatcaaaacacatacacccagaaagaaacaacagaaaccaaaactcacaaggcgcatgattacttgttttatatttcatgttgggttttccctcccactattaaacagtctgtttccgt

SEQ ID NO: 20879 - DNA, 393 bp, Homo sapiens
ggagagggcactgcagctgccagcgcaggaggattcgggtttgggagcagcagcaacaccacatccttcggcacgctcgcgagtcagaatgcccccactttcggatcactgtcccaacagacttctggttttgggacccagagtagcggattctctggttttggatcaggcacaggagggttcagctttgggtcaaataactcgtctgtccagggttttggtggctggcgaagctgagggcgtgtcagcaggctgttcagaccgacgttgccatcaaaacacatacacccagaaagaaacaacagaaaccaaaactcacaaggcgcatgattacttgttttatatttcatgttgggttttccctcccactattaaacagtctgtttccgtaca

SEQ ID NO: 20880 - DNA, 5269 bp, Homo sapiens
ggcgctgaggggaggaagtttgctgtcgagcggcctgggttccgtgggcaaggccgtgggaggcagcgttggctgcttcgacacactaccccaacctcctctcaagccccacagaaactggatgcttctgcagctgcagcccctgcctctctgccaccttcatcacctgctgctcccattgccactttttctttgcttcctgctggtggagcccccactgtgttctcctttggttcttcatctttgaagtcatctgctacggtcactggggagcccccttcatattccagtggctccgacagctccaaagcagccccaggccctggcccatcaaccttctcttttgttcccccttctaaagcctccctagcccccacccctgcagcgtctcctgtggctccatcagctgcttcattctcctttggatcatctggttttaagcctaccctggaaagcacaccagtgccaagtgtgtctgctccaaatatagcaatgaagccctccttcccaccctcaacctctgctgtcaaagtcaaccttagtgaaaagtttactgctgcagctacctctactcctgttagtagctcccagagcgcacccccgatgtcgccattctcttctgcctccaagccagctgcttctggaccactcagccaccccacacctctctcagcaccacctagttccgtgccattgaagtcctcagtcttgccctcaccatcagcaggacgatctgctcagggcagttcaagcccagtgccctcaatggtacagaaatcacccaggataacccctccagcggcaaagccaggctctccccaggcaaagtcacttcagcctgctgttgcagaaaagcagggacatcagtggaaagattcagatcctgtaatggctggaattggggaggagattgcacactttcagaaggagttggaagagttaaaagcccgaacttccaaagcctgtttccaagtgggcacttctgaggagatgaagatgctgcgaacagaatcagatgacttgcatacctttcttttggagattaaagagaccacagagtcgcttcatggagatataagtagcctgaaaacaactttacttgagggctttgctggtgttgaggaagccagagaacaaaatgaaagaaatcgtgactctggttatctgcatttgctttataaaagaccactggatcccaagagtgaagctcagcttcaggaaattcggcgccttcatcagtatgtgaaatttgctgtccaagatgtgaatgatgttctagacttggagtgggatcagcatctggaacaaaagaaaaaacaaaggcacctgcttgtgccagagcgagagacactgtttaacaccctagccaacaatcgggaaatcatcaaccaacagaggaagaggctgaatcacctggtggatagtcttcagcagctccgcctttacaaacagacttccctgtggagcctgtcctcggctgttccttcccagagcagcattcacagttttgacagtgacctggaaagcctgtgcaatgctttgttgaaaaccaccatagaatctcacaccaaatccttgcccaaagtaccagccaaactgtcccccatgaaacaggcacaactgagaaacttcttggccaagaggaagaccccaccagtgagatccactgctccagccagcctgtctcgatcagcctttctgtctcagagatattatgaagacttggatgaagtcagctcaacgtcatctgtctcccagtctctggagagtgaagatgcacggacgtcctgtaaagatgacgaggcagtggttcaggcccctcggcacgcccccgtggttcgcactccttccatccagcccagtctcttgccccatgcagcaccttttgctaaatctcacctggttcatggttcttcacctggtgtgatgggaacttcagtggctacatctgctagcaaaattattcctcaaggggccgatagcacaatgcttgccacgaaaaccgtgaaacatggtgcacctagtccttcccaccccatctcagccccgcaggcagctgccgcagcagcactcaggcggcagatggccagtcaggcaccagctgtaaacactttgactgaatcaacgttgaagaatgtccctcaagtggtaaatgtgcaggaattgaagaataaccctgcaaccccttctacagccatgggttcttcagtgccctactccacagccaaaacacctcacccagtgttgaccccagtggctgctaaccaagccaagcaggggtctctaataaattcccttaagccatctgggcctacaccagcatccggtcagttatcatctggtgacaaagcttcagggacagccaagatagaaacagctgtgacttcaaccccatctgcttctgggcagttcagcaagcctttctcattttctccatcagggactggctttaattttgggataatcacaccaacaccgtcttctaatttcactgctgcacaaggggcaacaccctccactaaagagtcaagccagccggacgcattctcatctggtgggggaagcaaaccttcttatgaggccattcctgaaagctcacctccctcaggaatcacatccgcatcaaacaccaccccaggagaacctgccgcatctagcagcagacctgtggcaccttctggaactgctctttccaccacctctagtaagctggaaaccccaccgtccaagctgggagagcttctgtttccaagttctttggctggagagactctgggaagtttttcaggactgcgggttggccaagcagatgattctacaaaaccaaccaataaggcttcatccacaagcctaactagtacccagccaaccaagacgtcaggcgtgccctcagggtttaattttactgcccccccggtgttagggaagcacacggagccccctgtgacatcctctgcaaccaccacctcagtagcaccaccagcagccaccagcacttcctcaactgccgtttttggcagtctgccagtcaccagtgcaggatcctctggggtcatcagttttggtgggacatctctaagtgctggcaagactagtttttcatttggaagccaacagaccaatagcacagtgcccccatctgccccaccaccaactacagctgccactccccttccaacatcattccccacattgtcatttggtagcctcctgagttcagcaactaccccctccctgcctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactagtcttgtagcactttctgcagaggctaccccagccaccacgggggtccctgatgccaggacggaggcagtaccacctgcttcctccttttctgtgcctgggcagactgctgtcacagcagctgctatctcaagtgcaggccctgtggccgtcgaaacatcaagtacccccatagcctccagcaccacgtccattgttgctcccggcccatctgcagaggcagcagcatttggtaccgtcacttctggctcatccgtctttgctcagcctcctgctgccagttctagctcagctttcaaccagctcaccaacaacacagccactgccccctctgccacgcccgtgtttgggcaagtggcagccagcaccgcaccaagtctgtttgggcagcagactggtagcacagccagcacagcagctgccacaccacaggtcagcagctcagggtttagcagcccagcttttggtaccacagccccaggggtctttggacagacaaccttcgggcaggcctcagtctttgggcagtcggcgagcagtgctgcaagtgtcttttccttcagtcagcctgggttcagttccgtgcctgccttcggtcagcctgcttcctccactcccacatccaccagtggaagtgtctttggtgccgcctcaagtaccagtagctccagttccttctcatttggacagtcttctcccaacacaggaggggggctgtttggccaaagcaacgctcctgcttttgggcagagtcctggctttggacagggaggctctgtctttggtggtacctcagctgccaccacaacagcagcaacctctgggttcagcttttgccaagcttcaggttttgggtctagtaatactggttctgtgtttggtcaagcagccagtactggtggaatagtctttggccagcaatcatcctcttccagtggtagcgtgtttgggtctggaaacactggaagagggggaggtttcttcagtggccttggaggaaaacccagtcaggatgcagccaacaaaaacccattcagctcggccagtgggggctttggatccacagctacctcaaatacctctaacctatttggaaacagtggggccaagacatttggtggatttgccagctcgtcgtttggagagcagaaacccactggcactttcagctctggaggaggaagtgtggcatcccaaggctttgggttttcctctccaaacaaaacaggtggcttcggtgctgctccagtgtttggcagccctcctacttttgggggatcccctgggtttggaggggtgccagcattcggttcagccccagcctttacaagccctctgggctcgacgggaggcaaagtgttcggagagggcactgcagctgccagcgcaggaggattcgggtttgggagcagcagcaacaccacatccttcggcacgctcgcgagtcagaatgcccccactttcggatcactgtcccaacagacttctggttttgggacccagagtagcggattctctggttttggatcaggcacaggagggttcagctttgggtcaaataactcgtctgtccagggttttggtggctggcgaagctgagggcgtgtcagcaggcctttcgatccctgggaccaaccgcatcctcagcttcttccccgagaaatgctggagcaggctgttcagaccgacgttgccatcaaaacacatacacccagaaagaaacaacagaaaccaaaactcacaaggcgcatgattacttgttttatatttcatgttgggttttccctcccactattaaacagtctgtttccgt

SEQ ID NO: 20881 - DNA, 6698 bp, Homo sapiens
ctgcgcgccgctggcgctgaggggaggaagtttgctgtcgagcggcctgggttccgtgggcaaggccgtgggaggcagcgttggctgcttcgacacactgagggcggcgcgatgggagacgagatggatgccatgattcccgagcgggagatgaaggattttcagtttagagcgctaaagaaggtgagaatctttgactcccctgaggaattgcccaaggaacgctcgagtctgcttgctgtgtccaacaaatatggtctggtcttcgctggtggagccagtggcttgcagatttttcctactaaaaatcttcttattcaaaataaacccggagatgatcccaacaaaatagttgataaagtccaaggcttgctagttcctatgaaattcccaatccatcacctggccttgagctgtgataacctcacactctctgcgtgcatgatgtccagtgaatatggttccattattgctttttttgatgttcgcacattctcaaatgaggctaaacagcaaaaacgcccatttgcctatcataagcttttgaaagatgcaggaggcatggtgattgatatgaagtggaaccccactgtcccctccatggtggcagtttgtctggctgatggtagtattgctgtcctgcaagtcacggaaacagtgaaagtatgtgcaactcttccttccacggtagcagtaacctctgtgtgctggagccccaaaggaaagcagctggcagtgggaaaacagaatggaactgtggtccagtatcttcctactttgcaggaaaaaaaagtcattccttgtcctccgttttatgagtcagatcatcctgtcagagttctggatgtgctgtggattggtacctacgtcttcgccatagtgtatgctgctgcagatgggaccctggaaacgtctccagatgtggtgatggctctactaccgaaaaaagaagaaaagcacccagagatatttgtgaactttatggagccctgttatggcagctgcacggagagacagcatcattactacctcagttacattgaggaatgggatttagtgctggcagcatctgcggcttcaacagaagttagtatccttgctcgacaaagtgatcagattaattgggaatcttggctactggaggattctagtcgagctgaattgcctgtgacagacaagagtgatgactccttgcccatgggagttgtcgtagactatacaaaccaagtggaaatcaccatcagtgatgaaaagactcttcctcctgctccagttctcatgttactttcaacagatggtgtgctttgtccattttatatgattaatcaaaatcctggggttaagtctctcatcaaaacaccagagcgactttcattagaaggagagcgacagcccaagtcaccaggaagtactcccactaccccaacctcctctcaagccccacagaaactggatgcttctgcagctgcagcccctgcctctctgccaccttcatcacctgctgctcccattgccactttttctttgcttcctgctggtggagcccccactgtgttctcctttggttcttcatctttgaagtcatctgctacggtcactggggagcccccttcatattccagtggctccgacagctccaaagcagccccaggccctggcccatcaaccttctcttttgttcccccttctaaagcctccctagcccccacccctgcagcgtctcctgtggctccatcagctgcttcattctcctttggatcatctggttttaagcctaccctggaaagcacaccagtgccaagtgtgtctgctccaaatatagcaatgaagccctccttcccaccctcaacctctgctgtcaaagtcaaccttagtgaaaatagctcccagagcgcacccccgatgtcgccattctcttctgcctccaagccagctgcttctggaccactcagccaccccacacctctctcagcaccacctagttccgtgccattgaagtcctcagtcttgccctcaccatcaggacgatctgctcagggcagttcaagcccagtgccctcaatggtacagaaatcacccaggataacccctccagcggcaaagccaggctctccccaggcaaagtcacttcagcctgctgttgcagaaaagcagggacatcagtggaaagattcagatcctgtaatggctggaattggggaggagattgcacactttcagaaggagttggaagagttaaaagcccgaacttccaaagcctgtttccaagtgggcacttctgaggagatgaagatgctgcgaacagaatcagatgacttgcatacctttcttttggagattaaagagaccacagagtcgcttcatggagatataagtagcctgaaaacaactttacttgagggctttgctggtgttgaggaagccagagaacaaaatgaaagaaatcgtgactctggttatctgcatttgctttataaaagaccactggatcccaagagtgaagctcagcttcaggaaattcggcgccttcatcagtatgtgaaatttgctgtccaagatgtgaatgatgttctagacttggagtgggatcagcatctggaacaaaagaaaaaacaaaggcacctgcttgtgccagagcgagagacactgtttaacaccctagccaacaatcgggaaatcatcaaccaacagaggaagaggctgaatcacctggtggatagtcttcagcagctccgcctttacaaacagacttccctgtggagcctgtcctcggctgttccttcccagagcagcattcacagttttgacagtgacctggaaagcctgtgcaatgctttgttgaaaaccaccatagaatctcacaccaaatccttgcccaaagtaccagccaaactgtcccccatgaaacaggcacaactgagaaacttcttggccaagaggaagaccccaccagtgagatccactgctccagccagcctgtctcgatcagcctttctgtctcagagatattatgaagacttggatgaagtcagctcaacgtcatctgtctcccagtctctggagagtgaagatgcacggacgtcctgtaaagatgacgaggcagtggttcaggcccctcggcacgcccccgtggttcgcactccttccatccagcccagtctcttgccccatgcagcaccttttgctaaatctcacctggttcatggttcttcacctggtgtgatgggaacttcagtggctacatctgctagcaaaattattcctcaaggggccgatagcacaatgcttgccacgaaaaccgtgaaacatggtgcacctagtccttcccaccccatctcagccccgcaggcagctgccgcagcagcactcaggcggcagatggccagtcaggcaccagctgtaaacactttgactgaatcaacgttgaagaatgtccctcaagtggtaaatgtgcaggaattgaagaataaccctgcaaccccttctacagccaaaacacctcacccagtgttgaccccagtggctgctaaccaagccaagcaggggtctctaataaattcccttaagccatctgggcctacaccagcatccggtcagttatcatctggtgacaaagcttcagggacagccaagatagaaacagctgtgacttcaaccccatctgcttctgggcagttcagcaagcctttctcattttctccatcagggactggctttaattttgggataatcacaccaacaccgtcttctaatttcactgctgcacaaggggcaacaccctccactaaagagtcaagccagccggacgcattctcatctggtgggggaagcaaaccttcttatgaggccattcctgaaagctcacctccctcaggaatcacatccgcatcaaacaccaccccaggagaacctgccgcatctagcagcagacctgtggcaccttctggaactgctctttccaccacctctagtaagctggaaaccccaccgtccaagctgggagagcttctgtttccaagttctttggctggagagactctgggaagtttttcaggactgcgggttggccaagcagatgattctacaaaaccaaccaataaggcttcatccacaagcctaactagtacccagccaaccaagacgtcaggcgtgccctcagggtttaattttactgcccccccggtgttagggaagcacacggagccccctgtgacatcctctgcaaccaccacctcagtagcaccaccagcagccaccagcacttcctcaactgccgtttttggcagtctgccagtcaccagtgcaggatcctctggggtcatcagttttggtgggacatctctaagtgctggcaagactagtttttcatttggaagccaacagaccaatagcacagtgcccccatctgccccaccaccaactacagctgccactccccttccaacatcattccccacattgtcatttggtagcctcctgagttcagcaactaccccctccctgcctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactagtcttgtagcactttctgcagaggctaccccagccaccacgggggtccctgatgccaggacggaggcagtaccacctgcttcctccttttctgtgcctgggcagactgctgtcacagcagctgctatctcaagtgcaggccctgtggccgtcgaaacatcaagtacccccatagcctccagcaccacgtccattgttgctcccggcccatctgcagaggcagcagcatttggtaccgtcacttctggctcatccgtctttgctcagcctcctgctgccagttctagctcagctttcaaccagctcaccaacaacacagccactgccccctctgccacgcccgtgtttgggcaagtggcagccagcaccgcaccaagtctgtttgggcagcagactggtagcacagccagcacagcagctgccacaccacaggtcagcagctcagggtttagcagcccagcttttggtaccacagccccaggggtctttggacagacaaccttcgggcaggcctcagtctttgggcagtcggcgagcagtgctgcaagtgtcttttccttcagtcagcctgggttcagttccgtgcctgccttcggtcagcctgcttcctccactcccacatccaccagtggaagtgtctttggtgccgcctcaagtaccagtagctccagttccttctcatttggacagtcttctcccaacacaggaggggggctgtttggccaaagcaacgctcctgcttttgggcagagtcctggctttggacagggaggctctgtctttggtggtacctcagctgccaccacaacagcagcaacctctgggttcagcttttgccaagcttcaggttttgggtctagtaatactggttctgtgtttggtcaagcagccagtactggtggaatagtctttggccagcaatcatcctcttccagtggtagcgtgtttgggtctggaaacactggaagagggggaggtttcttcagtggccttggaggaaaacccagtcaggatgcagccaacaaaaacccattcagctcggccagtgggggctttggatccacagctacctcaaatacctctaacctatttggaaacagtggggccaagacatttggtggatttgccagctcgtcgtttggagagcagaaacccactggcactttcagctctggaggaggaagtgtggcatcccaaggctttgggttttcctctccaaacaaaacaggtggcttcggtgctgctccagtgtttggcagccctcctacttttgggggatcccctgggtttggaggggtgccagcattcggttcagccccagcctttacaagccctctgggctcgacgggaggcaaagtgttcggagagggcactgcagctgccagcgcaggaggattcgggtccctggccatgagcctgtctccgaccctgaagggcaggctgttgctgatgaggcccaaggcaggaggaggaagggagcaggccgctcctgggagaaagtccaatgagagcagatcccttggccacctttgtatggaaagagccttgacctcaccattaaaagtttgggagcagcagcaacaccacatccttcggcacgctcgcgagtcagaatgcccccactttcggatcactgtcccaacagacttctggttttgggacccagagtagcggattctctggttttggatcaggcacaggagggttcagctttgggtcaaataactcgtctgtccagggttttggtggctggcgaagctgagggcgtgtcagcaggcctttcgatccctgggaccaaccgcatcctcagcttcttccccgagaaatgctggagcaggctgttcagaccgacgttgccatcaaaacacatacacccagaaagaaacaacagaaaccaaaactcacaaggcgcatgattacttgttttatatttcatgttgggttttccctcccactattaaacagtctgtttccgt

SEQ ID NO: 20882 - DNA, 2818 bp, Homo sapiens
atgaaatcctctcttttgttacgaggtgttcacttctgttttcacttgccaggggcaacaccctccactaaagagtcaagccagccggacgcattctcatctggtgggggaagcaaaccttcttatgaggccattcctgaaagctcacctccctcaggaatcacatccgcatcaaacaccaccccaggagaacctgccgcatctagcagcagacctgtggcaccttctggaactgctctttccaccacctctagtaagctggaaaccccaccgtccaagctgggagagcttctgtttccaagttctttggctggagagactctgggaagtttttcaggactgcgggttggccaagcagatgattctacaaaaccaaccaataaggcttcatccacaagcctaactagtacccagccaaccaagacgtcaggcgtgccctcagggtttaattttactgcccccccggtgttagggaagcacacggagccccctgtgacatcctctgcaaccaccacctcagtagcaccaccagcagccaccagcacttcctcaactgccgtttttggcagtctgccagtcaccagtgcaggatcctctggggtcatcagttttggtgggacatctctaagtgctggcaagactagtttttcatttggaagccaacagaccaatagcacagtgcccccatctgccccaccaccaactacagctgccactccccttccaacatcattccccacattgtcatttggtagcctcctgagttcagcaactaccccctccctgcctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactagtcttgtagcactttctgcagaggctaccccagccaccacgggggtccctgatgccaggacggaggcagtaccacctgcttcctccttttctgtgcctgggcagactgctgtcacagcagctgctatctcaagtgcaggccctgtggccgtcgaaacatcaagtacccccatagcctccagcaccacgtccattgttgctcccggcccatctgcagaggcagcagcatttggtaccgtcacttctggctcatccgtctttgctcagcctcctgctgccagttctagctcagctttcaaccagctcaccaacaacacagccactgccccctctgccacgcccgtgtttgggcaagtggcagccagcaccgcaccaagtctgtttgggcagcagactggtagcacagccagcacagcagctgccacaccacaggtcagcagctcagggtttagcagcccagcttttggtaccacagccccaggggtctttggacagacaaccttcgggcaggcctcagtctttgggcagtcggcgagcagtgctgcaagtgtcttttccttcagtcagcctgggttcagttccgtgcctgccttcggtcagcctgcttcctccactcccacatccaccagtggaagtgtctttggtgccgcctcaagtaccagtagctccagttccttctcatttggacagtcttctcccaacacaggaggggggctgtttggccaaagcaacgctcctgcttttgggcagagtcctggctttggacagggaggctctgtctttggtggtacctcagctgccaccacaacagcagcaacctctgggttcagcttttgccaagcttcaggttttgggtctagtaatactggttctgtgtttggtcaagcagccagtactggtggaatagtctttggccagcaatcatcctcttccagtggtagcgtgtttgggtctggaaacactggaagagggggaggtttcttcagtggccttggaggaaaacccagtcaggatgcagccaacaaaaacccattcagctcggccagtgggggctttggatccacagctacctcaaatacctctaacctatttggaaacagtggggccaagacatttggtggatttgccagctcgtcgtttggagagcagaaacccactggcactttcagctctggaggaggaagtgtggcatcccaaggctttgggttttcctctccaaacaaaacaggtggcttcggtgctgctccagtgtttggcagccctcctacttttgggggatcccctgggtttggaggggtgccagcattcggttcagccccagcctttacaagccctctgggctcgacgggaggcaaagtgttcggagagggcactgcagctgccagcgcaggaggattcgggtttgggagcagcagcaacaccacatccttcggcacgctcgcgagtcagaatgcccccactttcggatcactgtcccaacagacttctggttttgggacccagagtagcggattctctggttttggatcaggcacaggagggttcagctttgggtcaaataactcgtctgtccagggttttggtggctggcgaagctgagggcgtgtcagcaggcctttcgatccctgggaccaaccgcatcctcagcttcttccccgagaaatgctggagcaggctgttcagaccgacgttgccatcaaaacacatacacccagaaagaaacaacagaaaccaaaactcacaaggcgcatgattacttgttttatatttcatgttgggttttccctcccactattaaacagtctgtttccgt

SEQ ID NO: 20883 - DNA, 1633 bp, Homo sapiens
acgcaaccccataaggtagcacgccgttacccgtggggagcgtttccgccatttttgaaaattaattgggaaggtactggttttaagtgtagttgccgacgcaatggcagcctttgcagtggaacctcaggggcccgcgttaggatctgaaccaatgatgctgggttcacccacatctccaaagccaggagttaatgcccagttcttacctggatttttaatgggggatttgccagctccggtgactccacaacctcgatcaattagtggcccttcagtaggagtaatggaaatgagatcacctttacttgcaggtgggtcaccaccacaaccagttgtaccagctcataaagataaaagtggcgctccaccagttagaagtatatatgatgacatttctagcccaggacttggatcaacacctttaacttcaagaagacagccaaacatttcagtaatgcagagtcctcttgttggagttacatctactcctggaacagggcaaagtatgtttagtccagcaagtatcggtcagccacgaaagacgacattatctcctgcccagttggatcctttttatactcaaggagattctttgacttcagaagatcacctcgatgactcttgggtgactgtatttgggtttcctcaagcatctgcttcctacatattactacaatttgcacagtatgggaatatcttaaaacatgtgatgtctaatacaggaaattggatgcatattcgttatcaatctaaactgcaggctcggaaagccttaagcaaagatgggaggatttttggagaatccatcatgattggtgtaaaaccatgtattgacaaaagtgttatggaaagcagtgacagatgtgctttatcatctccatctttagcctttacaccaccaatcaaaactctaggtacaccaacacaacctggaagtactcctaggatttctaccatgagacctcttgctacagcatacaaagcctctactagtgattatcaggttatttctgacagacaaacgccaaaaaaagatgaaagtcttgtatccaaagcaatggagtacatgtttggctggtagtagaacaccaagaaggaggttgctacactaaaacagagttagcagagtgctgctggttccttcggttagttatataactgttcctgcagtattggatagctatctcatacttcttttagaaagaagcctttttcattaaggatacaacctatttgtagctcgcactttaaaagatgcttgagatacattttaaagaaaactaaaaatccctgtaaataggattttgtgctttctgtaacagtgcatgcttcagcacagaaaactcagcattgattattgtaaattaaataactgaaattgtggtgagacgtcatagtcttcatgagaacgtgggggtgaatttcatgaaggggaactatagttatttctaccgacacaaatattataattagcaatttgaattatggtcttttaatttagatagtatttaatattttaattatccttgtttgtatatgtcctgtcacagagtgtcctcttggtgtattctaaaacgagcattcttttaaaaaacctaaagtttcttgataataaacattgtcaatgata

SEQ ID NO: 20884 - DNA, 1470 bp, Homo sapiens
acaccaggtgctgaaggctgagacggtgagagcatgagtgataagatgctctctccccttgctctctttctgaagatgacaaactccatcttttttctaaagtcttactaaaggtgacaatgtatatagtataatgaaggatgttactaaatgacatgtgctgcacacctgagtcttgtggaggctgaagaaaaggaggcttctgtagaaaataggaactcagatctgaaccaatgatgctgggttcacccacatctccaaagccaggagttaatgcccagttcttacctggatttttaatgggggatttgccagctccggtgactccacaacctcgatcaattagtggcccttcagtaggagtaatggaaatgagatcacctttacttgcaggtgggtcaccaccacaaccagttgtaccagctcataaagataaaagtggcgctccaccagttagaagtatatatgatgacatttctagcccaggacttggatcaacacctttaacttcaagaagacagccaaacatttcagtaatgcagagtcctcttgttggagttacatctactcctggaacagggcaaagtatgtttagtccagcaagtatcggtcagccacgaaagacgacattatctcctgcccagttggatcctttttatactcaaggagattctttgacttcagaagatcacctcgatgactcttgggtgactgtatttgggtttcctcaagcatctgcttcctacatattactacaatttgcacagtatgggaatatcttaaaacatgtgatgtctaatacaggaaattggatgcatattcgttatcaatctaaactgcaggctcggaaagccttaagcaaagatgggaggatttttggagaatccatcatgattggtgtaaaaccatgtattgacaaaagtgttatggaaagcagtgacagatgtgctttatcatctccatctttagcctttacaccaccaatcaaaactctaggtacaccaacacaacctggaagtactcctaggatttctaccatgagacctcttgctacagcatacaaagcctctactagtgattatcaggttatttctgacagacaaacgccaaaaaaagatgaaagtcttgtatccaaagcaatggagtacatgtttggctggtagtagaacaccaagaaggaggttgctacactaaaacagagttagcagagtgctgctggttccttcggttagttatataactgttcctgcagtattggatagctatctcatacttcttttagaaagaagcctttttcattaaggatacaacctatttgtagctcgcactttaaaagatgcttgagatacattttaaagaaaactaaaaatccctgtaaataggattttgtgctttctgtaacagtgcatgcttcagcacagaaaactcagcattgattattgtaaattaaataactgaaattgtggtgag

SEQ ID NO: 20885 - DNA, 1624 bp, Homo sapiens
agttgccgacgcaatggcagcctttgcagtggaacctcaggggcccgcgttaggatctgaaccaatgatgctgggttcacccacatctccaaagccaggagttaatgcccagttcttacctggatttttaatgggggatttgccagctccggtgactccacaacctcgatcaattagtggcccttcagtaggagtaatggaaatgagatcacctttacttgcaggtgggtcaccaccacaaccagttgtaccagctcataaagataaaagtggcgctccaccagttagaagtatatatgatgacatttctagcccaggacttggatcaacacctttaacttcaagaagacagggtccccaacagggtcctgatcagttgcccaggctagagtgcagcggcacagtcataactctgcagccttgaactcctgggttcaaccaatcctcctgcctcaactgtcctattgggatatagccaaacatttcagtaatgcagagtcctcttgttggagttacatctactcctggaacagggcaaagtatgtttagtccagcaagtatcggtcagccacgaaagacgacattatctcctgcccagttggatcctttttatactcaaggagattctttgacttcagaagatcacctcgatgactcttgggtgactgtatttgggtttcctcaagcatctgcttcctacatattactacaatttgcacagtatgggaatatcttaaaacatgtgatgtctaatacaggaaattggatgcatattcgttatcaatctaaactgcaggctcggaaagccttaagcaaagatgggaggatttttggagaatccatcatgattggtgtaaaaccatgtattgacaaaagtgttatggaaagcagtgacagatgtgctttatcatctccatctttagcctttacaccaccaatcaaaactctaggtacaccaacacaacctggaagtactcctaggatttctaccatgagacctcttgctacagcatacaaagcctctactagtgattatcaggttatttctgacagacaaacgccaaaaaaagatgaaagtcttgtatccaaagcaatggagtacatgtttggctggtagtagaacaccaagaaggaggttgctacactaaaacagagttagcagagtgctgctggttccttcggttagttatataactgttcctgcagtattggatagctatctcatacttcttttagaaagaagcctttttcattaaggatacaacctatttgtagctcgcactttaaaagatgcttgagatacattttaaagaaaactaaaaatccctgtaaataggattttgtgctttctgtaacagtgcatgcttcagcacagaaaactcagcattgattattgtaaattaaataactgaaattgtggtgagacgtcatagtcttcatgagaacgtgggggtgaatttcatgaaggggaactatagttatttctaccgacacaaatattataattagcaatttgaattatggtcttttaatttagatagtatttaatattttaattatccttgtttgtatatgtcctgtcacagagtgtcctcttggtgtattctaaaacgagcattctttt

SEQ ID NO: 20886 - DNA, 1203 bp, Homo sapiens
tttcgtgaccttgtccagtagaaggctatttaattttcacaactgcttgaattttgacatacaagatgaagcaagatgcctcaagaaatgctgcctacactgtggattgtgaagattatgtgcatgtggtagaatttaatccctttgagaatggggattcaggaaacctaattgcatatggtggcaataattatgtggtcattggcacgtgtacgtttcaggaagaagaagcagacgttgaaggcattcagtataaaacacttcgaacatttcaccatggagtcagggttgatggcatagcttggagcccagagactagacttgattcattgcctccagtaatcaaattttgtacttcagctgctgatatgaaaattagattatttacttcagatcttcaggataaaaatgaatataaggttttagagggccataccgatttcattaatggtttggtgtttgatcccaaagaaggccaagaaattgcaagtgtgagtgacgatcacacctgcaggatttggaacttggaaggagtgcaaacagctcattttgttcttcattctcctggcatgagtgtgtgctggcatcctgaggagacttttaagctaatggttgcagagaagaatggaacaatccggttttatgatcttttggcccaacaggctattttatctcttgaatcagaacaagtgccattaatgtcagcacactggtgcttaaaaaacaccttcaaagttggagccgttgcaggaaatgattggttaatttgggatattactcggtccagttatcctcaaaataagagacctgttcacatggatcgagcctgcttattcaggtggtccacaattagtgaaaatctgtttgcaaccactggttatcctggcaaaatggcaagccagtttcaaattcatcatttaggacaccctcagcccatcctcatgggttctgtagccgttggatctggactgtcctggcatcgaactctccctctgtgtgtaattggaggagaccacaagctgttgttttgggtgactgaagtataaagtgttttctgtaccttagattcacaaactttgtatttttagtacatattttgaagaatttctatagtacatattttgaagaatttttatatcaaatataccgtatactttagaaaatgtctcagttgcttttattaaataaaatgttgatggtttg

SEQ ID NO: 20887 - DNA, 645 bp, Homo sapiens
tattttaatttttaagttccgggatacgtgtgcgggacgtgcaggtttattacaaaggtaaaacgtgtgctatggtggtttgcacacccatcacctaggtattaagctccacatgcattagctatttatcctgatgctctccctccgcccaaccccctgaacattatttttatatcacacattttggtactccttaacaacagatcctgtattttctatctgtttatattatagcccttttcacgttgagtcataactatccctaaactgtggtctccttcaagccaggaggctgtttttttcttcattagcgctggttctccacacacaatgaagtcttccaaatcctggccctgcttatgagcttggcaagttagttaacctactgaagcctcagtttctccatctacaaaatggagaccagagtttcgtgaccttgtccagtagaaggctatttaattttcacaactgcttgaattttgacatacaagatgaagcaagatgcctcaagaaatgctgcctacactgtggattgtgaagattatgtgcatgtggtagaatttaatccctttgagaatggggattcaggaaacctaattgcatatggtggcaataattatgtggtcattggcacgtgtacgtttc

SEQ ID NO: 20888 - DNA, 1286 bp, Homo sapiens
aagcagagccacagcgcgtcgcggcagcccccaaggaagaccagcctgcctctggtcggttcctggcgctctgcgtttcgtgaccttgtccagtagaaggctatttaattttcacaactgcttgaattttgacatacaagatgaagcaagatgcctcaagaaatgctgcctacactgtggattgtgaagattatgtgcatgtggtagaatttaatccctttgagaatggggattcaggaaacctaattgcatatggtggcaataattatgtggtcattggcacgtgtacgtttcaggaagaagaagcagacgttgaaggcattcagtataaaacacttcgaacatttcaccatggagtcagggttgatggcatagcttggagcccagagactagacttgattcattgcctccagtaatcaaattttgtacttcagctgctgatatgaaaattagattatttacttcagatcttcaggataaaaatgaatataaggttttagagggccataccgatttcattaatggtttggtgtttgatcccaaagaaggccaagaaattgcaagtgtgagtgacgatcacacctgcaggatttggaacttggaaggagtgcaaacagctcattttgttcttcattctcctggcatgagtgtgtgctggcatcctgaggagacttttaagctaatggttgcagagaagaatggaacaatccggttttatgatcttttggcccaacaggctattttatctcttgaatcagaacaagtgccattaatgtcagcacactggtgcttaaaaaacaccttcaaagttggagccgttgcaggaaatgattggttaatttgggatattactcggtccagttatcctcaaaataagagacctgttcacatggatcgagcctgcttattcaggtggtccacaattagtgaaaatctgtttgcaaccactggttatcctggcaaaatggcaagccagtttcaaattcatcatttaggacaccctcagcccatcctcatgggttctgtagccgttggatctggactgtcctggcatcgaactctccctctgtgtgtaattggaggagaccacaagctgttgttttgggtgactgaagtataaagtgttttctgtaccttagattcacaaactttgtatttttagtacatattttgaagaatttctatagtacatattttgaagaatttttatatcaaatataccgtatactttagaaaatgtctcagttgcttttattaaataaaatgttgatggtttgaaaaatta

SEQ ID NO: 20889 - DNA, 3874 bp, Homo sapiens
gttccgcgggaagaggcggtgctgagaggcgcgtactgtgcttgctttttgcagtacctgctgcggccgctttcggcatggaggaaatttatgcgaagtttgtgtcccagaaaatcagcaaaacccgctggcgaccgctgcctccgggaagtttacagaccgcggagacgttcgctacaggatcttgggacaatgaggaaaattatatttcactgtggtctattggagattttggaaacttggactctgatggagggtttgaaggagaccatcagttattgtgtgatatcagacaccatggtgatgtaatggatttacagttttttgaccaggaaagaattgtcgctgcttcatcaacaggatgtgtaacagttttccttcaccatccaaataaccagactctgtcagtcaaccagcagtggactacagctcactaccacacaggccctggcagtccttcctatagcagtgcaccatgtacaggtgttgtgtgcaacaacccagaaatcgttacagttggagaggatggtcgaataaatctcttcagagctgatcacaaggaagctgtaagaaccatagacaatgcagatagtagtacactccatgctgtaacctttcttcgaactcctgagattcttactgtaaattcaattggacagttgaaaatatgggatttcagacaacaaggaaatgagccttctcagatattgtcactgactggtgaccgagtgccactccactgtgttgatagacatcccaaccaacagcatgttgtagctactggtggccaagatggaatgttgagtatttgggatgttagacaaggtactatgcctgtatctctgctgaaggctcatgaagctgaaatgtgggaagttcactttcacccatccaacccagaacatctttttacctgctctgaagatggatccctctggcactgggatgcttccacagatgtacctgaaaagtcgtcactctttcaccaaggaggaagaagcagtacttttttgtctcatagcattagtaaccaagctaatgttcaccagtctgtcattagctcctggctcagcactgatcctgcaaaagaccgaattgaaatcacaagcttacttcccagtaggtctctgtctgtgaacactttggatgttttaggtccttgtcttgtttgtggaaccgatgcagaagcaatttatgttactagacatcttttttcgtagaagtactataattataagatttcagatagaacatgcaattagccttttgaaatccaacttctgtgcaaaattttagtatcagaaaatacgagatttgcaggggaaacatcagtaaactaccattaatgtcaatgcccagttttgacttttgttagcctgacactcccaaacagttgtagaatccgatagatgactgatggcaaaagattgtgaacatgtggaagaaaatcagtgggattctggtgctgatgaataggttgccttcagagtattattgacagacagcttgtggaactaattctttatttttgatgttgtgggaattaacacatcaatggtggttatgggaactaccaatgggttcctacaatttttatcagtagtatgtggcatatacaccttcctagtggcagttgccaatgttaatgattattctttttattgcaagtatttcctatgatccttccacactttatttccttaataataataaactttttcagaaagaattgagtagagcaaaaatgacaaagatgtgtagctgtgttcaatttttttttttttttttttttgaggcagagtcttgctctgctggagtgcggtggtgcaatctcggctcactgcaacctccacctcccaggttcaagcaattctcctgcctcagtctcctgagtagctggaactacaggtgtgcgccaccacgcccagctaatttttgtaattttagtagagacagagtttcaccatgttggccaggatggtctcgatctcttgacctcatgatccacccgcctcgacctcccaaagtgctgtgattacaggtgtgagccactgcacccggcctgaaatttttttaaggtgaaaatgttttgacaagttcctttttcagaataggtttttgagcagaactctttcagcttgttagacccaactttgcttttgtttagcttcacagcatagctgaaagttgccaaactggacattgtgcaataaagtagaattctatattgataagcaaactatttccaaactaaaaatgtgatagataaaagtgtgattaatcaaatgatatgatcagagtaaagaattttgccattttgatccttttactttgttttagccacctatagtgttaccaaccatctttatccttgtctgcagggataataatgaactaatgtagtgttttaagataatttaatgatactatctttccaaactttgttagattttaaatgtattattgacctgagaccttaatgacaaatcactgctattagacaattgaagtgttcatttactttgtaattccaataatcatagttatggaattatggtaaggttttgcttttctgtcctaataaatatatatattttttgagatggagttttgctcttgttgctgaggctggagtgaaatggcatgatctcagctcactgcaacctccgtctcttaggttcaagcaattctcctgcctcagcctcccgagtagctgggattacaggtgctcaccaccacacccagctaatttttgtatttttagtagagatggggtttcactgtgttggccaggctggtcttgaactgacctcatgatccacctgcctcagcctcccaaaatgctgggattacaggcttgagccactgctcccggctgatttttgtattagtagagacgacagggtttcaccatgttggccagggctggtctcgaactcctgaccacaggtaatcagcccgcctcggcctcccaaagtgctgggattacaggcgtgagccacttagtatttgtaaccataagagaaagtatattttaacagcattacatttcatgccaattgacaagttttgccaattttaataagaaactaagctttatgtaatgtaacaccgtaatttatgaatttgttcattgtcactgcctttattcatgaaactgtcaaatagagtgtctttcaagggttgcaggatcttagagatagaaagtaccttggtgatcatctccagcctaaatttcatcatcccttctatggtattcccaacaaattatcatccaacctatacttaaaaacatatggtggccaggcatggtggctcacgcctgtaatgctagcactttgggaggccgaggtgggtgaagcacctgaggtcaagagttcgagatcagcctggccaacatggcgaaaccccgtctccactaaaaatgcaaaaaaaaaattaaccgggcgtggtggcaggcatctataatcccagctacttgggaggctgaggcaggagaattgctcaaacccgggaggcagaggttgcagtgacccaagatcgtgccacttcactccagcctgggcaaaagagcaaaacgccatctcaaaaaatatacatatataaggagataaagtttcccattttccaatacagtttcacatttgaacagccctaattgatacaactttatggcagggttttagtgtgtgagtgggatccaaaacactcaatcctgtaaaagggtacagtcctattgtatgttaacacactgatgatgtgagcctgtgagatgagccaatcaccagttgttatgttcgaatctgctttgtgttgggacgctttaatgtcagggtttcactaaataaatgaattttcatatactgaactgaaa

SEQ ID NO: 20890 - DNA, 3836 bp, Homo sapiens
atgggtgggcctctcagtctaggtactgactgtgcccacactggctatcgacgagaattgactctctgcagccaccgtctccgtcctaaagtcccatccaatcagggttccgcgggaagaggcggtgctgagaggcgcgtactgtgcttgctttttgcagtacctgctgcggccgctttcggcatggaggaaatttatgcgaagtttgtgtcccagaaaatcagcaaaacccgctggcgaccgctgcctccgggaagtttacagaccgcggagacgttcgctacaggatcttgggacaatgaggaaaattatatttcactgtggtctattggagattttggaaacttggactctgatggagggtttgaaggagaccatcagttattgtgtgatatcagacaccatggtgatgtaatggatttacagttttttgaccaggaaagaattgtcgctgcttcatcaacaggatgtgtaacagttttccttcaccatccaaataaccagactctgtcagtcaaccagcagtggactacagctcactaccacacaggccctggcagtccttcctatagcagtgcaccatgtacaggtgttgtgtgcaacaacccagaaatcgttacagttggagaggatggtcgaataaatctcttcagagctgatcacaaggaagctgtaagaaccataggactggtgaccgagtgccactccactgtgttgatagacatcccaaccaacagcatgttgtagctactggtggccaagatggaatgttgagtatttgggatgttagacaaggtactatgcctgtatctctgctgaaggctcatgaagctgaaatgtgggaagttcactttcacccatccaacccagaacatctttttacctgctctgaagatggatccctctggcactgggatgcttccacagatgtacctgaaaagtcgtcactctttcaccaaggaggaagaagcagtacttttttgtctcatagcattagtaaccaagctaatgttcaccagtctgtcattagctcctggctcagcactgatcctgcaaaagaccgaattgaaatcacaagcttacttcccagtaggtctctgtctgtgaacactttggatgttttaggtccttgtcttgtttgtggaaccgatgcagaagcaatttatgttactagacatcttttttcgtagaagtactataattataagatttcagatagaacatgcaattagccttttgaaatccaacttctgtgcaaaattttagtatcagaaaatacgagatttgcaggggaaacatcagtaaactaccattaatgtcaatgcccagttttgacttttgttagcctgacactcccaaacagttgtagaatccgatagatgactgatggcaaaagattgtgaacatgtggaagaaaatcagtgggattctggtgctgatgaataggttgccttcagagtattattgacagacagcttgtggaactaattctttatttttgatgttgtgggaattaacacatcaatggtggttatgggaactaccaatgggttcctacaatttttatcagtagtatgtggcatatacaccttcctagtggcagttgccaatgttaatgattattctttttattgcaagtatttcctatgatccttccacactttatttccttaataataataaactttttcagaaagaattgagtagagcaaaaatgacaaagatgtgtagctgtgttcaatttttttttttttttttttttgaggcagagtcttgctctgctggagtgcggtggtgcaatctcggctcactgcaacctccacctcccaggttcaagcaattctcctgcctcagtctcctgagtagctggaactacaggtgtgcgccaccacgcccagctaatttttgtaattttagtagagacagagtttcaccatgttggccaggatggtctcgatctcttgacctcatgatccacccgcctcgacctcccaaagtgctgtgattacaggtgtgagccactgcacccggcctgaaatttttttaaggtgaaaatgttttgacaagttcctttttcagaataggtttttgagcagaactctttcagcttgttagacccaactttgcttttgtttagcttcacagcatagctgaaagttgccaaactggacattgtgcaataaagtagaattctatattgataagcaaactatttccaaactaaaaatgtgatagataaaagtgtgattaatcaaatgatatgatcagagtaaagaattttgccattttgatccttttactttgttttagccacctatagtgttaccaaccatctttatccttgtctgcagggataataatgaactaatgtagtgttttaagataatttaatgatactatctttccaaactttgttagattttaaatgtattattgacctgagaccttaatgacaaatcactgctattagacaattgaagtgttcatttactttgtaattccaataatcatagttatggaattatggtaaggttttgcttttctgtcctaataaatatatatattttttgagatggagttttgctcttgttgctgaggctggagtgaaatggcatgatctcagctcactgcaacctccgtctcttaggttcaagcaattctcctgcctcagcctcccgagtagctgggattacaggtgctcaccaccacacccagctaatttttgtatttttagtagagatggggtttcactgtgttggccaggctggtcttgaactgacctcatgatccacctgcctcagcctcccaaaatgctgggattacaggcttgagccactgctcccggctgatttttgtattagtagagacgacagggtttcaccatgttggccagggctggtctcgaactcctgaccacaggtaatcagcccgcctcggcctcccaaagtgctgggattacaggcgtgagccacttagtatttgtaaccataagagaaagtatattttaacagcattacatttcatgccaattgacaagttttgccaattttaataagaaactaagctttatgtaatgtaacaccgtaatttatgaatttgttcattgtcactgcctttattcatgaaactgtcaaatagagtgtctttcaagggttgcaggatcttagagatagaaagtaccttggtgatcatctccagcctaaatttcatcatcccttctatggtattcccaacaaattatcatccaacctatacttaaaaacatatggtggccaggcatggtggctcacgcctgtaatgctagcactttgggaggccgaggtgggtgaagcacctgaggtcaagagttcgagatcagcctggccaacatggcgaaaccccgtctccactaaaaatgcaaaaaaaaaattaaccgggcgtggtggcaggcatctataatcccagctacttgggaggctgaggcaggagaattgctcaaacccgggaggcagaggttgcagtgacccaagatcgtgccacttcactccagcctgggcaaaagagcaaaacgccatctcaaaaaatatacatatataaggagataaagtttcccattttccaatacagtttcacatttgaacagccctaattgatacaactttatggcagggttttagtgtgtgagtgggatccaaaacactcaatcctgtaaaagggtacagtcctattgtatgttaacacactgatgatgtgagcctgtgagatgagccaatcaccagttgttatgttcgaatctgctttgtgttgggacgctttaatgtcagggtttcactaaataaatgaattttcatatactg

SEQ ID NO: 20891 - DNA, 2186 bp, Homo sapiens
gcagtacctgctgcggccgctttcggcatggaggaaatttatgcgaagtttgtgtcccagaaaatcagcaaaacccgctggcgaccgctgcctccgggaagtttacagaccgcggagacgttcgctacaggatcttgggacaatgaggaaaattatatttcactgtggtctattggagattttggaaacttggactctgatggagggtttgaaggagaccatcagttattgtgtgatatcagacaccatggtgatgtaatggatttacagttttttgaccaggaaagaattgtcgctgcttcatcaacaggatgtgtaacagttttccttcaccatccaaataaccagactctgtcagtcaaccagcagtggactacagctcactaccacacaggccctggcagtccttcctatagcagtgcaccatgtacaggtgttgtgtgcaacaacccagaaatcgttacagttggagaggatggtcgaataaatctcttcagagctgatcacaaggaagctgtaagaaccatagacaatgcagatagtagtacactccatgctgtaacctttcttcgaactcctgagattcttactgtaaattcaattggacagttgaaaatatgggatttcagacaacaaggaaatgagccttctcagatattgtcactgactggtgaccgagtgccactccactgtgttgatagacatcccaaccaacagcatgttgtagctactggtggccaagatggaatgttgagtatttgggatgttagacaaggtactatgcctgtatctctgctgaaggctcatgaagctgaaatgtgggaagttcactttcacccatccaacccagaacatctttttacctgctctgaagatggatccctctggcactgggatgcttccacagatgtacctgaaaagtcgtcactctttcaccaaggaggaagaagcagtacttttttgtctcatagcattagtaaccaagctaatgttcaccagtctgtcattagctcctggctcagcactgatcctgcaaaagaccgaattgaaatcacaagcttacttcccagtaggtctctgtctgtgaacactttggatgttttaggtccttgtcttgtttgtggaaccgatgcagaagcaatttatgttactagacatcttttttcgtagaagtactataattataagatttcagatagaacatgcaattagccttttgaaatccaacttctgtgcaaaattttagtatcagaaaatacgagatttgcaggggaaacatcagtaaactaccattaatgtcaatgcccagttttgacttttgttagcctgacactcccaaacagttgtagaatccgatagatgactgatggcaaaagattgtgaacatgtggaagaaaatcagtgggattctggtgctgatgaataggttgccttcagagtattattgacagacagcttgtggaactaattctttatttttgatgttgtgggaattaacacatcaatggtggttatgggaactaccaatgggttcctacaatttttatcagtagtatgtggcatatacaccttcctagtggcagttgccaatgttaatgattattctttttattgcaagtatttcctatgatccttccacactttatttccttaataataataaactttttcagaaagaattgagtagagcaaaaatgacaaagatgtgtagctgtgttcaatttttttttttttttttttttgaggcagagtcttgctctgctggagtgcggtggtgcaatctcggctcactgcaacctccacctcccaggagaattgctcaaacccgggaggcagaggttgcagtgacccaagatcgtgccacttcactccagcctgggcaaaagagcaaaacgccatctcaaaaaatatacatatataaggagataaagtttcccattttccaatacagtttcacatttgaacagccctaattgatacaactttatggcagggttttagtgtgtgagtgggatccaaaacactcaatcctgtaaaagggtacagtcctattgtatgttaacacactgatgatgtgagcctgtgagatgagccaatcaccagttgttatgttcgaatctgctttgtgttgggacgctttaatgtcagggtttcactaaataaatgaattttcatatactgaactg

SEQ ID NO: 20892 - DNA, 5229 bp, Homo sapiens
agccccgcgccggtttccagggagctgggcgcatgcgccgcgtaaggggcccggccggcggaaggaggtgctactgccggaagcgccggcgcgcttgcgcagtagctgaacgcgggcgtttctttcctccctttttttcgaattggttttgggggtagattcgagttacaaaatggccgcccggagcgtgttcggcgcggttcccccagctgtctctggctgaaccggcgctctcgcctccctgccgaacacagcgtgaggagcccccccagggatatggtgtttgagtctctgggcttgccgagcactaagtcctctgagttccgcagcgcagcaccggaagcggccgagcgcgctcagcccggcgacccctgcgggctccagacccctgcgccgctgcgccccgggtttcgccgcaaccaagacccagcgagtgcagcggcggccgccgaggaggttcgaaaacatggccaaaagaaatgccgagaaggaactgacagataggaattgggatcaagaagatgaagctgaagaggtgggaacattctccatggccagtgaggaagtcttgaagaatagagccataaagaaagcaaagcgcagaaatgttggatttgaatctgacactggaggagcctttaaaggttttaaaggtttggtggtaccttctggaggaggacgcttttctggatttggtagtggcgctggagggaagcctttggaaggactgtcgaatggaaacaacataaccagtgcccctcccttcgccagtgcaaaggcagcggcagatcccaaggtagcctttggttctcttgctgcaaatggccctaccaccttggttgataaagtttcaaatcccaaaactaatggggacagtcagcagccctcctcctctggccttgcttccagtaaagcttgtgtcggaaatgcctatcacaagcagttggccgccttgaactgctccgtgcgggattggatagtgaagcacgtgaatacaaaccccctctgtgatctgacacctatctttaaagactatgagaaatatttagcaaacattgaacagcaacacgggaacagtggcaggaattctgaaagtgaatctaacaaagtggcagctgaaacacagtctccttccctttttggctcaacaaaattacagcaagagtcaacgtttttgtttcatggcaacaaaactgaagatacacctgacaagaagatggaggtggcatctgaaaagaaaacggacccatcatcactaggagcgacaagtgcctcatttaatttcggcaagaaagttgatagctctgttttgggctcattaagctctgtccccctgactggattttctttctcccctggaaactccagtttatttggcaaagatactacccagagtaaaccagtctcttcaccatttcccactaaaccattggagggccaagcagaaggtgacagtggtgaatgcaaaggtggagatgaagaagagaatgatgagccacccaaagtagtagttaccgaagtaaaagaagaagatgctttttactccaaaaagtgtaaactgttttacaagaaagacaatgagtttaaagagaaaggcataggtactctgcatttaaaacctacagcaaatcagaagacacagcttttggtgcgggcagacaccaatttaggcaacatattgctgaacgttctgattccacccaatatgccatgtacgcgaacagggaagaataacgttcttatcgtctgtgttccaaatccaccaattgacgagaagaatgccaccatgccagtcaccatgttgattcgggtaaaaaccagcgaggatgcagacgagttgcacaaaattttactggagaaaaaggatgcctgaacacgcaaagtcggctgcagaattattgccaagttgctgctgcttccaccgccccttaaagttagtcagtttttcttctcttctttgacattctaagaacttatagataacttaaaacttttgtgaggaagattaatgtggccaataaaacctttaaatgttaagtgtcaagaaactgcactctcccttcttaagaactgcctaaagtgtaaaatacatttgaatgcaatttttggaagattttttaatgttcgtttattaaactaaccctaagtgatttcttcaaggactgcaatcagggtatcaatttgctttcccaaaggctcttccaacccgtgggttttggggtccaccgccaccacgagagaggcttttgaacaggtgcctggctgtgttcagaaggaagctggcctgtgtgcttctctccggtgggctcagccgacgtgtgagacttgttctgttaccaaatgaaccgggctgccacgctgtgacaggcgtttgtcctctgctttatttttactttgaagctcaaatgcgagtactaagtgttcacctcagcgttcgaatcattggcctgtaaccctgtgggctgcttcacgagaattcaggacctgcattttcattctaaaaagaaatgaacagcttgtgaaggagttttttggcttcatagtttctattcatgaggtagtgttacttctttatccccctaaagacaaaatgaagataaagggggattgccaggaatgggtttaaaagcacaaatgtggtagcttatcatctacaccatggagagtgaacccttacgaaatgaaagtcaaatgagaccatccgagaaaaagatgcgcataggcatttgtaccatgatcaaccccacgcacatgaaaactgtgaccaagtgacgtgcctgggagctttgacacacgagccgtgtgaattcactaggaaacatgtaataaagtcatggaagagaaaatcgtgtgtaaactttgcctttaactttagaccgcagtatattataatacatttgatatctgaaatatctttacttttttaagagtaagattccatatgtctgtctggaagggagccatggttattcacacgaatatccctgtcacttctccagaggtgtcaggtaactaacacgagcattctttgaagactctgggcacatgaatgatacacagaattgaatgtttaaatttccactgagtcctcatgaatcatttgagactagtaccagctgatcttgtgtacaggctcagggtcagtgcccaagggctcccgcgtgtgtgttctgatcttcagtgcgtagcacattctccatttagaaaagagtggtcagaataattgtggacggtacagtggctttttaaaactacagtctttaggtgtaaggtttggcgccgggagcaattttatgatcaaatatgatgaactcctaagtcactgaggtgtgattgggccaatgttggcatgaggttcttgctctacttccagtgttttgattccactgggagaatttggcctagtgtgtggctttggatgaatccgtgtagagagaggtgagcttgtcctgttacagatgctgtcagacatagcgatagtaggcacctagggaggaagtggccgttagttttacactgactttttaagaatggagaatgcacgtgggtttctgttgcggatgattcatagtaagcaagcggttgatgctgttaataccggccccacccgattgacattaagtttattcagcttttaaaaagatgaagaactaaggggaacaaatttaagtttgttgcaacttagccacacatgcttccctggtaccagctggaatcagcagctcacaggcatcttcaggacacttcagtgtatatgacacagtactttgttagcgtctgcgtgtgtatggaaagttgacaaaaaatggcatgaaaagatcatgattggattttcttttaaacctgcccttctgtaaaaaatagtttatatatttttaaattagtaggtatgtgtggcttccttttttcctaacattcccagcaaatttttgctgctaagactatcactgttaaagtgaaaattacagggaaaaatgtgatgaatataccgtaactcaaaatgtgatattttcttaaaatcactcttttatgctttaggaactggttggtctccactttgattattagtgtaaagagcctgagtatacgtggatttcattgtaaaatttaactccttgtcttttacttggggcacggggcccctggagggcttccctactttccccactatgttaacaggtaattctgatttatgcgtttagtttgacttatttttaacaaaatattagaagttatgctttaaaatgtttaatgtggactgaaattttcatcttttgtttgagaatctatgaagtgtatcatatacgtggcctaaagcaaggtgtgtattttgttattctgaaattgttttgcatctggacaaatactaaatatcccagtggcctttttttttttttttttaaaacctgtgtatccatctcatccttttgcgcattcctagtaagcaaaaaaatttgttatgccatcttcattattcgaattacagactgaaaaaatatggccagtttttaaagaagtttagattatgttttccatggaaggacaagtctgactgttcataggctgattttctttaagaggattattctgttttacaatttcaattctagatcacattttatatatgctgcatgccaaaaaaaaaaaaaagagaaaactgccttttctggtgtggaggggaagaaaaactaatattctaccttactagtagagttcaaaacaagttttcactgagagccttttcagtaaaagttaaacaagtttgttttttgagcatttgtcagttattctatttcagaagagtcaaaattcaagcacgatacattttgaaggctttgcaaactcctaaacccctgatgagtcctctcattctggaagtgggaatttgagtagatactgatttgtcccgtagtatggcagatgacagggaggtcttttccaagcaggcactcagaacacaggtcaccgtatgttctcagccagtaacaatcatactgaggacgaaggactctccgtttgatgcagacacaattgtaatggagatgtaaaacttcttagcaatcagatggataaattgtttgctttttactttaaataggaaattgttttctaaaactaaaatacttgaattgtcagacaatataatctcagcttgtattagtttttgaatgctcccatcgaggaagtgtaacaatccatgaaatgtgaataaatgaaaagtaaacaaaa

SEQ ID NO: 20893 - DNA, 1895 bp, Homo sapiens
ggggtgggatgacagcggcgacgcagccccggctgtttttgaagcggggcccgggccccaccgggctgcggcgtccgactcgagtgagactctcccctgcggccccgccggaggttcgaaaacatggccaaaagaaatgccgagaaggaactgacagataggaattgggatcaagaagatgaagctgaagagggtaaaagaagggctataaactaaagccgaagatattcagcagctttctgacgtggacatcagaagtgtggacatgagtgtgctttgagcgcactgtggaagagcagtggttgtccagcaaggtcctaggtgcctccgtggcctttcgtacagtgggcaagttgggcaggactcatcttaaaaatcatgtgtgggaacattctccatggccagtgaggaagtcttgaagaatagagccataaagaaagcaaagcgcagaaatgttggatttgaatctgacactggaggagcctttaaaggttttaaaggtttggtggtaccttctggaggaggacgcttttctggatttggtagtggcgctggagggaagcctttggaaggactgtcgaatggaaacaacataaccagtgcccctcccttcgccagtgcaaaggcagcggcagatcccaaggtagcctttggttctcttgctgcaaatggccctaccaccttggttgataaagtttcaaatcccaaaactaatggggacagtcagcagccctcctcctctggccttgcttccagtaaagcttgtgtcggaaatgcctatcacaagcagttggccgccttgaactgctccgtgcgggattggatagtgaagcacgtgaatacaaaccccctctgtgatctgacacctatctttaaagactatgagaaatatttagcaaacattgaacagcaacacgggaacagtggcaggaattctgaaagtgaatctaacaaagtggcagctgaaacacagtctccttccctttttggctcaacaaaattacagcaagagtcaacgtttttgtttcatggcaacaaaactgaagatacacctgacaagaagatggaggtggcatctgaaaagaaaacggacccatcatcactaggagcgacaagtgcctcatttaatttcggcaagaaagttgatagctctgttttgggctcattaagctctgtccccctgactggattttctttctcccctggaaactccagtttatttggcaaagatactacccagagtaaaccagtctcttcaccatttcccactaaaccattggagggccaagcagaaggtgacagtggtgaatgcaaaggtggagatgaagaagagaatgatgagccacccaaagtagtagttaccgaagtaaaagaagaagatgctttttactccaaaaagtgtaaactgttttacaagaaagacaatgagtttaaagagaaaggcataggtactctgcatttaaaacctacagcaaatcagaagacacagcttttggtgcgggcagacaccaatttaggcaacatattgctgaacgttctgattccacccaatatgccatgtacgcgaacagggaagaataacgttcttatcgtctgtgttccaaatccaccaattgacgagaagaatgccaccatgccagtcaccatgttgattcgggtaaaaaccagcgaggatgcagacgagttgcacaaaattttactggagaaaaaggatgcctgaacacgcaaagtcggctgcagaattattgccaagttgctgctgcttccaccgccccttaaagttagtcagtttttcttctcttctttgacattctaagaacttatagataacttaaaacttttgtgaggaagattaatgtggccaataaaacctttaaatgttaagtgtcaagaaa

SEQ ID NO: 20894 - DNA, 2059 bp, Homo sapiens
gttttgggggtagattcgagttacaaaatggccgcccggagcgtgttcggcgcggttcccccagctgtctctggctgaaccggcgctctcgcctccctgccgaacacagcgtgaggagcccccccagggatatggtgtttgagtctctgggcttgccgagcactaagtcctctgagttccgcagcgcagcaccggaagcggccgagcgcgctcagcccggcgacccctgcgggctccagacccctgcgccgctgcgccccgggtttcgccgcaaccaagacccagcgagtgcagcggcggccgccgaggaggttcgaaaacatggccaaaagaaatgccgagaaggaactgacagataggaattgggatcaagaagatgaagctgaagagggtaaaagaagggctataaactaaagccgaagatattcagcagctttctgacgtggacatcagaagtgtggacatgagtgtgctttgagcgcactgtggaagagcagtggttgtccagcaaggtcctaggtgcctccgtggcctttcgtacagtgggtgggaacattctccatggccagtgaggaagtcttgaagaatagagccataaagaaagcaaagcgcagaaatgttggatttgaatctgacactggaggagcctttaaaggttttaaaggtttggtggtaccttctggaggaggacgcttttctggatttggtagtggcgctggagggaagcctttggaaggactgtcgaatggaaacaacataaccagtgcccctcccttcgccagtgcaaaggcagcggcagatcccaaggtagcctttggttctcttgctgcaaatggccctaccaccttggttgataaagtttcaaatcccaaaactaatggggacagtcagcagccctcctcctctggccttgcttccagtaaagcttgtgtcggaaatgcctatcacaagcagttggccgccttgaactgctccgtgcgggattggatagtgaagcacgtgaatacaaaccccctctgtgatctgacacctatctttaaagactatgagaaatatttagcaaacattgaacagcaacacgggaacagtggcaggaattctgaaagtgaatctaacaaagtggcagctgaaacacagtctccttccctttttggctcaacaaaattacagcaagagtcaacgtttttgtttcatggcaacaaaactgaagatacacctgacaagaagatggaggtggcatctgaaaagaaaacggacccatcatcactaggagcgacaagtgcctcatttaatttcggcaagaaagttgatagctctgttttgggctcattaagctctgtccccctgactggattttctttctcccctggaaactccagtttatttggcaaagatactacccagagtaaaccagtctcttcaccatttcccactaaaccattggagggccaagcagaaggtgacagtggtgaatgcaaaggtggagatgaagaagagaatgatgagccacccaaagtagtagttaccgaagtaaaagaagaagatgctttttactccaaaaagtgtaaactgttttacaagaaagacaatgagtttaaagagaaaggcataggtactctgcatttaaaacctacagcaaatcagaagacacagcttttggtgcgggcagacaccaatttaggcaacatattgctgaacgttctgattccacccaatatgccatgtacgcgaacagggaagaataacgttcttatcgtctgtgttccaaatccaccaattgacgagaagaatgccaccatgccagtcaccatgttgattcgggtaaaaaccagcgaggatgcagacgagttgcacaaaattttactggagaaaaaggatgcctgaacacgcaaagtcggctgcagaattattgccaagttgctgctgcttccaccgccccttaaagttagtcagtttttcttctcttctttgacattctaagaacttatagataacttaaaacttttgtgaggaagattaatgtggccaataaaacctttaaatgttaagtgtcaagaaa

SEQ ID NO: 20895 - DNA, 584 bp, Homo sapiens
agattcgagttacaaaatggccgcccggagcgtgttcggcgcggttcccccagctgtctctggctgaaccggcgctctcgcctccctgccgaacacagcgtgaggagcccccccagggatatggtgtttgagtctctgggcttgccgagcactaagtcctctgagttccgcagcgcagcaccggaagcggccgagcgcgctcagcccggcgacccctgcgggctccagacccctgcgccgctgcgccccgggtttcgccgcaaccaagacccagcgagtgcagcggcggccgccgaggaggttcgaaaacatggccaaaagaaatgccgagaaggaactgacagataggaattgggatcaagaagatgaagctgaagagggtaaaagaagggctataaactaaagccgaagatattcagcagctttctgacgtggacatcagaagtgtggacatgagtgtgctttgagcgcactgtggaagagcagtggttgtccagcaaggtcctaggtgcctccgtggcctttcgtacagtgggcaagttgggtgggaacattctccatggccagtgaggaagtcttgaaga

SEQ ID NO: 20896 - DNA, 543 bp, Homo sapiens
cgaaaacatggccaaaagaaatgccgagaaggaactgacagataggaattgggatcaagaagatgaagctgaagaggtgggaacattctccatggccagtgaggaagtcttgaagaatagagccataaagaaagcaaagcgcagaaatgttggatttgaatctgacactggaggagcctttaaaggttttaaaggtttggtggtaccttctggaggaggacgcttttctggatttggtagtggcgctggagggaagcctttggaaggactgtcgaatggaaacaacataaccagtgcccctcccttcgccagtgcaaaggcagcggcagatcccaaggtagcctttggtggagatgaagaagagaatgatgagccacccaaagtagtagttaccgaagtaaaagaagaagatgctttttactccaaaaagtgtaaactgttttacaagaaagacaatgagtttaaagagaaaggcataggtactctgcatttaaaacctacagcaaatcagaagacacagcttttggtgcgggcagacaccaa

SEQ ID NO: 20897 - DNA, 579 bp, Homo sapiens
ttttgggggtagattcgagttacaaaatggccgcccggagcgtgttcggcgcggttcccccagctgtctctggctgaaccggcgctctcgcctccctgccgaacacagcgtgaggagcccccccagggatatggtgtttgagtctctgggcttgccgagcactaagtcctctgagttccgcagcgcagcaccggaagcggccgagcgcgctcagcccggcgacccctgcgggctccagacccctgcgccgctgcgccccgggtttcgccgcaaccaagacccagcgagtgcagcggcggccgccgaggagatggagtcttgctctgtcacataggctggagtgcattggcgcgatctcagctcactgcaacctccacctcctgggttcaagagattctcctgcctcagcctccggagtagctgggattacaggttcgaaaacatggccaaaagaaatgccgagaaggaactgacagataggaattgggatcaagaagatgaagctgaagaggtgggaacattctccatggccagtgaggaagtcttgaagaatagagccataaagaaagcaaagcgcag

SEQ ID NO: 20898 - DNA, 2030 bp, Homo sapiens
attcgagttacaaaatggccgcccggagcgtgttcggcgcggttcccccagctgtctctggctgaaccggcgctctcgcctccctgccgaacacagcgtgaggagcccccccagggatatggtgtttgagtctctgggcttgccgagcactaagtcctctgagttccgcagcgcagcaccggaagcggccgagcgcgctcagcccggcgacccctgcgggctccagacccctgcgccgctgcgccccgggtttcgccgcaaccaagacccagcgagtgcagcggcggccgccgaggaggttcgaaaacatggccaaaagaaatgccgagaaggaactgacagataggaattgggatcaagaagatgaagctgaagaggtgggaacattctccatggccagtgaggaagtcttgaagaatagagccataaagaaagcaaagcgcagaaatgttggatttgaagttctcttgctgcaaatggccctaccaccttggttgataaagtttcaaatcccaaaactaatggggacagtcagcagccctcctcctctggccttgcttccagtaaagcttgtgtcggaaatgcctatcacaagcagttggccgccttgaactgctccgtgcgggattggatagtgaagcacgtgaatacaaaccccctctgtgatctgacacctatctttaaagactatgagaaatatttagcaaacattgaacagcaacacgggaacagtggcaggaattctgaaagtgaatctaacaaagtggcagctgaaacacagtctccttccctttttggctcaacaaaattacagcaagagtcaacgtttttgtttcatggcaacaaaactgaagatacacctgacaagaagatggaggtggcatctgaaaagaaaacggacccatcatcactaggagcgacaagtgcctcatttaatttcggcaagaaagttgatagctctgttttgggctcattaagctctgtccccctgactggattttctttctcccctggaaactccagtttatttggcaaagatactacccagagtaaaccagtctcttcaccatttcccactaaaccattggagggccaagcagaaggtgacagtggtgaatgcaaaggtggagatgaagaagagaatgatgagccacccaaagtagtagttaccgaagtaaaagaagaagatgctttttactccaaaaagtgtaaactgttttacaagaaagacaatgagtttaaagagaaaggcataggtactctgcatttaaaacctacagcaaatcagaagacacagcttttggtgcgggcagacaccaatttaggcaacatattgctgaacgttctgattccacccaatatgccatgtacgcgaacagggaagaataacgttcttatcgtctgtgttccaaatccaccaattgacgagaagaatgccaccatgccagtcaccatgttgattcgggtaaaaaccagcgaggatgcagacgagttgcacaaaattttactggagaaaaaggatgcctgaacacgcaaagtcggctgcagaattattgccaagttgctgctgcttccaccgccccttaaagttagtcagtttttcttctcttctttgacattctaagaacttatagataacttaaaacttttgtgaggaagattaatgtggccaataaaacctttaaatgttaagtgtcaagaaactgcactctcccttcttaagaactgcctaaagtgtaaaatacatttgaatgcaatttttggaagattttttaatgttcgtttattaaactaaccctaagtgatttcttcaaggactgcaatcagggtatcaatttgctttcccaaaggctcttccaacccgtgggttttggggtccaccgccaccacgagagaggcttttgaacaggtgcctggctgtgttcagaaggaagctggcctgtgtgcttctctccggtgggctcagccgacgtgtgagacttgttctgttaccaaatgaaccgggctgccacgctgtgacaggcgtttgt

SEQ ID NO: 20899 - DNA, 537 bp, Homo sapiens
ttcgagttacaaaatggccgcccggagcgtgttcggcgcggttcccccagctgtctctggctgaaccggcgctctcgcctccctgccgaacacagcgtgaggagcccccccagggatatggtgtttgagtctctgggcttgccgagcactaagtcctctgagttccgcagcgcagcaccggaagcggccgagcgcgctcagcccggcgacccctgcgggctccagacccctgcgccgctgcgccccgggtttcgccgcaaccaagacccagcgagtgcagcggcggccgccgaggaggttcgaaaacatggccaaaagaaatgccgagaaggaactgacagataggaattgggatcaagaagatgaagctgaagaggtgggaacattctccatggccagtgaggaagtcttgaagaatagagccataaagaaagcaaagcgcagaaatgttggatttgaagttctcttgctgcaaatggccctaccaccttggttgataaagtttcaaatcccaaaactaatggggacagtcagcag

SEQ ID NO: 20900 - DNA, 551 bp, Homo sapiens
gtttttgaagcggggcccgggccccaccgggctgcggcgtccgactcgagtgagactctcccctgcggccccgccggaggtagggggctggcagggctgtcctggcgtggtcttctccgtttccttcctagcgattcctctcgagcttcctctccccctggccgcccctcgtctctcttctcttgggcgcattacctctctggcctgtcttactgcgttcccgggttattcatcacccatttgctcggttccattaagaaccagcttggagattagatgaagaaactgaggcacaaaaattaaatataacttgcccaagttctcacagctagaaaatggcaaaactgggatgccagcatcttttagtattttttgaaatactttatgctcactggggaaatacttccccagctcactgatctaatgacagacaggacacctgctgtttgagctgggcactgttggggcatttggagtatatctgtaaacaaaacaaagatccctgcgttttggttatatactgatttggttcgaaaacatggccaaaagaa

SEQ ID NO: 20901 - DNA, 443 bp, Homo sapiens
gggcggggcgcgcggtgggggagcgacgggtggagggtggggtgggatgacagcggcgacgcagccccggctgtttttgaagcggggcccgggccccaccgggctgcggcgtccgactcgagtgagactctcccctgcggccccgccggagatgaagaaactgaggcacaaaaattaaatataacttgcccaagttctcacagctagaaaatggcaaaactgggatgccagcatcttttagtattttttgaaatactttatgctcactggggaaatacttccccagctcactgatctaatgacagacaggacacctgctgtttgagctgggcactgttggggcatttggagtatatctgtaaacaaaacaaagatccctgcgttttggttatatactgatttggttcgaaaacatggccaaaagaaatgccgagaaggaactg

SEQ ID NO: 20902 - DNA, 2367 bp, Homo sapiens
cttggcgccttccggcctcttaggctaggtcagaaaggaggcggaactcggtgatctgactggcggtttcccggccggactgagaaggggagcgcgctgcgcgtcgcaggagtaacctacttggtctcctgctttcgcgacatggccttcaattttggggctccctcgggcacctccggtaccgctgcagccaccgcggcccccgcgggtgggtttggaggatttgggacaacatctacaactgcaggttctgcattcagcttttctgccccaactaacacaggcactactggactctttggtggtactcagaacaaaggttttggatttggtactggttttggcacaacaacgggaactagtactggtttaggtactggtttgggaactggactgggatttggaggatttaatacacagcagcagcagcaaactacattaggtggtctcttcagtcagcctacacaagctcctacccagtccaaccagctgataaatactgcgagtgctctttctgctccaacgctgttgggagatgagagagatgctattttggcaaaatggaatcaactgcaggccttttggggaacaggaaaagggtatttcaacaataatattccgccagtggaattcacacaagaaaatcccttttgccgatttaaggcagtaggttatagttgcatgcccagtaataaagatgaagatgggctagtggttttagttttcaacaaaaaagaaacagagattcgaagccaacaacaacagttggtagaatcattgcataaagttttgggaggaaaccagacccttactgtaaatgtagagggcactaaaacattgccagatgatcagacagaagttgttatttatgttgttgagcgttcgccaaatggtacttcaagaagagttccagctacaacgctatatgcccattttgaacaagccaatataaaaacacaattgcagcaacttggtgtaaccctttctatgactagaacagaactttctcctgcacagatcaaacagcttttacagaatcctcctgctggtgttgatcctattatctgggaacaggccaaggtagataaccctgattctgaaaagttaattcctgtaccaatggtgggttttaaggaacttctccgaagactgaaggttcaagatcagatgactaagcagcatcaaaccagattagatatcatatctgaagatattagtgagctacaaaagaatcaaactacatctgtagccaaaattgcacaatacaagaggaaactcatggatctttcccatagaactttacaggtcctaatcaaacaggaaattcaaaggaagagtggttatgccattcaggctgatgaagagcagttgcgagttcagctggatacgattcagggtgaactaaatgcacctactcagttcaagggccgactaaatgaattgatgtctcaaatcaggatgcagaatcattttggagcagtcagatctgaagaaaggtattacatagatgcagatctgttacgagaaatcaagcagcatttgaaacaacaacaggaaggccttagccatttgattagcatcattaaagacgatctagaagatataaagctggtcgaacatggattgaatgaaaccatccacatcagaggtggtgtctttagttgacagttcacaaacttgtgtaaaggtttgtgaaatgcatcttcttactgcatcagaccttccttaagaatgaaaccgaccacatggagggaaaaagaaaacaattctttcttggattggttttttgagaagtttactgacaaattactgttcatcaaatctgaaatagtcacctcacagctcttcaaagaaaacctttgaaagatttatatctaaaagctgtatttactttaaaagaagtgcataattaccaaaattgtatgtactattgtacatttttacaacagcattttcttaaacataatctgtgtttaatgattattgtccattgagcctgtactctgctttccataccaagtaaatatgaaataatctactttgcacataacagaacaaactataattacttggctgttggagatttgtacttgagtataaatgtacaccagtttttgtatttgtgaactcatctgtgggaggagtaaagaaaatccaaaagcatttaatgttttgtttttgttctataaagatatgaaaatgtatttttatattattttacttatttggaatttacagagcacacctaagcaattaggatataacaaaactacttaaccatttttgcaaccattttgttttttaagcctttttatttctaaaaagatgaaaacttataaataaattcttaatttgtaattactttta

SEQ ID NO: 20903 - DNA, 2142 bp, Homo sapiens
ctacttggtctcctgctttcgcgacatggccttcaattttggggctccctcgggcacctccggtaccgctgcagccaccgcggcccccgcgggtgggtttggaggatttgggacaacatctacaactgcaggttctgcattcagcttttctgccccaactaacacaggcactactggactctttggtggtactcagaacaaaggttttggatttggtactggttttggcacaacaacgggaactagtactggtttaggtactggtttgggaactggactgggatttggaggatttaatacacagcagcagcagcaaactacattaggtggtctcttcagtcagcctacacaagctcctacccagtccaaccagctgataaatactgcgagtgctctttctgctccaacgctgttgggagatgagagagatgctattttggcaaaatggaatcaactgcaggccttttggggaacaggaaaagggtatttcaacaataatattccgccagtggaattcacacaagaaaatcccttttgccgatttaaggcagtaggttatagttgcatgcccagtaataaagatgaagatgggctagtggttttagttttcaacaaaaaagaaacagagattcgaagccaacaacaacagttggtagaatcattgcataaagttttgggaggaaaccagacccttactgtaaatgtagagggcactaaaacattgccagatgatcagacagaagttgttatttatgttgttgagcgttcgccaaatggtacttcaagaagagttccagctacaacgctatatgcccattttgaacaagccaatataaaaacacaattgcagcaacttggtgtaaccctttctatgactagaacagaactttctcctgcacagatcaaacagcttttacagaatcctcctgctggtgttgatcctattatctgggaacaggccaaggtagataaccctgattctgaaaagttaattcctgtaccaatggtgggttttaaggaacttctccgaagactgaaggttcaagatcagatgactaagcagcatcaaaccagattagatgtcctaatcaaacaggaaattcaaaggaagagtggttatgccattcaggctgatgaagagcagttgcgagttcagctggatacgattcagggtgaactaaatgcacctactcagttcaagggccgactaaatgaattgatgtctcaaatcaggatgcagaatcattttggagcagtcagatctgaagaaaggtattacatagatgcagatctgttacgagaaatcaagcagcatttgaaacaacaacaggaaggccttagccatttgattagcatcattaaagacgatctagaagatataaagctggtcgaacatggattgaatgaaaccatccacatcagaggtggtgtctttagttgacagttcacaaacttgtgtaaaggtttgtgaaatgcatcttcttactgcatcagaccttccttaagaatgaaaccgaccacatggagggaaaaagaaaacaattctttcttggattggttttttgagaagtttactgacaaattactgttcatcaaatctgaaatagtcacctcacagctcttcaaagaaaacctttgaaagatttatatctaaaagctgtatttactttaaaagaagtgcataattaccaaaattgtatgtactattgtacatttttacaacagcattttcttaaacataatctgtgtttaatgattattgtccattgagcctgtactctgctttccataccaagtaaatatgaaataatctactttgcacataacagaacaaactataattacttggctgttggagatttgtacttgagtataaatgtacaccagtttttgtatttgtgaactcatctgtgggaggagtaaagaaaatccaaaagcatttaatgttttgtttttgttctataaagatatgaaaatgtatttttatattattttacttatttggaatttacagagcacacctaagcaattaggatataacaaaactacttaaccatttttgcaaccattttgttttttaagcctttttatttctaaaaagatgaaaacttataaataaattcttaatttgtaattactttt

SEQ ID NO: 20904 - DNA, 1385 bp, Homo sapiens
acttggtctcctgctttcgcgacatggccttcaattttggggctccctcgggcacctccggtaccgctgcagccaccgcggcccccgcgggtgggtttggaggatttgggacaacatctacaactgcaggttctgcattcagcttttctgccccaactaacacaggcactactggactctttggtggtactcagaacaaaggttttggatttggtactggttttggcacaacaacgggaactagtactggtttaggtactggtttgggaactggactgggatttggaggatttaatacacagcagcagcagcaaactagcagtaggttatagttgcatgcccagtaataaagatgaagatgggctagtggttttagttttcaacaaaaaagaaacagagattcgaagccaacaacaacagttggtagaatcattgcataaagttttgggaggaaaccagacccttactgtaaatgtagagggcactaaaacattgccagatgatcagacagaagttgttatttatgttgttgagcgttcgccaaatggtacttcaagaagagttccagctacaacgctatatgcccattttgaacaagccaatataaaaacacaattgcagcaacttggtgtaaccctttctatgactagaacagaactttctcctgcacagatcaaacagcttttacagaatcctcctgctggtgttgatcctattatctgggaacaggccaaggtagataaccctgattctgaaaagttaattcctgtaccaatggtgggttttaaggaacttctccgaagactgaaggttcaagatcagatgactaagcagcatcaaaccagattagatatcatatctgaagatattagtgagctacaaaagaatcaaactacatctgtagccaaaattgcacaatacaagaggaaactcatggatctttcccatagaactttacaggtcctaatcaaacaggaaattcaaaggaagagtggttatgccattcaggctgatgaagagcagttgcgagttcagctggatacgattcagggtgaactaaatgcacctactcagttcaagggccgactaaatgaattgatgtctcaaatcaggatgcagaatcattttggagcagtcagatctgaagaaaggtattacatagatgcagatctgttacgagaaatcaagcagcatttgaaacaacaacaggaaggccttagccatttgattagcatcattaaagacgatctagaagatataaagctggtcgaacatggattgaatgaaaccatccacatcagaggtggtgtctttagttgacagttcacaaacttgtgtaaaggtttgtgaaatgcatcttcttactgcatcagaccttccttaag

SEQ ID NO: 20905 - DNA, 1563 bp, Homo sapiens
acttggtctcctgctttcgcgacatggccttcaattttggggctccctcgggcacctccggtaccgctgcagccaccgcggcccccgcgggtgggtttggaggatttgggacaacatctacaactgcaggttctgcattcagcttttctgccccaactaacacaggcactactgcattaggtggtctcttcagtcagcctacacaagctcctacccagtccaaccagctgataaatactgcgagtgctctttctgctccaacgctgttgggagatgagagagatgctattttggcaaaatggaatcaactgcaggccttttggggaacaggaaaagggtatttcaacaataatattccgccagtggaattcacacaagaaaatcccttttgccgatttaaggcagtaggttatagttgcatgcccagtaataaagatgaagatgggctagtggttttagttttcaacaaaaaagaaacagagattcgaagccaacaacaacagttggtagaatcattgcataaagttttgggaggaaaccagacccttactgtaaatgtagagggcactaaaacattgccagatgatcagacagaagttgttatttatgttgttgagcgttcgccaaatggtacttcaagaagagttccagctacaacgctatatgcccattttgaacaagccaatataaaaacacaattgcagcaacttggtgtaaccctttctatgactagaacagaactttctcctgcacagatcaaacagcttttacagaatcctcctgctggtgttgatcctattatctgggaacaggccaaggtagataaccctgattctgaaaagttaattcctgtaccaatggtgggttttaaggaacttctccgaagactgaaggttcaagatcagatgactaagcagcatcaaaccagattagatatcatatctgaagatattagtgagctacaaaagaatcaaactacatctgtagccaaaattgcacaatacaagaggaaactcatggatctttcccatagaactttacaggtcctaatcaaacaggaaattcaaaggaagagtggttatgccattcaggctgatgaagagcagttgcgagttcagctggatacgattcagggtgaactaaatgcacctactcagttcaagggccgactaaatgaattgatgtctcaaatcaggatgcagaatcattttggagcagtcagatctgaagaaaggtattacatagatgcagatctgttacgagaaatcaagcagcatttgaaacaacaacaggaaggccttagccatttgattagcatcattaaagacgatctagaagatataaagctggtcgaacatggattgaatgaaaccatccacatcagaggtggtgtctttagttgacagttcacaaacttgtgtaaaggtttgtgaaatgcatcttcttactgcatcagaccttccttaagaatgaaaccgaccacatggagggaaaaagaaaacaattctttcttggattggttttttgagaagtttactgacaaattactgttcatcaaatctg

SEQ ID NO: 20906 - DNA, 1961 bp, Homo sapiens
cgctcccggcctcagcatattttattaataggaactctggggcccagtctcatttcttccttaccacttgtaagagccgcagacgttggactgtccaacacctgctgtcattcttctgtctccctcatccctctaaagtgtctgtttccagctatcctcatcttccattccaaatgatgggtgcccaggccccatcccctggcagggattcagacatcgaggccccagctgcgtccttttctccatcccttgcccttggcttcctttcaaaccgtccttcagcttccactggataggaactatctcccaaccctgccaaaaatggaagatctccgttttcgtttagtcacagggtagccatcttgccccttctcatgcactgggccctcctccaccagccgaggtggatgtccgtcttttctctgttgcagaaacccaccttgtcccatccacatcaggacatcccagctggagttcaaccttcatcccttctgtggcagttaggagactgaatcaaggtccagagaaggtggaggaatcctgatactgagcgaaatcttcccaaggctgcagacaccgacggatttgctttgggagccagagtagctgccgccaccagagtccggagccatgagcgggtttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttttggaacagcgactcttgcttcggggggaactggattttctttggggatcggtgcttcaaagctcaacttgagcaacacagctgccaccccagccatggcaaaccccagcggctttgggctgggcagcagcaacctcactaatgccatatcgagcaccgtcacctccagccagggcacagcacccaccggctttgtgtttggcccctccaccacctctgtggctccagctaccacatctggaggcttctcattcactggtggaagcacggcccaaccctccggtttcaacattggctcagcagggaattcagcccagcccacggcacctgccacgttgcccttcactccagcctaggcaacagagactctgtctcaaaaaaaaaaaaaaaaaaaaagaaactcccaggagacagcagcctagttttcgagtgtgagcttgtgcttgtgaaagctaaccatgctaaccaccaaggcaaagcagcacagtgtgaatagaacagagcgggatcaagaatttcacagaagacaggtcagctgaggggcctgcacacacagggtgttgaggaaccacagatgggcgccgagaggcctgccttttgcctggcccaggctcacccccaccttgggcctcacctcctccaggaagccttcccagctacccgaagctcaggtggccttcttgcaggtccccgtagcaccctgagcctgtaccttgggtggcacttgttatgctatcctgtgctagccgtttgtgcctcgtctcgctgttagattgtgagttcccatgggcagagacccactgtcgttccccgtgtgtccccagcccggtccctgtcacatttgttaaatgaaagaacaatgaagcccagtgtaacgtcagtccacagaaatagccacagcttccagtggtggccgtagacttggctcggaacttagtggcaccagagtaactctagtcagttacagtaaaatccactgtgtgtggaaggcagaagctagcggttgtatcccaagcatcttttgtatttgtctttatactttgctgaattctctgaaatacctattactgtatgttgcttttctaaataaatgtattgtgaaacc

SEQ ID NO: 20907 - DNA, 3415 bp, Homo sapiens
actacttctgcgcctgcgcgaccgtgattccccgctcgcgactccccaccccccagggctccctaaagagggccacgagctgcgaaagggcgggaaaggcagttggagaagaggtaagcggttactcactccatggctgcagcaaggagaggcggcggcggcctcggctgaagaaagaaggtgggagcggagagcgcaggcgtgccgaggtggatgtccgtcttttctctgttgcagaaacccaccttgtcccatccacatcaggacatcccagctggagttcaaccttcatcccttctgtggcagttaggagactgaatcaaggtccagagaaggtggaggaatcctgatactgagcgaaatcttcccaaggctgcagacaccgacggatttgctttgggagccagagtagctgccgccaccagagtccggagccatgagcgggtttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttttggaacagcgactcttgcttcggggggaactggattttctttggggatcggtgcttcaaagctcaacttgagcaacacagctgccaccccagccatggcaaaccccagcggctttgggctgggcagcagcaacctcactaatgccatatcgagcaccgtcacctccagccagggcacagcacccaccggctttgtgtttggcccctccaccacctctgtggctccagctaccacatctggaggcttctcattcactggtggaagcacggcccaaccctccggtttcaacattggctcagcagggaattcagcccagcccacggcacctgccacgttgcccttcactccggccacgccagcagccaccacagcaggtgccacacagccagctgctcccacacccacagccaccatcaccagcactgggcccagcctctttgcgtcaatagcaactgctccaacctcatctgccaccactggactctccctctgtacccctgtgaccacagcgggcgcccccactgctgggacacagggcttcagcttaaaggcacctggagcagcttccggcacctccacaacaacatccaccgctgccaccgccaccgccaccaccaccagcagcagcagcaccaccggctttgccttgaatttaaaaccactggcgccagccgggatccccagcaatacagcagctgccgtgaccgctccacctggccctggcgcagctgcaggggcggctgccagctccgccatgacctacgcgcagctggagagcctgatcaacaaatggagcctggagctagaggaccaggagcggcacttcctccagcaggccacccaggtcaacgcctgggaccgcacgctgatcgagaatggagaaaagatcaccagcctgcaccgcgaggtggagaaggtgaagctggaccagaagaggctggaccaggagctcgacttcatcctgtcccagcagaaggagctggaagacctgctgagcccactggaggagttggtcaaggagcagagcgggaccatctacctgcagcacgcggatgaggagcgtgagaaaacctacaagctggctgagaacatcgatgcacagctcaagcgcatggcccaggatctcaaggacatcatcgagcacctgaacacgtccggggcccccgccgacaccagtgacccactgcagcagatctgcaagatcctcaatgcgcacatggactcactgcagtggatcgaccagaactcggccctgctgcagaggaaggtggaggaggtgaccaaggtgtgcgagggccggcgcaaggagcaggagcgcagcttccggatcacctttgactgagcgacagcagccctggggcccgcaggtccctagggagttcatgaggggaatgcgccctgttgtctgtagtttggggttgtggcaagatacttgtttgtttgtttctttctttcacatgactgcccttgacatgatcgctgtgtgctttgcgtttttccatttaggagggtattctgggccttctgcccaggcagcagcctcatgggtgtggcttctgtggctttcatttgagtatctttggccccttttcacctactgcgaccacccacctcatcctggctcagcctggtgatggagaagtgctgatggtcttggtcccagccagggtcgtgggggcagccactctctccaaagcatagtcataggtgtcatgaaaaaataccaaatgtaagagaacctccaagtcagggcgcagtggctcacccctgtaatctcagcactttgggtggccaaggcgggcagatgacttgaggtcaggagttcgagaccagcctggccaacatggtgaaaccccgtctctactaaaaatacaaaaattagtcaggtgtggtggacgcctgtgatctcaatctcagctactcgggaggctgaggcaggagaatcacttgaacccaggaggtgttgcagtgaaccaagatcacaccactgcactccagcctaggcaacagagactctgtctcaaaaaaaaaaaaaaaaaaaaagaaactcccaggagacagcagcctagttttcgagtgtgagcttgtgcttgtgaaagctaaccatgctaaccaccaaggcaaagcagcacagtgtgaatagaacagagcgggatcaagaatttcacagaagacaggtcagctgaggggcctgcacacacagggtgttgaggaaccacagatgggcgccgagaggcctgccttttgcctggcccaggctcacccccaccttgggcctcacctcctccaggaagccttcccagctacccgaagctcaggtggccttcttgcaggtccccgtagcaccctgagcctgtaccttgggtggcacttgttatgctatcctgtgctagccgtttgtgcctcgtctcgctgttagattgtgagttcccatgggcagagacccactgtcgttccccgtgtgtccccagcccggtccctgtcacatttgttaaatgaaagaacaatgaagcccagtgtaacgtcagtccacagaaatagccacagcttccagtggtggccgtagacttggctcggaacttagtggcaccagagtaactctagtcagttacagtaaaatccactgtgtgtggaaggcagaagctagcggttgtatcccaagcatcttttgtatttgtctttatactttgctgaattctctgaaatacctattactgtatgttgcttttctaaataaatgtattgtgaaacc

SEQ ID NO: 20908 - DNA, 3236 bp, Homo sapiens
actacttctgcgcctgcgcgaccgtgattccccgctcgcgactccccaccccccagggctccctaaagagggccacgagctgcgaaagggcgggaaaggcagttggagaagaggtaagcggttactcactccatggctgcagcaaggagaggcggcggcggcctcggctgaagaaagaagaaatcttcccaaggctgcagacaccgacggatttgctttgggagccagagtagctgccgccaccagagtccggagccatgagcgggtttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttttggaacagcgactcttgcttcggggggaactggattttctttggggatcggtgcttcaaagctcaacttgagcaacacagctgccaccccagccatggcaaaccccagcggctttgggctgggcagcagcaacctcactaatgccatatcgagcaccgtcacctccagccagggcacagcacccaccggctttgtgtttggcccctccaccacctctgtggctccagctaccacatctggaggcttctcattcactggtggaagcacggcccaaccctccggtttcaacattggctcagcagggaattcagcccagcccacggcacctgccacgttgcccttcactccggccacgccagcagccaccacagcaggtgccacacagccagctgctcccacacccacagccaccatcaccagcactgggcccagcctctttgcgtcaatagcaactgctccaacctcatctgccaccactggactctccctctgtacccctgtgaccacagcgggcgcccccactgctgggacacagggcttcagcttaaaggcacctggagcagcttccggcacctccacaacaacatccaccgctgccaccgccaccgccaccaccaccagcagcagcagcaccaccggctttgccttgaatttaaaaccactggcgccagccgggatccccagcaatacagcagctgccgtgaccgctccacctggccctggcgcagctgcaggggcggctgccagctccgccatgacctacgcgcagctggagagcctgatcaacaaatggagcctggagctagaggaccaggagcggcacttcctccagcaggccacccaggtcaacgcctgggaccgcacgctgatcgagaatggagaaaagatcaccagcctgcaccgcgaggtggagaaggtgaagctggaccagaagaggctggaccaggagctcgacttcatcctgtcccagcagaaggagctggaagacctgctgagcccactggaggagttggtcaaggagcagagcgggaccatctacctgcagcacgcggatgaggagcgtgagaaaacctacaagctggctgagaacatcgatgcacagctcaagcgcatggcccaggatctcaaggacatcatcgagcacctgaacacgtccggggcccccgccgacaccagtgacccactgcagcagatctgcaagatcctcaatgcgcacatggactcactgcagtggatcgaccagaactcggccctgctgcagaggaaggtggaggaggtgaccaaggtgtgcgagggccggcgcaaggagcaggagcgcagcttccggatcacctttgactgagcgacagcagccctggggcccgcaggtccctagggagttcatgaggggaatgcgccctgttgtctgtagtttggggttgtggcaagatacttgtttgtttgtttctttctttcacatgactgcccttgacatgatcgctgtgtgctttgcgtttttccatttaggagggtattctgggccttctgcccaggcagcagcctcatgggtgtggcttctgtggctttcatttgagtatctttggccccttttcacctactgcgaccacccacctcatcctggctcagcctggtgatggagaagtgctgatggtcttggtcccagccagggtcgtgggggcagccactctctccaaagcatagtcataggtgtcatgaaaaaataccaaatgtaagagaacctccaagtcagggcgcagtggctcacccctgtaatctcagcactttgggtggccaaggcgggcagatgacttgaggtcaggagttcgagaccagcctggccaacatggtgaaaccccgtctctactaaaaatacaaaaattagtcaggtgtggtggacgcctgtgatctcaatctcagctactcgggaggctgaggcaggagaatcacttgaacccaggaggtgttgcagtgaaccaagatcacaccactgcactccagcctaggcaacagagactctgtctcaaaaaaaaaaaaaaaaaaaaagaaactcccaggagacagcagcctagttttcgagtgtgagcttgtgcttgtgaaagctaaccatgctaaccaccaaggcaaagcagcacagtgtgaatagaacagagcgggatcaagaatttcacagaagacaggtcagctgaggggcctgcacacacagggtgttgaggaaccacagatgggcgccgagaggcctgccttttgcctggcccaggctcacccccaccttgggcctcacctcctccaggaagccttcccagctacccgaagctcaggtggccttcttgcaggtccccgtagcaccctgagcctgtaccttgggtggcacttgttatgctatcctgtgctagccgtttgtgcctcgtctcgctgttagattgtgagttcccatgggcagagacccactgtcgttccccgtgtgtccccagcccggtccctgtcacatttgttaaatgaaagaacaatgaagcccagtgtaacgtcagtccacagaaatagccacagcttccagtggtggccgtagacttggctcggaacttagtggcaccagagtaactctagtcagttacagtaaaatccactgtgtgtggaaggcagaagctagcggttgtatcccaagcatcttttgtatttgtctttatactttgctgaattctctgaaatacctattactgtatgttgcttttctaaataaatgtattgtgaaacc

SEQ ID NO: 20909 - DNA, 3260 bp, Homo sapiens
actacttctgcgcctgcgcgaccgtgattccccgctcgcgactccccaccccccagggctccctaaagagggccacgagctgcgaaagggcgggaaaggcagttggagaagaggtaagcggttactcactccatggctgcagcaaggagaggcggcggcggcctcggctgaagaaagaaggtgggagcggagagcgcaggcgtgaaatcttcccaaggctgcagacaccgacggatttgctttgggagccagagtagctgccgccaccagagtccggagccatgagcgggtttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttttggaacagcgactcttgcttcggggggaactggattttctttggggatcggtgcttcaaagctcaacttgagcaacacagctgccaccccagccatggcaaaccccagcggctttgggctgggcagcagcaacctcactaatgccatatcgagcaccgtcacctccagccagggcacagcacccaccggctttgtgtttggcccctccaccacctctgtggctccagctaccacatctggaggcttctcattcactggtggaagcacggcccaaccctccggtttcaacattggctcagcagggaattcagcccagcccacggcacctgccacgttgcccttcactccggccacgccagcagccaccacagcaggtgccacacagccagctgctcccacacccacagccaccatcaccagcactgggcccagcctctttgcgtcaatagcaactgctccaacctcatctgccaccactggactctccctctgtacccctgtgaccacagcgggcgcccccactgctgggacacagggcttcagcttaaaggcacctggagcagcttccggcacctccacaacaacatccaccgctgccaccgccaccgccaccaccaccagcagcagcagcaccaccggctttgccttgaatttaaaaccactggcgccagccgggatccccagcaatacagcagctgccgtgaccgctccacctggccctggcgcagctgcaggggcggctgccagctccgccatgacctacgcgcagctggagagcctgatcaacaaatggagcctggagctagaggaccaggagcggcacttcctccagcaggccacccaggtcaacgcctgggaccgcacgctgatcgagaatggagaaaagatcaccagcctgcaccgcgaggtggagaaggtgaagctggaccagaagaggctggaccaggagctcgacttcatcctgtcccagcagaaggagctggaagacctgctgagcccactggaggagttggtcaaggagcagagcgggaccatctacctgcagcacgcggatgaggagcgtgagaaaacctacaagctggctgagaacatcgatgcacagctcaagcgcatggcccaggatctcaaggacatcatcgagcacctgaacacgtccggggcccccgccgacaccagtgacccactgcagcagatctgcaagatcctcaatgcgcacatggactcactgcagtggatcgaccagaactcggccctgctgcagaggaaggtggaggaggtgaccaaggtgtgcgagggccggcgcaaggagcaggagcgcagcttccggatcacctttgactgagcgacagcagccctggggcccgcaggtccctagggagttcatgaggggaatgcgccctgttgtctgtagtttggggttgtggcaagatacttgtttgtttgtttctttctttcacatgactgcccttgacatgatcgctgtgtgctttgcgtttttccatttaggagggtattctgggccttctgcccaggcagcagcctcatgggtgtggcttctgtggctttcatttgagtatctttggccccttttcacctactgcgaccacccacctcatcctggctcagcctggtgatggagaagtgctgatggtcttggtcccagccagggtcgtgggggcagccactctctccaaagcatagtcataggtgtcatgaaaaaataccaaatgtaagagaacctccaagtcagggcgcagtggctcacccctgtaatctcagcactttgggtggccaaggcgggcagatgacttgaggtcaggagttcgagaccagcctggccaacatggtgaaaccccgtctctactaaaaatacaaaaattagtcaggtgtggtggacgcctgtgatctcaatctcagctactcgggaggctgaggcaggagaatcacttgaacccaggaggtgttgcagtgaaccaagatcacaccactgcactccagcctaggcaacagagactctgtctcaaaaaaaaaaaaaaaaaaaaagaaactcccaggagacagcagcctagttttcgagtgtgagcttgtgcttgtgaaagctaaccatgctaaccaccaaggcaaagcagcacagtgtgaatagaacagagcgggatcaagaatttcacagaagacaggtcagctgaggggcctgcacacacagggtgttgaggaaccacagatgggcgccgagaggcctgccttttgcctggcccaggctcacccccaccttgggcctcacctcctccaggaagccttcccagctacccgaagctcaggtggccttcttgcaggtccccgtagcaccctgagcctgtaccttgggtggcacttgttatgctatcctgtgctagccgtttgtgcctcgtctcgctgttagattgtgagttcccatgggcagagacccactgtcgttccccgtgtgtccccagcccggtccctgtcacatttgttaaatgaaagaacaatgaagcccagtgtaacgtcagtccacagaaatagccacagcttccagtggtggccgtagacttggctcggaacttagtggcaccagagtaactctagtcagttacagtaaaatccactgtgtgtggaaggcagaagctagcggttgtatcccaagcatcttttgtatttgtctttatactttgctgaattctctgaaatacctattactgtatgttgcttttctaaataaatgtattgtgaaacc

SEQ ID NO: 20910 - DNA, 2311 bp, Homo sapiens
cggtactctgagtgcagtcagtcctcggcgctgttttccctgatttgctgtcgacgccaggaaggaaggacgcgtgcagaggaccgcagaggggtggccgtggctgagaggagacagcgccgcagcactgagggtttgggcttgcaggcgctgcaggagacgcccaggcggagtcttgtctcgcagccagctctgagcgggaggcctgagcgggaagcattggcgtccgagcgacttctaggagcctggggttcggcgctatggaggagctcgatggcgagccaacagtcactttgattccaggcgtgaattccaagaagaaccaaatgtattttgactggggtccaggggagatgctggtatgtgaaacctccttcaacaaaaaagaaaaatcagagatggtgccaagttgcccctttatctatatcatccgtaaggatgtagatgtttactctcaaatcttgagaaaactcttcaatgaatcccatggaatctttctgggcctccagagaattgacgaagagttgactggaaaatccagaaaatctcaattggttcgagtgagtaaaaactaccgatcagtcatcagagcatgtatggaggaaatgcaccaggttgcaattgctgctaaagatccagccaatggccgccagttcagcagccaggtctccattttgtcagcaatggagctcatctggaacctgtgtgagattctttttattgaagtggccccagctggccctctcctcctccatctccttgactgggtccggctccatgtgtgcgaggtggacagtttgtcggcagatgttctgggcagtgagaatccaagcaaacatgacagcttctggaacttggtgaccatcttggtgctgcagggccggctggatgaggcccgacagatgctctccaaggaagccgatgccagccccgcctctgcaggcatatgccgaatcatgggggacctgatgaggacaatgcccattcttagtcccgggaacacccagacactgacagagctggagctgaagtggcagcactggcacgaggaatgtgagcggtacctccaggacagcacattcgccaccagccctcacctggagtctctcttgaagattatgctgggagacgaagctgccttgttagagcagaaggaacttctgagtaattggtatcatttcctagtgactcggctcttgtactccaatcccacagtaaaacccattgatctgcactactatgcccagtccagcctggacctgtttctgggaggtgagagcagcccagaacccctggacaacatcttgttggcagcctttgagtttgacatccatcaagtaatcaaagagtgcagcatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaagttcgcagcatttgtaagatcttagccatgaaagccgtccgcaacaatcgcctgggttctgccctctcttggagcatccgtgctaaggatgccgcctttgccacgctcgtgtcagacaggttcctcagggattactgtgagcgaggctgcttttctgatttggatctcattgacaacctggggccagccatgatgctcagtgaccgactgacattcctgggaaagtatcgcgagttccaccgtatgtacggggagaagcgttttgccgacgcagcttctctccttctgtccttgatgacgtctcggattgcccctcggtctttctggatgactctgctgacagacgccttgccccttttggaacagaaacaggtgattttctcagcagaacagacttatgagttgatgcggtgtctggaggacttgacgtcaagaagacctgtgcatggagaatctgataccgagcagctccaggatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagatttttttaaaagaataaatgttgttttgcaaatgtag

SEQ ID NO: 20911 - DNA, 2233 bp, Homo sapiens
attggcgtccgagcgacttctaggagcctggggttcggcgctatggaggagctcgatggcgagccaacagtcactttgattccaggcgtgaattccaagaagaaccaaatgtattttgactggggtccaggggagatgctggtatgtgaaacctccttcaacaaaaaagaaaaatcagagatggtgccaagttgcccctttatctatatcatccgtaaggatgtagatgtttactctcaaatcttgagaaaactcttcaatgaatcccatggaatctttctgggcctccagagaattgacgaagagttgactggaaaatccagaaaatctcaattggttcgagtgagtaaaaactaccgatcagtcatcagagcatgtatggaggaaatgcaccaggttgcaattgctgctaaagatccagccaatggccgccagttcagcagccaggtctccattttgtcagcaatggagctcatctggaacctgtgtgagattctttttattgaagtggccccaggtgaccatcttggtgctgcagggccggctggatgaggcccgacagatgctctccaaggaagccgatgccagccccgcctctgcaggcatatgccgaatcatgggggacctgatgaggacaatgcccattcttagtcccgggaacacccagacactgacagagctggagctgaagtggcagcactggcacgaggaatgtgagcggtacctccaggacagcacattcgccaccagccctcacctggagtctctcttgaagattatgctgggagacgaagctgccttgttagagcagaaggaacttctgagtaattggtatcatttcctagtgactcggctcttgtactccaatcccacagtaaaacccattgatctgcactactatgcccagtccagcctggacctgtttctgggaggtgagagcagcccagaacccctggacaacatcttgttggcagcctttgagtttgacatccatcaagtaatcaaagagtgcagcatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaagttcgcagcatttgtaagatcttagccatgaaagccgtccgcaacaatcgcctgggttctgccctctcttggagcatccgtgctaaggatgccgcctttgccacgctcgtgtcagacaggttcctcagggattactgtgagcgaggctgcttttctgatttggatctcattgacaacctggggccagccatgatgctcagtgaccgactgacattcctgggaaagtatcgcgagttccaccgtatgtacggggagaagcgttttgccgacgcagcttctctccttctgtccttgatgacgtctcggattgcccctcggtctttctggatgactctgctgacagacgccttgccccttttggaacagaaacaggtgaaggttgcagcagcagtggttttctttgcttgtcagtccctgctagagcttagttgtatagctgttgccgatgtgcgtgtttcctcctttgtcgttctgcctgtgcgcgtgtattccccttagcgccctctctgggattccagactcacacaggaaacaaacactgcttgatttgaaatgaggtattcgtatacaaagcacactattgcgaagggtatgaaaggaagaacgtccgaacatgggcccctgccccaaccaatgcaggccagggctgggggcagccaagcaaggcaggctctcttccctaggtgattttctcagcagaacagacttatgagttgatgcggtgtctggaggacttgacgtcaagaagacctgtgcatggagaatctgataccgagcagctccaggatgatgacatagagaccaccaaggtggaaatgctgagactttctctggcacgaaatcttgctcgggcaattataagagaaggctcactggaaggttcctgagaactgcttcaatgtggtatctttgtatggc

SEQ ID NO: 20912 - DNA, 1287 bp, Homo sapiens
gagcgggaagcattggcgtccgagcgacttctaggagcctggggttcggcgctatggaggagctcgatggcgagccaacagtcactaaaaatcagagatggtgccaagttgcccctttatctatatcatccgtaaggatgtagatgtttactctcaaatcttgagaaaactcttcaatgaatcccatggaatctttctgggcctccagagaattgacgaagagttgactggaaaatccagaaaatctcaattggttcgagtgagtaaaaactaccgatcagtcatcagagcatgtatggaggaaatgcaccaggttgcaattgctgctaaagatccagccaatggccgccagttcagcagccaggtctccattttgtcagcaatggagctcatctggaacctgtgtgagattctttttattgaagtggccccagctggccctctcctcctccatctccttgactgggtccggctccatgtgtgcgaggtggacagtttgtcggcagatgttctgggcagtgagaatccaagcaaacatgacagcttctggaacttggtgaccatcttggtgctgcagggccggctggatgaggcccgacagatgctctccaaggaagccgatgccagccccgcctctgcaggcatatgccgaatcatgggggacctgatgaggacaatgcccattcttagtcccgggaacacccagacactgacagagctggagctgaagtggcagcactggcacgaggaatgtgagcggtacctccaggacagcacattcgccaccagccctcacctggagtctctcttgaagattatgctgggagacgaagctgccttgttagagcagaaggaacttctgagtaattggtatcatttcctagtgactcggctcttgtactccaatcccacagtaaaacccattgatctgcactactatgcccagtccagcctggacctgtttctgggaggtgagagcagcccagaacccctggacaacatcttgttggcagcctttgagtttgacatccatcaagtaatcaaagagtgcagggatgttcatttaaaataacatcgcgggaaactactttgacatttaaaatctagaaaaagccagcaagcctgtttcttggcacctaatggacaccttatgggatggcgtgttccaagagtctcactccagtgacgtgagctaccgaaccactgggcttcaggctgggtattattcagaatttccagccctctatccaaaagagggtgttctatgattgcactgaatctttagca

SEQ ID NO: 20913 - DNA, 1926 bp, Homo sapiens
tttaggaataaaacagatttgagcagaagaagtctgttggatgcagggagtataaaaggggaaagcatcctgctgtttccagtggcagaagagaaagagaagtaccatgaagaggggtgaacaacatcactctcgtgccggacacagacaaggaatgattaggcttgcagtcccccagtctcagcctctctccactctcacaagcaggaagggatctgagctctgttagtgggaaatcttggagtttgcatttctctgatcacgaggctacctcctatcctgttttgaaagaggaacagaaaagcagagcttgtcccaggaattgtgaaatgggctgcaatgtcttcagaggcagtagcagttttaggaagtgtgccctcctggctctggggaaaggttgaattggggtcttgtgggcacttgttttctcatgggatgtatcagtcagacccatgcacagttctgggcggcagggaagtgtgtctctttctggacttgagccagtgagctgttggcatgcctttttaaaggcattagaaaaaaggtttctttcttttttttcctttcctgttcacaccaccttcatatgaacatggagaagggaggtttctaagtgggcccctgatttactcctatgtcaataatcgtgccagaccctaaggggcagaaaaggcagccaggggatcctgactcagaggctgtagttcgtcagccctgctaaagggccaggggtttgtctctcagtgcctgggtgggcatgcttgactgctaaccccttagctgaaaggagatggcaggagtcctccacagggtcccttcttccctcctggcttacagcttcctctgaagacgggccagttccttgctgtctggcaagaggaaacagctggggtgcacttcactgggagttgggcaagatgtcggcagtttcctggtgcccttcaagtcctccaaaagtatcgagctaaaagcatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaagttcgcagcatttgtaagatcttagccatgaaagccgtccgcaacaatcgcctgggttctgccctctcttggagcatccgtgctaaggatgccgcctttgccacgctcgtgtcagacaggttcctcagggattactgtgagcgaggctgcttttctgatttggatctcattgacaacctggggccagccatgatgctcagtgaccgactgacattcctgggaaagtatcgcgagttccaccgtatgtacggggagaagcgttttgccgacgcagcttctctccttctgtccttgatgacgtctcggattgcccctcggtctttctggatgactctgctgacagacgccttgccccttttggaacagaaacaggtgattttctcagcagaacagacttatgagttgatgcggtgtctggaggacttgacgtcaagaagacctgtgcatggagaatctgataccgagcagctccaggatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagatttttttaaaagaataaatgttgttttgcaaatgt

SEQ ID NO: 20914 - DNA, 2010 bp, Homo sapiens
ctgagcgggaagcattggcgtccgagcgacttctaggagcctggggttcggcgctatggaggagctcgatggcgagccaacagtcactaaaaatcagagatggtgccaagttgcccctttatctatatcatccgtaaggatgtagatgtttactctcaaatcttgagaaaactcttcaatgaatcccatggaatctttctgggcctccagagaattgacgaagagttgactggaaaatccagaaaatctcaattggttcgagtgagtaaaaactaccgatcagtcatcagagcatgtatggaggaaatgcaccaggttgcaattgctgctaaagatccagccaatggccgccagttcagcagccaggtctccattttgtcagcaatggagctcatctggaacctgtgtgagattctttttattgaagtggccccagctggccctctcctcctccatctccttgactgggtccggctccatgtgtgcgaggtggacagtttgtcggcagatgttctgggcagtgagaatccaagcaaacatgacagcttctggaacttggtgaccatcttggtgctgcagggccggctggatgaggcccgacagatgctctccaaggaagccgatgccagccccgcctctgcaggcatatgccgaatcatgggggacctgatgaggacaatgcccattcttagtcccgggaacacccagacactgacagagctggagctgaagtggcagcactggcacgaggaatgtgagcggtacctccaggacagcacattcgccaccagccctcacctggagtctctcttgaagattatgctgggagacgaagctgccttgttagagcagaaggaacttctgagtaattggtatcatttcctagtgactcggctcttgtactccaatcccacagtaaaacccattgatctgcactactatgcccagtccagcctggacctgtttctgggaggtgagagcagcccagaacccctggacaacatcttgttggcagcctttgagtttgacatccatcaagtaatcaaagagtgcagcatcgccctgagcaactggtggtttgtggcccacctgacagacctgctggaccactgcaagctcctccagtcacacaacctctatttcggttccaacatgagagagttcctcctgctggagtacgcctcgggactgtttgctcatcccagcctgtggcagctgggggtcgattactttgattactgccccgagctgggccgagtctccctggagctgcacattgagcggatacctctgaacaccgagcagaaagccctgaaggtgctgcggatctgtgagcagcggcagatgactgaacaagttcgcagcatttgtaagatcttagccatgaaagccgtccgcaacaatcgcctgggttctgccctctcttggagcatccgtgctaaggatgccgcctttgccacgctcgtgtcagacaggttcctcagggattactgtgagcgaggctgcttttctgatttggatctcattgacaacctggggccagccatgatgctcagtgaccgactgacattcctgggaaagtatcgcgagttccaccgtatgtacggggagaagcgttttgccgacgcagcttctctccttctgtccttgatgacgtctcggattgcccctcggtctttctggatgactctgctgacagacgccttgccccttttggaacagaaacaggtgattttctcagcagaacagacttatgagttgatgcggtgtctggaggacttgacgtcaagaagacctgtgcatggagaatctgataccgagcagctccaggatgatgacatagagaccaccaaggtggaaatgctgagactttctctggcacgaaatcttgctcgggcaattataagagaaggctcactggaaggttcctgagaactgcttcaatgtggtatctttgtatggcaatgtatatagatttttttaaaagaataaatgttgttttgcaaatgt

SEQ ID NO: 20915 - DNA, 2436 bp, Homo sapiens
aactggagtgaggggagcagttgggccaagatggcggccgccgagggaccggtgggcgacggcgagctgtggcagacctggcttcctaaccacgtcgtgttcttgcggctccgggagggactgaaaaaccagagtccaaccgaagctgagaaaccagcttcttcgtcgttgccttcgtcgccgccgccgcagttgctgacgagaaacgtggtctttggcctcggcggagagcttttcctgtgggacggagaagacagctccttcttagtcgttcgccttcggggccccagcggcggcggcgaagagcccgccctgtcccagtaccagagattgctttgcataaatccacccctgtttgaaatctatcaagtcttgttaagcccaacacaacatcatgtagcacttataggaataaaaggacttatggtattagaattacctaaaagatgggggaagaattctgaatttgaaggtggaaaatcaacagtgaattgtagtaccactccagttgcggagagatttttcaccagttccacctctctgactctaaagcatgctgcatggtatccaagtgaaatcctggatccccacgtagtgctgttaacatcagacaacgtaatcagaatttactcactacgtgagccgcagacacccactaacgtgataatactttcagaagccgaagaggaaagtctagtactcaataaaggaagggcgtataccgcatctctaggagagacagcagttgcatttgactttgggccattggcagcagtcccaaagactctatttggacaaaacggcaaagatgaagtagtggcatacccactgtacatcttatatgaaaatggagagactttcctgacatacatcagtctgttacacagccctggaaatattggaaagctgttgggtccattgcccatgcatcctgcggctgaagataactatggttatgatgcgtgtgctgtactctgcttaccctgtgtccccaatatcttagtgatcgctactgaatcaggaatgctgtatcactgtgtcgtgctagaaggggaagaagaagatgaccacacgtcagaaaagtcctgggattccaggattgacctcattccttctctgtatgtgtttgaatgtgttgagttggagcttgctttgaaactggcatctggagaggatgacccttttgattctgacttttcttgtccagtcaaacttcatagagatcccaagtgtccttcaagatatcactgtactcatgaagctggtgtacatagtgttgggctaacttggattcataaacttcacaaatttcttggatcagatgaagaagataaggatagtttacaggaactctctacagaacagaaatgctttgttgaacacatcctttgtacgaagccattgccctgcaggcagccagctccaattcgaggattttggattgtacctgacattctgggacccacgatgatctgcatcaccagtacctatgaatgcctcatatggccgttattaagtacagtccatccagcgtctcctcccctgctttgtactcgagaagatgttgaagtggcagagtctcccctccgtgttctggctgaaaccccagattcctttgaaaagcatattagaagcattttgcaacgtagtgttgccaatccagcatttttgaaagcttctgaaaaggacatagcccctcctcctgaagaatgccttcagctcctcagcagagccacccaggtgttcagagagcagtacattctcaaacaggacttggcaaaggaggagattcagcggagggtcaaattattatgtgaccaaaaaaagaaacaactagaagatctcagttattgtcgagaagagaggaaaagtctgcgggaaatggctgagcgtttagctgacaaatatgaggaagctaaagaaaaacaagaggatatcatgaacaggatgaaaaaactacttcacagttttcactctgagctcccagttctctctgatagtgagcgagacatgaagaaagaattacagctgatacctgatcaacttcgacatttgggcaatgccatcaaacaggttactatgaaaaaggattatcaacagcaaaagatggagaaggtgttgagtcttccaaaacccaccattattctcagtgcctaccagcgaaagtgcattcagtccatcctgaaagaggagggtgaacatataagggaaatggtgaagcaaatcaatgatatccgcaatcatgtaaacttctgacaccaccaggagctgactcacacctgaactgaacaccattgaaggcttaaacccatattgtaaaacaggtagaattatctaatttataaaaaggtgttttgatgacctttggtgtggttcatctttttaaatatgttgttttataataattgagtaaatgcttttatttaaaatttggaa

SEQ ID NO: 20916 - DNA, 2244 bp, Homo sapiens
agttgggccaagatggcggccgccgagggaccggtgggcgacggcgagctgtggcctcggcggagagcttttcctgtgggacggagaagacagctccttcttagtcgttcgccttcggggccccagcggcggcggcgaagagcccgccctgtcccagtaccagagattgctttgcataaatccacccctgtttgaaatctatcaagtcttgttaagcccaacacaacatcatgtagcacttataggaataaaaggacttatggtattagaattacctaaaagatgggggaagaattctgaatttgaaggtggaaaatcaacagtgaattgtagtaccactccagttgcggagagatttttcaccagttccacctctctgactctaaagcatgctgcatggtatccaagtgaaatcctggatccccacgtagtgctgttaacatcagacaacgtaatcagaatttactcactacgtgagccgcagacacccactaacgtgataatactttcagaagccgaagaggaaagtctagtactcaataaaggaagggcgtataccgcatctctaggagagacagcagttgcatttgactttgggccattggcagcagtcccaaagactctatttggacaaaacggcaaagatgaagtagtggcatacccactgtacatcttatatgaaaatggagagactttcctgacatacatcagtctgttacacagccctggaaatattggaaagctgttgggtccattgcccatgcatcctgcggctgaagataactatggttatgatgcgtgtgctgtactctgcttaccctgtgtccccaatatcttagtgatcgctactgaatcaggaatgctgtatcactgtgtcgtgctagaaggggaagaagaagatgaccacacgtcagaaaagtcctgggattccaggattgacctcattccttctctgtatgtgtttgaatgtgttgagttggagcttgctttgaaactggcatctggagaggatgacccttttgattctgacttttcttgtccagtcaaacttcatagagatcccaagtgtccttcaagatatcactgtactcatgaagctggtgtacatagtgttgggctaacttggattcataaacttcacaaatttcttggatcagatgaagaagataaggatagtttacaggaactctctacagaacagaaatgctttgttgaacacatcctttgtacgaagccattgccctgcaggcagccagctccaattcgaggattttggattgtacctgacattctgggacccacgatgatctgcatcaccagtacctatgaatgcctcatatggccgttattaagtacagtccatccagcgtctcctcccctgctttgtactcgagaagatgttgaagtggcagagtctcccctccgtgttctggctgaaaccccagattcctttgaaaagcatattagaagcattttgcaacgtagtgttgccaatccagcatttttgaattgttttactcagctaaggaaaataaaggtagaaactttgtttttaagagcttctgaaaaggacatagcccctcctcctgaagaatgccttcagctcctcagcagagccacccaggtgttcagagagcagtacattctcaaacaggacttggcaaaggaggagattcagcggagggtcaaattattatgtgaccaaaaaaagaaacaactagaagatctcagttattgtcgagaagagaggaaaagtctgcgggaaatggctgagcgtttagctgacaaatatgaggaagctaaagaaaaacaagaggatatcatgaacaggatgaaaaaactacttcacagttttcactctgagctcccagttctctctgatagtgagcgagacatgaagaaagaattacagctgatacctgatcaacttcgacatttgggcaatgccatcaaacaggttactatgaaaaaggattatcaacagcaaaagatggagaaggtgttgagtcttccaaaacccaccattattctcagtgcctaccagcgaaagtgcattcagtccatcctgaaagaggagggtgaacatataagggaaatggtgaagcaaatcaatgatatccgcaatcatgtaaacttctgacaccaccaggagctgactcacacctgaactgaacaccattgaaggcttaaacccatattgtaaaacaggtagaattatctaatttataaaaaggtgttttgatg

SEQ ID NO: 20917 - DNA, 2916 bp, Homo sapiens
acagacccctgggaggtgtactttccgggtgcagaccgcgaatggatcgcagcgtattctgggaagtgttgttttatcgaccggccccacgtggagacagatttaggcatccaagcgaaatgcgtgaggccagcccgacctgcactgagggaggtaagtcttgagggaaagttctggatgcctgggtttacccagatggaggtgtccaataggcaattagatacacaagtctcaggctctccccaggtgctagatttccagcagcaccaccattatgttgacttctcgtcccgcccccttgggcttcagaaataatggtgattggctttcccttggtgacgcccctgcttggtgggctggcctcgccttcgccccccgacctggcacgagcctctcgagcttccgggccgtctgctcggtgattggccgaaacagtgagtggacggccgcggattggctgtgctcagcggcgggctgagcaactggagtgaggggagcagttgggccaagatggcggccgccgagggaccggtgggcgacggcgagctgtggcagacctggcttcctaaccacgtcgtgttcttgcggctccgggagggactgaaaaaccagagtccaaccgaagctgagaaaccagcttcttcgtcgttgccttcgtcgccgccgccgcagttgctgacgagaaacgtggtctttggcctcggcggagagcttttcctgtgggacggagaagacagctccttcttagtcgttcgccttcggggccccagcggcggcggcgaagagcccgccctgtcccagtaccagagattgctttgcataaatccacccctgtttgaaatctatcaagtcttgttaagcccaacacaacatcatgtagcacttataggaataaaaggacttatggtattagaattacctaaaagatgggggaagaattctgaatttgaaggtggaaaatcaacagtgaattgtagtaccactccagttgcggagagatttttcaccagttccacctctctgactctaaagcatgctgcatggtatccaagtgaaatcctggatccccacgtagtgctgttaacatcagacaacgtaatcagaatttactcactacgtgagccgcagacacccactaacgtgataatactttcagaagccgaagaggaaagtctagtactcaataaaggaagggcgtataccgcatctctaggagagacagcagttgcatttgactttgggccattggcagcagtcccaaagactctatttggacaaaacggcaaagatgaagtagtggcatacccactgtacatcttatatgaaaatggagagactttcctgacatacatcagtctgttacacagccctggaaatattggaaagctgttgggtccattgcccatgcatcctgcggctgaagataactatggttatgatgcgtgtgctgtactctgcttaccctgtgtccccaatatcttagtgatcgctactgaatcaggaatgctgtatcactgtgtcgtgctagaaggggaagaagaagatgaccacacgtcagaaaagtcctgggattccaggattgacctcattccttctctgtatgtgtttgaatgtgttgagttggagcttgctttgaaactggcatctggagaggatgacccttttgattctgacttttcttgtccagtcaaacttcatagagatcccaagtgtccttcaagatatcactgtactcatgaagctggtgtacatagtgttgggctaacttggattcataaacttcacaaatttcttggatcagatgaagaagataaggatagtttacaggaactctctacagaacagaaatgctttgttgaacacatcctttgtacgaagccattgccctgcaggcagccagctccaattcgaggattttggattgtacctgacattctgggacccacgatgatctgcatcaccagtacctatgaatgcctcatatggccgttattaagtacagtccatccagcgtctcctcccctgctttgtactcgagaagatgttgaagtggcagagtctcccctccgtgttctggctgaaaccccagattcctttgaaaagcatattagaagcattttgcaacgtagtgttgccaatccagcatttttgaaagcttctgaaaaggacatagcccctcctcctgaagaatgccttcagctcctcagcagagccacccaggtgttcagagagcagtacattctcaaacaggacttggcaaaggaggagattcagcggagggtcaaattattatgtgaccaaaaaaagaaacaactagaagatctcagttattgtcgagaagagaggaaaagtctgcgggaaatggctgagcgtttagctgacaaatatgaggaagctaaagaaaaacaagaggatatcatgaacaggatgaaaaaactacttcacagttttcactctgagctcccagttctctctgatagtgagcgagacatgaagaaagaattacagctgatacctgatcaacttcgacatttgggcaatgccatcaaacaggttactatgaaaaaggattatcaacagcaaaagatggagaaggtgttgagtcttccaaaacccaccattattctcagtgcctaccagcgaaagtgcattcagtccatcctgaaagaggagggtgaacatataagggaaatggtgaagcaaatcaatgatatccgcaatcatgtaaacttctgacaccaccaggagctgactcacacctgaactgaacaccattgaaggcttaaacccatattgtaaaacaggtagaattatctaatttataaaaaggtgttttgatgacctttggtgtggttcatctttttaaatatgttgttttataataattgagtaaatgcttttatttaaaatttggaa

SEQ ID NO: 20918 - DNA, 2902 bp, Homo sapiens
aatcaggaagcgggggagagcggcgcgagaagcggcggccgcgtcctcaagccggcacctgagcggcggagacggctgtagcacaaggatctgcatctccaatggatactgaggggtttggtgagctccttcagcaagctgaacagcttgctgctgagactgagggcatctcagagcttccccatgtggaacggaacttacaggagatccagcaggcgggagagcgcctgcgttcccgtaccctaacacgcacgtcccaggagacggcagatgtcaaggcgtcagttctcctcgggtctcggggacttgacatatcccacatctcccagcgattggagagtctgagtgcagccaccacctttgagcctcttgagcctgtgaaggacactgacattcagggcttcctgaagaatgagaaggacaatgccctgctgtctgccatcgaagagtcccggaagaggaccttcggcatggctgaggagtaccatcgggagtcaatgttggttgagtgggagcaagtgaaacagcgaattctgcacacactgctggcatcaggagaagacgcccttgactttactcaagaaagcgagccaagctacatcagtgatgtgggaccccctggtcgaagctctctggataacatcgagatggcctatgcgcggcaaatttatatctataatgagaaaattgtaaatggacacctgcagcctaacctggtggacctttgtgcttccgtcgcagagctcgatgataagagcatttccgacatgtggaccatggtaaaacaaatgacagacgtgttgttgacaccggcaacggatgccctgaagaaccgcagcagcgtggaagtgcgcatggagtttgtcaggcaggccttggcgtaccttgagcagagttataagaattacacccttgtgactgtctttggaaatttgcatcaggcccagctgggcggggtgcctgggacttaccaattggttcgaagtttcctgaacattaaactgccagctcccttgcctggactacaggatggagaggtggaaggccatcctgtgtgggcgctaatttactactgcatgcgctgtggagacctgcttgccgcttcacaggtagttaatcgagcccagcaccagctgggagagtttaaaacctggttccaggagtacatgaacagcaaggacagaagattgtccccagctacggaaaacaagctccggctgcattaccgtagggccctcaggaacaatacagatccctacaagcgggccgtgtactgtatcattggcagatgtgacgtcaccgacaaccagagtgaagtggcggacaaaactgaggattacctgtggctgaagttgaaccaagtgtgttttgacgacgatggcaccagctccccacaagacaggctcactctctcacagttccagaagcagttgttggaagactatggcgagtcccactttacggtgaaccagcaacccttcctctacttccaagtcctgttcctgacagcgcagtttgaagcagcagttgcctttcttttccgcatggagcggctgcgctgccatgctgtccatgtagcactggtgctgtttgagctgaagctgcttttaaagtcctctggacagagtgctcagctcctcagccacgagcctggtgaccctccttgcttgcggcggctgaacttcgtgcggctcctcatgctgtacacccggaagtttgagtccacggacccaagggaggccctccagtacttctatttcctcagggatgagaaagatagtcaaggagaaaacatgtttctgcgctgtgtgagtgagcttgtgattgaaagccgagagttcgatatgattcttgggaaactagagaatgacggaagtagaaagcctggagtcatagataagtttactagtgacacaaagcctattatcaacaaagttgcttctgtggcagaaaataaaggactgtttgaagaggcagcaaagctgtatgaccttgccaagaatgctgacaaggtactggagctgatgaacaaactgctgagccctgtcgtcccccagatcagtgccccgcaatccaacaaggagaggctgaagaacatggcactctccattgccgaacggtatagggctcaaggaataagcgcaaataaatttgtggactccacgttctatcttcttttggacttgatcaccttttttgacgagtatcatagtggtcatattgatagagcttttgatatcattgagcgcttgaagctggtgcccctgaatcaggaaagtgtggaagagagagtggctgccttcagaaatttcagtgatgaaatcaggcacaacctctcagaagtgcttcttgccaccatgaacatcttgttcacacagtttaagaggctcaaggggacaagtccatcctcgtcatccaggccccagcgagtcatcgaggaccgcgactctcaactccgaagtcaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggtttctgtattatgtatttttgtcaacgccaataaatttctttgatttgtatttcttttcaacattcttttattttctttttttttttctttgaaattttgtttacatttttatttgtgtaatgggaaataccgtcactagctcttgggccagggaatgagaggctatgtagatattcattatttggttaaattgaccttaattaattaaaaatctacccaaaatgagccaggaaa

SEQ ID NO: 20919 - DNA, 2856 bp, Homo sapiens
attgcaaagaatcgatttctgagatgagacaatgagatgtggtttgcattttgtaaagatggaggaaacctctaacactgaccctgtatgggagatgactcaattatccacgccttggtacagttgcaaattatttccctttgtctgaagtgggtggatgccagcgccttcatcagagctccttaatttaatgtatggaaaatgtctcagccaccatttttaacaattagctgtatcatggtcgaggtgagctgtattctgaaggcagctgcaaggccatttcatttacattaggttccatggcacaggagctttgttactgtaaaactaagaaaatgaatttgcacattgtatagaagagttctttaggaaggtggagaatattcccagaaagaaaatggaattcttttgtctacaggcttcctgaagaatgagaaggacaatgccctgctgtctgccatcgaagagtcccggaagaggaccttcggcatggctgaggagtaccatcgggagtcaatgttggttgagtgggagcaagtgaaacagcgaattctgcacacactgctggcatcaggagaagacgcccttgactttactcaagaaagcgagccaagctacatcagtgatgtgggaccccctggtcgaagctctctggataacatcgagatggcctatgcgcggcaaatttatatctataatgagaaaattgtaaatggacacctgcagcctaacctggtggacctttgtgcttccgtcgcagagctcgatgataagagcatttccgacatgtggaccatggtaaaacaaatgacagacgtgttgttgacaccggcaacggatgccctgaagaaccgcagcagcgtggaagtgcgcatggagtttgtcaggcaggccttggcgtaccttgagcagagttataagaattacacccttgtgactgtctttggaaatttgcatcaggcccagctgggcggggtgcctgggacttaccaattggttcgaagtttcctgaacattaaactgccagctcccttgcctggactacaggatggagaggtggaaggccatcctgtgtgggcgctaatttactactgcatgcgctgtggagacctgcttgccgcttcacaggtagttaatcgagcccagcaccagctgggagagtttaaaacctggttccaggagtacatgaacagcaaggacagaagattgtccccagctacggaaaacaagctccggctgcattaccgtagggccctcaggaacaatacagatccctacaagcgggccgtgtactgtatcattggcagatgtgacgtcaccgacaaccagagtgaagtggcggacaaaactgaggattacctgtggctgaagttgaaccaagtgtgttttgacgacgatggcaccagctccccacaagacaggctcactctctcacagttccagaagcagttgttggaagactatggcgagtcccactttacggtgaaccagcaacccttcctctacttccaagtcctgttcctgacagcgcagtttgaagcagcagttgcctttcttttccgcatggagcggctgcgctgccatgctgtccatgtagcactggtgctgtttgagctgaagctgcttttaaagtcctctggacagagtgctcagctcctcagccacgagcctggtgaccctccttgcttgcggcggctgaacttcgtgcggctcctcatgctgtacacccggaagtttgagtccacggacccaagggaggccctccagtacttctatttcctcagggatgagaaagatagtcaaggagaaaacatgtttctgcgctgtgtgagtgagcttgtgattgaaagccgagagttcgatatgattcttgggaaactagagaatgacggaagtagaaagcctggagtcatagataagtttactagtgacacaaagcctattatcaacaaagttgcttctgtggcagaaaataaaggactgtttgaagaggcagcaaagctgtatgaccttgccaagaatgctgacaaggtactggagctgatgaacaaactgctgagccctgtcgtcccccagatcagtgccccgcaatccaacaaggagaggctgaagaacatggcactctccattgccgaacggtatagggctcaaggaataagcgcaaataaatttgtggactccacgttctatcttcttttggacttgatcaccttttttgacgagtatcatagtggtcatattgatagagcttttgatatcattgagcgcttgaagctggtgcccctgaatcaggaaagtgtggaagagagagtggctgccttcagaaatttcagtgatgaaatcaggcacaacctctcagaagtgcttcttgccaccatgaacatcttgttcacacagtttaagaggctcaaggggacaagtccatcctcgtcatccaggccccagcgagtcatcgaggaccgcgactctcaactccgaagtcaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggtttctgtattatgtatttttgtcaacgccaataaatttctttgatttgtatttcttttcaacattcttttattttctttttttttttctttgaaattttgtttacatttttatttgtgtaatgggaaataccgtcactagctcttgggccagggaatgagaggctatgta

SEQ ID NO: 20920 - DNA, 2875 bp, Homo sapiens
atgcaagatgtcggaagtcatcaaagattcacatcagagtaattgcagtggtttgggttggggaaaaaaagtatcatagcattccttgcctacatgttgtctctccccctcttaaatcttaacttggtacagtccgttaacaataaaatacccttctgtaacctataaactgttactcccatcagtttgtgctttcaaactgatggctgacttctctgaatttgtgtagcgcacaacgaatggtgatgctgtgctccgggggctgcagtgcaccctttttaaagggaccctgcaatctcattgtttaatttgactctttagtgcttcagtcacatcagcacttgcagaggggttgttcttttcctttttcttctttctctctttttctcttctctctgtccttctccccacccccatccctcaattcaggcagtttggggtgggaaaaacttgagcactggttccgacagagctcatctcatataagaaggtttggaagagctgcagtgatcgacagcatcgaccgttctgtaactccttaaatttaagagctgcagggcttcctgaagaatgagaaggacaatgccctgctgtctgccatcgaagagtcccggaagaggaccttcggcatggctgaggagtaccatcgggagtcaatgttggttgagtgggagcaagtgaaacagcgaattctgcacacactgctggcatcaggagaagacgcccttgactttactcaagaaagcgagccaagctacatcagtgatgtgggaccccctggtcgaagctctctggataacatcgagatggcctatgcgcggcaaatttatatctataatgagaaaattgtaaatggacacctgcagcctaacctggtggacctttgtgcttccgtcgcagagctcgatgataagagcatttccgacatgtggaccatggtaaaacaaatgacagacgtgttgttgacaccggcaacggatgccctgaagaaccgcagcagcgtggaagtgcgcatggagtttgtcaggcaggccttggcgtaccttgagcagagttataagaattacacccttgtgactgtctttggaaatttgcatcaggcccagctgggcggggtgcctgggacttaccaattggttcgaagtttcctgaacattaaactgccagctcccttgcctggactacaggatggagaggtggaaggccatcctgtgtgggcgctaatttactactgcatgcgctgtggagacctgcttgccgcttcacaggtagttaatcgagcccagcaccagctgggagagtttaaaacctggttccaggagtacatgaacagcaaggacagaagattgtccccagctacggaaaacaagctccggctgcattaccgtagggccctcaggaacaatacagatccctacaagcgggccgtgtactgtatcattggcagatgtgacgtcaccgacaaccagagtgaagtggcggacaaaactgaggattacctgtggctgaagttgaaccaagtgtgttttgacgacgatggcaccagctccccacaagacaggctcactctctcacagttccagaagcagttgttggaagactatggcgagtcccactttacggtgaaccagcaacccttcctctacttccaagtcctgttcctgacagcgcagtttgaagcagcagttgcctttcttttccgcatggagcggctgcgctgccatgctgtccatgtagcactggtgctgtttgagctgaagctgcttttaaagtcctctggacagagtgctcagctcctcagccacgagcctggtgaccctccttgcttgcggcggctgaacttcgtgcggctcctcatgctgtacacccggaagtttgagtccacggacccaagggaggccctccagtacttctatttcctcagggatgagaaagatagtcaaggagaaaacatgtttctgcgctgtgtgagtgagcttgtgattgaaagccgagagttcgatatgattcttgggaaactagagaatgacggaagtagaaagcctggagtcatagataagtttactagtgacacaaagcctattatcaacaaagttgcttctgtggcagaaaataaaggactgtttgaagaggcagcaaagctgtatgaccttgccaagaatgctgacaaggtactggagctgatgaacaaactgctgagccctgtcgtcccccagatcagtgccccgcaatccaacaaggagaggctgaagaacatggcactctccattgccgaacggtatagggctcaaggaataagcgcaaataaatttgtggactccacgttctatcttcttttggacttgatcaccttttttgacgagtatcatagtggtcatattgatagagcttttgatatcattgagcgcttgaagctggtgcccctgaatcaggaaagtgtggaagagagagtggctgccttcagaaatttcagtgatgaaatcaggcacaacctctcagaagtgcttcttgccaccatgaacatcttgttcacacagtttaagaggctcaaggggacaagtccatcctcgtcatccaggccccagcgagtcatcgaggaccgcgactctcaactccgaagtcaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggtttctgtattatgtatttttgtcaacgccaataaatttctttgatttgt

SEQ ID NO: 20921 - DNA, 6973 bp, Homo sapiens
aaccgcggcggcgaggggcgggactccacggccctctcaccgctcctaccctgtgcctccccgaactccttctgcccctcctcttccctctcgccccttcccccttcagttcggtttcaaaagacgcgttgcccaatgaataacagggtcgacccagagtggcggccgcgtccaccaattcgcggacggcgagggcggagcgtccgcaacgagcctctgacgccgggcggcgtgtgacgcagtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcagagccagagcccagaggtggagcagttagggagggttgtggaactggacagtgacatggtagatatcacccaggagccagttttggataccatgttagaagagagcatgcctgaggatcaggaacctgtgtctgcctcaacacatattgcatcttcactgggaattaatccacatgtcttacagatcatgaaagcatcattgcttactgatgaagaagatgtagatatggcactggatcaacgcttcagtcgcctgccttccaaagcagatacttctcaagaaatctgttctcccagactccccatttcagcatcccactcgtcgaaaactcgttcactagttggtgggttactacaatcaaaatttacaagtggagcttttctttcaccaagtgtctctgtgcaagaatgtcgtactcccagagcagcatctttaatgaatatcccatccacatcctcttggtctgtccctccacccctgacttctgtgttcacaatgcccagcccagcccctgaggttccgttgaaaacagtgggtacacgtaggcaactaggcctagtccctcgtgaaaagtctgtcacctatggcaagggaaaactcttgatggacatggccctattcatgggacgctcatttcgtgttggttggggccccaactggactcttgctaatagtggagaacagctgaatggctctcatgaactagaaaatcatcagattgccgattccatggagtttggattcctgcccaatccagtagctgttaaacccctaactgagtccccattcaaagttcacttagaaaaactcagtttgagacaaagaaagccagatgaagacatgaaattatatcagacacctctggagctcaaattaaaacacagcactgtccatgtggatgaactgtgtcctctcattgtccccaatctgggagttgctgtcattcatgactatgcagattgggttaaagaagcatcaggagacttaccagaagcacaaattgtgaagcactggagcctgacatggacactatgtgaagccctatggggccacctgaaggagcttgacagccagctaaatgaaccccgtgaatacattcaaattctggagcgaagaagagctttctcccgctggctatcctgtactgccacacctcagattgaagaggaagtctccttaacccaaaaaaacagccctgtggaggctgtattcagctacctcacaggcaaaaggatcagtgaggcctgctctctggcccagcagtcaggggatcatcgtcttgctcttcttttatctcagtttgtgggtagccagtcagtccgggagctgctcaccatgcagttggtggactggcatcagctccaagcagactccttcatccaggatgagagactgcgcatctttgctctgttggctggaaaaccggtgtggcagctctcagaaaagaagcaaataaacgtgtgctcccagttggattggaaacgctccctggctatccatctttggtatttgcttccaccaacagcctccatttctagggcgctcagcatgtatgaagaagcatttcagaatacctctgacagtgacagatatgcctgctccccacttccttcgtatctggagggttctggctgtgtgatagcggaggagcaaaactcacagacaccacttcgagatgtctgctttcaccttctaaaactctacagtgacagacattatgatctcaaccagctgctggagcctcgaagcataacagcagatcctttggactaccgcctaagctggcacttgtgggaagtgctgagggctcttaactacacccatctctcagcgcagtgtgaaggtgtgctacaggccagttacgctggccagcttgaaagtgaggggctctgggagtgggccatctttgtcctcctgcacattgacaactcaggcatacgtgagaaggctgttcgagagctgcttacccggcactgccagctgttggagacccctgaatcttgggctaaagagactttccttacccagaagctccgtgtacctgccaaatggatccacgaggccaaagctgtgcgagcacacatggaatctgacaagcacttagaggccctttgcttatttaaggctgagcactggaaccgctgccacaagctcatcatccgacacttagcttctgatgccatcattaatgagaactatgactacctgaaggggttcttggaagacctggcacctccagagcgcagcagcctaattcaggattgggaaacatctgggcttgtttacctggactatattagagtcattgaaatgctccgccatatacagcaggtggattgctcaggtaatgacctggagcagttacacatcaaagtgacttcactgtgcagtcggatagagcagattcagtgttacagtgctaaagatcgcctggctcagtcagacatggccaaacgtgtagccaacctgctgcgcgtggtgctgagtctgcatcatcctcctgatagaacctccgactcaacaccagaccctcagcgagtccctttgcgcctcttggctccccacattggccggcttcccatgcctgaggactatgccatggacgaactgcgcagccttacccagtcctatctgcgagaactggctgttgggagcctgtgagccccaggcactttgcatcacagtcacatgcccattcacaccacacagaggttccctgccttgtttggattggcactgtttgccattctctgggttggctgtggcatctaccctccctccctgctgccagaagcagcatcctccacttgttcagggcttttcttaatactgaacgtagcataagggcttctggaacccagaagaggagacagtttaccatcctcaagatcattcagtgtttttcctttaaaaaaatggtcaataaagctcctttggcagaatcccccaaagaaccagggtattctttttccatccctagccattctggatcttgtgaccctccatgccaaccagcttccctactcctaccctggcccttttatactaggactccttaggaggagtgagacaggtgataatggatccttaacagatgaactatccacagaaggaagagggatccgtctcttaagtaattggttagttaacactgaattttggaggcaaaggagggttggcctgagttaggaaacaaaatgggatctttctgacacacttagggcagaagtgaatgcctgtcacggagggattgatcttcagggctgtttttgttcctgcctttagagttccatgaacaccatacctttgctactactatgtgcaggaacccttggtcacatgtgacatgtctgtgggaagctcccagagtttggtttggtccctggttttcagtcttgctgagactctgtctggatttgcctgcagagtttggataaaaaatggcaggttgggtaaccctccctgttcatcccatgttagctccaaagcatttcccaccctccatctaccccttccagaagcaaaaacaaaccatgactgaggcaggcatggagttgggcgttaggggcaggcagagggcctttgctacactgctgacagctatagggagccccaggtaatggcatgagatagctggtgttagggctatctcaggcaatatggccacacctgggtctttatgcatgaagataatgtaaaggtttttattaaaaaatatatatatgtataaataaatgatctagatattttcctctttttctgaagctactttcttaaaaaataaataaaatgtttatagcattcctggta

SEQ ID NO: 20922 - DNA, 5628 bp, Homo sapiens
tgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcagagccagagcccagaggtggagcagttagggagggttgtggaactggacagtgacatggtagatatcacccaggagccagttttggataccatgttagaagagagcatgcctgaggatcaggaacctgtgtctgcctcaacacatattgcatcttcactgggaattaatccacatgtcttacagatcatgaaagcatcattgcttactgatgaagaagatgtagatatggcactggatcaacgcttcagtcgcctgccttccaaagcagatacttctcaagaaatctgttctcccagactccccatttcagcatcccactcgtcgaaaactcgttcactagttggtgggttactacaatcaaaatttacaagtggagcttttctttcaccaagtgtctctgtgcaagaatgtcgtactcccagagcagcatctttaatgaatatcccatccacatcctcttggtctgtccctccacccctgacttctgtgttcacaatgcccagcccagcccctgaggttccgttgaaaacagtgggtacacgtaggcaactaggcctagtccctcgtgaaaagtctgtcacctatggcaagggaaaactcttgatggacatggccctattcatgggacgctcatttcgtgttggttggggccccaactggactcttgctaatagtggagaacagctgaatggctctcatgaactagaaaatcatcagattgccgattccatggagtttggattcctgcccaatccagtagctgttaaacccctaactgagtccccattcaaagttcacttagaaaaactcagtttgagacaaagaaagccagatgaagacatgaaattatatcagacacctctggagctcaaattaaaacacagcactgtccatgtggatgaactgtgtcctctcattgtccccaatctgggagttgctgtcattcatgactatgcagattgggttaaagaagcatcaggagacttaccagaagcacaaattgtgaagcactggagcctgacatggacactatgtgaagccctatggggccacctgaaggagcttgacagccagctaaatgaaccccgtgaatacattcaaattctggagcgaagaagagctttctcccgctggctatcctgtactgccacacctcagattgaagaggaagtctccttaacccaaaaaaacagccctgtggaggctgtattcagctacctcacaggcaaaaggatcagtgaggcctgctctctggcccagcagtcaggggatcatcgtcttgctcttcttttatctcagtttgtgggtagccagtcagtccgggagctgctcaccatgcagttggtggactggcatcagctccaagcagactccttcatccaggatgagagactgcgcatctttgctctgttggctggaaaaccggtgtggcagctctcagaaaagaagcaaataaacgtgtgctcccagttggattggaaacgctccctggctatccatctttggtatttgcttccaccaacagcctccatttctagggcgctcagcatgtatgaagaagcatttcagaatacctctgacagtgacagatatgcctgctccccacttccttcgtatctggagggttctggctgtgtgatagcggaggagcaaaactcacagacaccacttcgagatgtctgctttcaccttctaaaactctacagtgacagcatacgtgagaaggctgttcgagagctgcttacccggcactgccagctgttggagacccctgaatcttgggctaaagagactttccttacccagaagctccgtgtacctgccaaatggatccacgaggccaaagctgtgcgagcacacatggaatctgacaagcacttagaggccctttgcttatttaaggctgagcactggaaccgctgccacaagctcatcatccgacacttagcttctgatgccatcattaatgagaactatgactacctgaaggggttcttggaagacctggcacctccagagcgcagcagcctaattcaggattgggaaacatctgggcttgtttacctggactatattagagtcattgaaatgctccgccatatacagcaggtggattgctcaggtaatgacctggagcagttacacatcaaagtgacttcactgtgcagtcggatagagcagattcagtgttacagtgctaaagatcgcctggctcagtcagacatggccaaacgtgtagccaacctgctgcgcgtggtgctgagtctgcatcatcctcctgatagaacctccgactcaacaccagaccctcagcgagtccctttgcgcctcttggctccccacattggccggcttcccatgcctgaggactatgccatggacgaactgcgcagccttacccagtcctatctgcgagaactggctgttgggagcctgtgagccccaggcactttgcatcacagtcacatgcccattcacaccacacagaggttccctgccttgtttggattggcactgtttgccattctctgggttggctgtggcatctaccctccctccctgctgccagaagcagcatcctccacttgttcagggcttttcttaatactgaacgtagcataagggcttctggaacccagaagaggagacagtttaccatcctcaagatcattcagtgtttttcctttaaaaaaatggtcaataaagctcctttggcagaatcccccaaagaaccagggtattctttttccatccctagccattctggatcttgtgaccctccatgccaaccagcttccc

SEQ ID NO: 20923 - DNA, 6770 bp, Homo sapiens
aaccgcggcggcgaggggcgggactccacggccctctcaccgctcctaccctgtgcctccccgaactccttctgcccctcctcttccctctcgccccttcccccttcagttcggtttcaaaagacgcgttgcccaatgaataacagggtcgacccagagtggcggccgcgtccaccaattcgcggacggcgagggcggagcgtccgcaacgagcctctgacgccgggcggcgtgtgacgcagtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcagagccagagcccagaggtggagcagttagggagggttgtggaactggacagtgacatggtagatatcacccaggagccagttttggataccatgttagaagagagcatgcctgaggatcaggaacctgtgtctgcctcaacacatattgcatcttcactgggaattaatccacatgtcttacagatcatgaaagcatcattgcttactgatgaagaagatgtagatatggcactggatcaacgcttcagtcgcctgccttccaaagcagatacttctcaagaaatctgttctcccagactccccatttcagcatcccactcgtcgaaaactcgttcactagttggtgggttactacaatcaaaatttacaagtggagcttttctttcaccaagtgtctctgtgcaagaatgtcgtactcccagagcagcatctttaatgaatatcccatccacatcctcttggtctgtccctccacccctgacttctgtgttcacaatgcccagcccagcccctgaggttccgttgaaaacagtgggtacacgtaggcaactaggcctagtccctcgtgaaaagtctgtcacctatggcaagggaaaactcttgatggacatggccctattcatgggacgctcatttcgtgttggttggggccccaactggactcttgctaatagtggagaacagctgaatggctctcatgaactagaaaatcatcagattgccgattccatggagtttggattcctgcccaatccagtagctgttaaacccctaactgagtccccattcaaagttcacttagaaaaactcagtttgagacaaagaaagccagatgaagacatgaaattatatcagacacctctggagctcaaattaaaacacagcactgtccatgtggatgaactgtgtcctctcattgtccccaatctgggagttgctgtcattcatgactatgcagattgggttaaagaagcatcaggagacttaccagaagcacaaattgtgaagcactggagcctgacatggacactatgtgaagccctatggggccacctgaaggagcttgacagccagctaaatgaaccccgtgaatacattcaaattctggagcgaagaagagctttctcccgctggctatcctgtactgccacacctcagattgaagaggaagtctccttaacccaaaaaaacagccctgtggaggctgtattcagctacctcacaggcaaaaggatcagtgaggcctgctctctggcccagcagtcaggggatcatcgtcttgctcttcttttatctcagtttgtgggtagccagtcagtccgggagctgctcaccatgcagttggtggactggcatcagctccaagcagactccttcatccaggatgagagactgcgcatctttgctctgttggctggaaaaccggtgtggcagctctcagaaaagaagcaaataaacgtgtgctcccagttggattggaaacgctccctggctatccatctttggtatttgcttccaccaacagcctccatttctagggcgctcagcatgtatgaagaagcatttcagaatacctctgacagtgacagatatgcctgctccccacttccttcgtatctggagggttctggctgtgtgatagcggaggagcaaaactcacagacaccacttcgagatgtctgctttcaccttctaaaactctacagtgacagcatacgtgagaaggctgttcgagagctgcttacccggcactgccagctgttggagacccctgaatcttgggctaaagagactttccttacccagaagctccgtgtacctgccaaatggatccacgaggccaaagctgtgcgagcacacatggaatctgacaagcacttagaggccctttgcttatttaaggctgagcactggaaccgctgccacaagctcatcatccgacacttagcttctgatgccatcattaatgagaactatgactacctgaaggggttcttggaagacctggcacctccagagcgcagcagcctaattcaggattgggaaacatctgggcttgtttacctggactatattagagtcattgaaatgctccgccatatacagcagatagcactgttttgtgtagagtggattgctcaggtaatgacctggagcagttacacatcaaagtgacttcactgtgcagtcggatagagcagattcagtgttacagtgctaaagatcgcctggctcagtcagacatggccaaacgtgtagccaacctgctgcgcgtggtgctgagtctgcatcatcctcctgatagaacctccgactcaacaccagaccctcagcgagtccctttgcgcctcttggctccccacattggccggcttcccatgcctgaggactatgccatggacgaactgcgcagccttacccagtcctatctgcgagaactggctgttgggagcctgtgagccccaggcactttgcatcacagtcacatgcccattcacaccacacagaggttccctgccttgtttggattggcactgtttgccattctctgggttggctgtggcatctaccctccctccctgctgccagaagcagcatcctccacttgttcagggcttttcttaatactgaacgtagcataagggcttctggaacccagaagaggagacagtttaccatcctcaagatcattcagtgtttttcctttaaaaaaatggtcaataaagctcctttggcagaatcccccaaagaaccagggtattctttttccatccctagccattctggatcttgtgaccctccatgccaaccagcttccctactcctaccctggcccttttatactaggactccttaggaggagtgagacaggtgataatggatccttaacagatgaactatccacagaaggaagagggatccgtctcttaagtaattggttagttaacactgaattttggaggcaaaggagggttggcctgagttaggaaacaaaatgggatctttctgacacacttagggcagaagtgaatgcctgtcacggagggattgatcttcagggctgtttttgttcctgcctttagagttccatgaacaccatacctttgctactactatgtgcaggaacccttggtcacatgtgacatgtctgtgggaagctcccagagtttggtttggtccctggttttcagtcttgctgagactctgtctggatttgcctgcagagtttggataaaaaatggcaggttgggtaaccctccctgttcatcccatgttagctccaaagcatttcccaccctccatctaccccttccagaagcaaaaacaaaccatgactgaggcaggcatggagttgggcgttaggggcaggcagagggcctttgctacactgctgacagctatagggagccccaggtaatggcatgagatagctggtgttagggctatctcaggcaatatggccacacctgggtctttatgcatgaagataatgtaaaggtttttattaaaaaatatatatatgtataaataaatgatctagatattttcctctttttctgaagctactttcttaaaaaataaataaaatgtttatagcattcctggt

SEQ ID NO: 20924 - DNA, 3923 bp, Homo sapiens
ctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcaggtagagaaaaaaggacagtgaatttgaatggaatccgtgataccgaagttgaaagcaagtcattcagctaatacaaagctgttttatgacccttggaactttgaagagtacaaacattggcaatcacgttgaaacaagtgcaagggagggcgtgaggtcttgcaggcatctgtctttttactggagagatttaaagaattctcttgctgtttggattattcctctacagattgtcatttttaaaccctttgttctctctcatttggacttgctgaattctctgctcagtgattaacttaagatttgctcatgtgggttcatgcacagtaaattctgcctttattgactacctgatgtgcagtttaatctttttctttacctccatggttttttaaaagttaaattagctttctgaaagggtttttaatctccatttttttaaagttgtttgcttatacttcgggtaaccttgatatttgtattttaatagtacataatctttatgaaaaatagtttgggaatgtaaatgaattattatttggcttggggagattagggcctacattgtttatcgcaattacttgtatcattgatacgggatttctttgtaaagcatcctctacctctcagctgctgaaagctagacctttggtattttccatgctataattcttatggctgctgaaatgtgtggtttttatgatttattaaataatctcttaggaggcatttctggagaatgtgtgtatatacatgtttgcgcgtacaggggaggggagggtatgataaatgtgggaaactggaaatatattgacttttatgtttataatcttggtagcatttagaatgcccctaagaaatctccattgacaaatgaaatgctatagacttggttttccagttatccatattcattttgtctgtcatatgctttgtatcatctccttctttcctaattttttataaccttatatatatatttattataaatatatgtatttctgagggaaa

SEQ ID NO: 20925 - DNA, 3698 bp, Homo sapiens
ggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttccccaccgaaccgcgctttctgaaacaaagactcattttgaagatgtttaacaaatcatttggaacaccctttgggggtggcacaggtggctttggcacaacttcaacatttggacagaatactggctttggcactactagtggaggggcatttggaacatctgcatttggttctagcaacaatactggaggcctctttggaaattcacagactaaaccaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcaattttggaaccagtactagcagtggaggactctttggaaccacaaataccacctctaatccttttggcagcacatctggctccctctttgggccaagtagttttacagctgctcctactgggactactattaaatttaaccctccaactggtacagatactatggtcaaagctggagttagcactaacataagtaccaagcaccagtgtattactgctatgaaagaatatgaaagcaagtcactagaggaacttcgtttagaggattatcaggctaacaggaagggcccacagaaccaggtgggagcaggtaccacaactggcttgtttgggtcttctccagccacttccagcgcaacaggactcttcagctcctccaccactaattcaggctttgcatatggtcagaacaaaactgcctttggaactagtacaactggatttggaacaaatccaggtggtctctttggccaacagaatcagcagactaccagcctcttcagcaaaccatttggccaggctacaaccacccagaacactggcttttcctttggtaataccagcaccataggacagccaagcaccaacaccatgggattatttggagtaacccaagcctcacagcctggaggtctttttgggacagctacaaacaccagcactgggacagcatttggaacaggaacaggtctctttgggcagaccaatactggatttggtgctgttggttcgaccctgtttggcaataacaagcttactacatttggaagcagcacaaccagtgcaccttcatttggtacaaccagtggcgggctctttggtaacaaaccaaccctgactttaggaaccaatacaaacacttctaattttggttttggcacaaataccagtgggaatagtatttttggaagtaaaccagcacctgggactcttggaactgggcttggtgcaggatttggaacagctcttggtgctggacaggcatctttgtttgggaacaaccaacctaagattggagggcctcttggtacaggagcctttggggcccctggatttaatactacgacagccactttgggctttggagccccccaggccccagtagctttgacagatccaaatgcttctgctgcccagcaggctgttctccagcagcacatcaatagtctaacatactcaccttttggagactctcctctcttccggaatccgatgtcagaccctaagaagaaggaagagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagaagagcattaagaagttggttttgaagaaccttaataatagcaatctcttttctcctgttaatcgtgattcagaaaatctagcttcaccatctgaatatccagaaaatggagagagatttagtttcctaagcaaacctgttgatgagaatcaccagcaggatggagatgaagattcccttgtttcacatttttatactaaccctattgccaaacctattcctcaaaccccagaaagtgctggaaataaacacagcaacagcaacagtgtggatgataccattgttgcattaaacatgcgtgctgctttgcgaaatgggctggaaggaagcagtgaagaaacgtcttttcatgatgagtcacttcaggatgaccgagaagaaatagaaaataattcttaccatatgcacccagcaggtattattctcactaaggttggttactatactattccatctatggatgaccttgctaaaattaccaatgaaaaaggagagtgcattgtctctgatttcactattggtcggaaaggttatggttcaatctattttgaaggagatgtgaatttgacaaatctaaatttggatgatattgtgcatatccggaggaaagaagtagttgtctacttagatgataaccaaaaaccacctgtgggtgaagggctaaataggaaggctgaagttacattggatggagtttggccaacagataaaacatctcgttgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgcagatggctcttaatggcaaacctgcacctccacctcaggtagagaaaaaaggacagtgaatttgaatggaatccgtgataccgaagttgaaagcaagtcattcagctaatacaaagctgttttatgacccttggaactttgaagagtacaaacattggcaatcacgttgaaacaagtgcaagggagggcgtgaggtcttgcaggcatctgtctttttactggagagatttaaagaattctcttgctgtttggattattcctctacagattgtcatttttaaaccctttgttctctctcatttggacttgctgaattctctgctcagtgattaacttaagatttgctcatgtgggttcatgcacagtaaattctgcctttattgactacctgatgtgcagtttaatctttttctttacctccatggttttttaaaagttaaattagctttctgaaagggtttttaatctccatttttttaaagttgtttgcttatacttcgggtaaccttgatatttgtattttaatagtacataatctttatgaaaaatagtttgggaatgtaaatgaattattatttggcttggggagattagggcctacattgtttatcgcaattacttgtatcattgatacgggatttctttgtaaagcatcctctacctctcagctgctgaaagctagacctttggtattttccatgctataattcttatggctgctgaaatgtgtggtttttatgatttattaaataatctcttaggaggca

SEQ ID NO: 20926 - DNA, 2664 bp, Homo sapiens
agccttgccttcgccgccgttggggctggaagttcccgccaggtccgtgccgggcgagagagatgctgcccggcccgcctcggctttgaggcgagagaagtgtcccagacccatttcgccttgctgacggcgtcgagccctggccagacatgtccacagggttctccttcggaacgggagcgtctagcaacccttctgtggggctcaattttggaaatcttggaagtacttcaactccagcaactacatctgctccttcaagtggttttggaaccgggctctttggatctaaacctgccactgggttcactctaggaggaacaaatacaggaatagcaacaactataactacaggattaactctgggaacgccagccactacatctgcagctacaacaggcttcagtttaggattcaataaacctgcagcatctgccacaccatttgctctacctattacctctacctcagctagcggtctgactctttcgtctgctctgacatcaactccagcagcatccacaggatttactctaaataatttgggtgggacaacagccacaactacaactgcatcaacaggcctctctttagggggagccttagctggtttgggaggttcacttttccagagtacaaacacaggaacatcaggacttggacagaatgctttagggttgactttgggaactacagcagctacttcaactgcaggcaatgaaggccttggtggtatagatttcagtagctcctcagataaaaagagtgataaaacgggaacaagaccagaggatagtaaagctctgaaggatgaaaatctacctcctgtcatctgccaggatgttgaaaatctccagaaatttgtgaaggagcagaaacaagttcaagaagaaattagtagaatgtcttcaaaagcaatgcttaaggtacaagaagatattaaagctctgaagcagctcctgtcgttggctgccaatggaatacagagaaacactctcaacattgacaaattgaaaatagaaactgctcaggagttgaagaatgctgaaatagctttaagaacccagaagacaccacctggacttcaacatgaatatgcagctcctgctgactacttcagaatcttggttcagcaatttgaggtacagcttcagcagtacaggcagcagattgaagaactagaaaaccatcttgccactcaagcaaataattcacatataacccctcaagatttgtcaatggctatgcagaaaatttatcaaacatttgtagctttagcggcacaacttcagtctattcatgaaaatgtaaaggttctgaaagaacagtaccttggctacaggaaaatgttcttgggagatgctgttgatgtgtttgaaacaaggcgagcagaagccaagaagtggcagaacacacccagagttactactggacccactcctttcagcaccatgccaaacgcagcagccgttgccatggctgcaacacttacacagcagcaacagcctgctacagggccacagccatctctgggagttagttttggaacgccattcggctcaggtattggcactggcttgcaatcaagtggcttaggttcttcaaaccttggaggatttggaactagctctggttttggatgcagcaccacaggggcctccacatttggatttggaacaacaaataaaccctcaggaagtcttagtgcaggctttggcagctcaagtacatctgggtttaacttcagcaatcctggcatcacggcatcagctggtttgacttttggggtgtccaatcctgcctctgcaggttttggaacaggaggacaactccttcagttgaagaaacctccagctggaaacaaaagaggaaaaagataaacatgggttgatgtgttgagagaatccatagcagcaccgttcattctatgagtctatttttctaatgatgcagtaattaaattgcatcccaggagatttataaagttttgatatttttccctactctggaatttgaactttcttcatgtttgccatactgaacatcttttttcttgtggaatttaaagtccagctgtgttttctttttaatttgattctcagtgtaagaaatgttctgattacatcactgattggtaatggttagaaaccattaacctaaaacttactatttaacctagtgtttttgttgatgaggtttacattatgtgaatacatgcacatttgtttcttatacaggtggtgtgaactctagggcctatactagaatcaatttgttccttgttaaaggccttttgaattatactgcagggcatcttgtgaatatgtatgtaaatatatacagaataatacacacagttgtgtgtgcatataaaatacatatttacgccaggcgtggtggctcacgcctgtaatcccagcactttgggaggccgaggcaggcggatcacctgaggtcaggagtttgagaccagcctgacatggtgaaaccccatctctacgaaaaatacaaaaattagctgggcatagtggcgggtacctataatcccagctactcgggaggctgaggcacgagaatcacttgaagccgggaggtgggggttgcagtgagccgagatcacaccactgcactccagcctgggcaacaagagcaaaactccgtctc

SEQ ID NO: 20927 - DNA, 2489 bp, Homo sapiens
cttcgccgccgttggggctggaagttcccgccaggtccgtgccgggcgagagagatgctgcccggcccgcctcggctttgaggcgagagaagtgtcccagacccatttcgccttgctgacggcgtcgagccctggccagacatgtccacagggttctccttcgggtccgggactctgggctccaccaccgtggccgccggcgggaccagcacaggcggcgttttctccttcggaacgggagcgtctagcaacccttctgtggggctcaattttggaaatcttggaagtacttcaactccagcaactacatctgctccttcaagtggttttggaaccgggctctttggatctaaacctgccactgggttcactctaggaggaacaaatacaggaacgccagccactacatctgcagctacaacaggcttcagtttaggattcaataaacctgcagcatctgccacaccatttgctctacctattacctctacctcagctagcggtctgactctttcgtctgctctgacatcaactccagcagcatccacaggatttactctaaataatttgggtgggacaacagccacaactacaactgcatcaacaggcctctctttagggggagccttagctggtttgggaggttcacttttccagagtacaaacacaggaacatcaggacttggacagaatgctttagggttgactttgggaactacagcagctacttcaactgcaggcaatgaaggccttggtggtatagatttcagtagctcctcagataaaaagagtgataaaacgggaacaagaccagaggatagtaaagctctgaaggatgaaaatctacctcctgtcatctgccaggatgttgaaaatctccagaaatttgtgaaggagcagaaacaagttcaagaagaaattagtagaatgtcttcaaaagcaatgcttaaggtacaagaagatattaaagctctgaagcagctcctgtcgttggctgccaatggaatacagagaaacactctcaacattgacaaattgaaaatagaaactgctcaggagttgaagaatgctgaaatagctttaagaacccagaagacaccacctggacttcaacatgaatatgcagctcctgctgactacttcagaatcttggttcagcaatttgaggtacagcttcagcagtacaggcagcagattgaagaactagaaaaccatcttgccactcaagcaaataattcacatataacccctcaagatttgtcaatggctatgcagaaaatttatcaaacatttgtagctttagcggcacaacttcagtctattcatgaaaatgtaaaggttctgaaagaacagtaccttggctacaggaaaatgttcttgggagatgctgttgatgtgtttgaaacaaggcgagcagaagccaagaagtggcagaacacacccagagttactactggacccactcctttcagcaccatgccaaacgcagcagccgttgccatggctgcaacacttacacagcagcaacagcctgctacagggccacagccatctctgggagttagttttggaacgccattcggctcaggtattggcactggcttgcaatcaagtggcttaggttcttcaaaccttggaggatttggaactagctctggttttggatgcagcaccacaggggcctccacatttggatttggaacaacaaataaaccctcaggaagtcttagtgcaggctttggcagctcaagtacatctgggtttaacttcagcaatcctggcatcacggcatcagctggtttgacttttggggtgtccaatcctgcctctgcaggttttggaacaggaggacaactccttcagttgaagaaacctccagctggaaacaaaagaggaaaaagataaacatgggttgatgtgttgagagaatccatagcagcaccgttcattctatgagtctatttttctaatgatgcagtaattaaattgcatcccaggagatttataaagttttgatatttttccctactctggaatttgaactttcttcatgtttgccatactgaacatcttttttcttgtggaatttaaagtccagctgtgttttctttttaatttgattctcagtgtaagaaatgttctgattacatcactgattggtaatggttagaaaccattaacctaaaacttactatttaacctagtgtttttgttgatgaggtttacattatgtgaatacatgcacatttgtttcttatacaggtggtgtgaactctagggcctatactagaatcaatttgttccttgttaaaggccttttgaattatactgcagggcatcttgtgaatatgtatgtaaatatatacagaataatacacacagttgtgtgtgcatataaaatacatatttacgccaggcgtggtggctcacgcctgtaatcccagcactttgggaggccgaggcaggcggatcacctgaggtcaggagtt

SEQ ID NO: 20928 - DNA, 4322 bp, Homo sapiens
actcacgtaccagggctcattgcgtgacggttacacttccggcgggctacgtgcgcgcggcgagcgccgggcgtacttttgcgtggttgctccaccccctcagccttgccttcgccgccgttggggctggaagttcccgccaggtccgtgccgggcgagagagatgctgcccggcccgcctcggctttgaggcgagagaagtgtcccagacccatttcgccttgctgacggcgtcgagccctggccagacatgtccacagggttctccttcgggtccgggactctgggctccaccaccgtggccgccggcgggaccagcacaggcggcgttttctccttcggaacgggagcgtctagcaacccttctgtggggctcaattttggaaatcttggaagtacttcaactccagcaactacatctgctccttcaagtggttttggaaccgggctctttggatctaaacctgccactgggttcactctaggaggaacaaatacaggaatagcaacaactataactacaggattaactctgggaacgccagccactacatctgcagctacaacaggcttcagtttaggattcaataaacctgcagcatctgccacaccatttgctctacctattacctctacctcagctagcggtctgactctttcgtctgctctgacatcaactccagcagcatccacaggatttactctaaataatttgggtgggacaacagccacaactacaactgcatcaacaggcctctctttagggggagccttagctggtttgggaggttcacttttccagagtacaaacacaggaacatcaggacttggacagaatgctttagggttgactttgggaactacagcagctacttcaactgcaggcaatgaaggccttggtggtatagatttcagtagctcctcagataaaaagagtgataaaacgggaacaagaccagaggatagtaaagctctgaaggatgaaaatctacctcctgtcatctgccaggatgttgaaaatctccagaaatttgtgaaggagcagaaacaagttcaagaagaaattagtagaatgtcttcaaaagcaatgcttaaggtacaagaagatattaaagctctgaagcagctcctgtcgttggctgccaatggaatacagagaaacactctcaacattgacaaattgaaaatagaaactgctcaggagttgaagaatgctgaaatagctttaagaacccagaagacaccacctggacttcaacatgaatatgcagctcctgctgactacttcagaatcttggttcagcaatttgaggtacagcttcagcagtacaggcagcagattgaagaactagaaaaccatcttgccactcaagcaaataattcacatataacccctcaagatttgtcaatggctatgcagaaaatttatcaaacatttgtagctttagcggcacaacttcagtctattcatgaaaatgtaaaggttctgaaagaacagtaccttggctacaggaaaatgttcttgggagatgctgttgatgtgtttgaaacaaggcgagcagaagccaagaagtggcagaacacacccagagttactactggacccactcctttcagcaccatgccaaacgcagcagccgttgccatggctgcaacacttacacagcagcaacagcctgctacagggccacagccatctctgggagttagttttggaacgccattcggctcaggtattggcactggcttgcaatcaagtggcttaggttcttcaaaccttggaggatttggaactagctctggttttggatgcagcaccacaggggcctccacatttggatttggaacaacaaataaaccctcaggaagtcttagtgcaggctttggcagctcaagtacatctgggtttaacttcagcaatcctggcatcacggcatcagctggtttgacttttggggtgtccaatcctgcctctgcaggttttggaacaggaggacaactccttcagttgaagaaacctccagctggaaacaaaagaggaaaaagataaacatgggttgatgtgttgagagaatccatagcagcaccgttcattctatgagtctatttttctaatgatgcagtaattaaattgcatcccaggagatttataaagttttgatatttttccctactctggaatttgaactttcttcatgtttgccatactgaacatcttttttcttgtggaatttaaagtccagctgtgttttctttttaatttgattctcagtgtaagaaatgttctgattacatcactgattggtaatggttagaaaccattaacctaaaacttactatttaacctagtgtttttgttgatgaggtttacattatgtgaatacatgcacatttgtttcttatacaggtggtgtgaactctagggcctatactagaatcaatttgttccttgttaaaggccttttgaattatactgcagggcatcttgtgaatatgtatgtaaatatatacagaataatacacacagttgtgtgtgcatataaaatacatatttacgccaggcgtggtggctcacgcctgtaatcccagcactttgggaggccgaggcaggcggatcacctgaggtcaggagtttgagaccagcctgacatggtgaaaccccatctctacgaaaaatacaaaaattagctgggcatagtggcgggtacctataatcccagctactcgggaggctgaggcacgagaatcacttgaagccgggaggtgggggttgcagtgagccgagatcacaccactgcactccagcctgggcaacaagagcaaaactccgtctcaaaaaagatgaaaataaaataaaatatatatttacaggcctacaacttttgcctcagactgttccccttttctaagggtattcaagttttcaccttttaagcttcatatcctcagtgcttgtagaatgatgagcttagaggtaccaggtcattgcagttgtttgcttaaagacttattgaaatggttactggcgtaaatacttggccaactcaactttattgcccctgatcttttccatttttgtttccaccttaacctatagcagctcctccaaatgaggaatgctgtaagtaagactcatcaaacagattttaaccattttattatcctgtgtgtccttacattgcttctgtgagatgtttttttcttatctgagatgaactttcaggagcctatttgaactccagactggtgttctggggcaaagagctattagccaaactgattctatgcaggtgaaggatgcactaaagttctcactttagtgagaacttttctagctattccaatacagagttctttcttatagggctattgatattgacaccaaatggagtggcttctcagcctcttaatgtcttaagtaagtgcttaatttggaatagagaaaccagtatattttaaaaaagaaaaatattctttgtagcaactgtaaattctcccattataacagtgaacagagctccaggtaataacgcataggcatgtcaggttgcatctgtatatttgactacattagtattagtgacatcaggtggatataaaagaaaacccttggaaagagaactgccttagccatgatttcgttagtagacctatttatgattcaattgcaattttcagataggatgtgaacatggaatttcattgaaaatagtttaattttttatataaaaggttttgtatataatgtgtgtcagtgactattttcaaaatcattttcatcaagacaccttttttctaaaataggcattgcatacacatatgcacacgtatgtgcatgtgccacacattttttgtataatgttgggtttgattataaaagtgttgtcaaatgttttatttatctgcatatagcagtggttggcttttttgaattgaaatttttgcgcattgatgcattgaaataaggaaaattatttatctctgagcactaaacttatttttgcatatttctgtaatattgcagtccccagatccagaacatgggaagttagggaaaatgtgtgattttgtgttttgaattactgtcagaattacatacacaattacaacaaactttttttaaaagacatttcattgtactgcaaaaatctgaatatttatatttcttgtttttttctttatatgttttgcattttaatatgttgagccactggaaatttgtaacagattaatttgttataggagtttaaatgtgttgtcattgtctccattgtctttgtccagagcctattattatggaaacaataaaatttattgtgtca

SEQ ID NO: 20929 - DNA, 1761 bp, Homo sapiens
acgtaccagggctcattgcgtgacggttacacttccggcgggctacgtgcgcgcggcgagcgccgggcgtacttttgcgtggttgctccaccccctcagccttgccttcgccgccgttggggctggaagttcccgccaggtccgtgccgggcgagagagatgctgcccggcccgcctcggctttgaggcgagagaagtgtcccagacccatttcgccttgctgacggcgtcgagccctggccagacatgtccacagggttctccttcgggtccgggactctgggctccaccaccgtggccgccggcgggaccagcacaggcggcgttttctccttcggaacgggagcgtctagcaacccttctgtggggctcaattttggaaatcttggaagtacttcaactccagcaactacatctgctccttcaagtggttttggaaccgggctctttggatctaaacctgccactgggttcactctaggaggaacaaatacaggaacgccagccactacatctgcagctacaacaggcttcagtttaggattcaataaacctgcagcatctgccacaccatttgctctacctattacctctacctcagctagcggtctgactctttcgtctgctctgacatcaactccagcagcatccacaggatttactctaaataatttgggtgggacaacagccacaactacaactgcatcaacaggcctctctttagggggagccttagctggtttgggaggttcacttttccagagtacaaacacaggaacatcaggacttggacagaatgctttagggttgactttgggaactacagcagctacttcaactgcaggcaatgaaggccttggtggtatagatttcagtagctcctcagataaaaagagtgataaaacgggaacaagaccagaggatagtaaagctctgaaggatgaaaatctacctcctgtcatctgccaggatgttgaaaatctccagaaatttgtgaaggagcagaaacaagttcaagaagaaattagtagaatgtcttcaaaagcaatgcttaaggtacaagaagatattaaagctctgaagcagctcctgtcgttggctgccaatggaatacagagaaacactctcaacattgacaaattgaaaatagaaactgctcaggagttgaagaatgctgaaatagctttaagaacccagaagacaccacctggacttcaacatgaatatgcagctcctgctgactacttcagaatcttggttcagcaatttgaggtacagcttcagcagtacaggcagcagattgaagaactagaaaaccatcttgccactcaagcaaataattcacatataacccctcaagatttgtcaatggctatgcagaaaatttatcaaacatttgtagctttagcggcacaacttcagtctattcatgaaaatgtaaaggttctgaaagaacagtaccttggctacaggaaaatgttcttgggagatgctgttgatgtgtttgaaacaaggcgagcagaagccaagaagtggcagaacacacccagagttactactggacccactcctttcagcaccatgccaaacgcagcagccgttgccatggctgcaacacttacacagcagcaacagcctgctacaggtgataagtggtgtaatgtagcagagcttaagaatagaactcaattatcactttttgtgaacaagttggaattgtcatgttactgtgtaattgatttgctttacaatgaacaataa

SEQ ID NO: 20930 - DNA, 6360 bp, Homo sapiens
gccttcgccgccgttggggctggaagttcccgccaggtccgtgccgggcgagagagatgctgcccggcccgcctcggctttgaggcgagagaagtgtcccagacccatttcgccttgctgacggcgtcgagccctggccagacatgtccacagggttctccttcgggtccgggactctgggctccaccaccgtggccgccggcgggaccagcacaggcggcgttttctccttcggaacgggagcgtctagcaacccttctgtggggctcaattttggaaatcttggaagtacttcaactccagcaactacatctgctccttcaagtggttttggaaccgggctctttggatctaaacctgccactgggttcactctaggaggaacaaatacaggaatagcaacaactataactacaggattaactctgggaacgccagccactacatctgcagctacaacaggcttcagtttaggattcaataaacctgcagcatctgccacaccatttgctctacctattacctctacctcagctagcggtctgactctttcgtctgctctgacatcaactccagcagcatccacaggatttactctaaataatttgggtgggacaacagccacaactacaactgcatcaacaggcctctctttagggggagccttagctggtttgggaggttcacttttccagagtacaaacacaggaacatcaggacttggacagaatgctttagggttgactttgggaactacagcagctacttcaactgcaggcaatgaaggccttggtggtatagatttcagtagctcctcagataaaaagagtgataaaacgggaacaagaccagaggatagtaaagctctgaaggatgaaaatctacctcctgtcatctgccaggatgttgaaaatctccagaaatttgtgaaggagcagaaacaagttcaagaagaaattagtagaatgtcttcaaaagcaatgcttaaggtacaagaagatattaaagctctgaagcagctcctgtcgttggctgccaatggaatacagagaaacactctcaacattgacaaattgaaaatagaaactgctcaggagttgaagaatgctgaaatagctttaagaacccagaagacaccacctggacttcaacatgaatatgcagctcctgctgactacttcagaatcttggttcagcaatttgaggtacagcttcagcagtacaggcagcagattgaagaactagaaaaccatcttgccactcaagcaaataattcacatataacccctcaagatttgtcaatggctatgcagaaaatttatcaaacatttgtagctttagcggcacaacttcagtctattcatgaaaatgtaaaggttctgaaagaacagtaccttggctacaggaaaatgttcttgggagatgctgttgatgtgtttgaaacaaggcgagcagaagccaagaagtggcagaacacacccagagttactactggacccactcctttcagcaccatgccaaacgcagcagccgttgccatggctgcaacacttacacagcagcaacagcctgctacaggtctgaacgcattcaagttatagcttcttactgttccaatgcagaacatttatgtgcgtttttataagtcttccatttgtgtgagcactgaagaaatttctatgagtagctgttccaatacaatctaaaattgtgatggacacgattataaacatacctgataaaaaaggcagggtagtcttagcaataattatacatcaattagatattgaatattgtgaatctacttaatgttatttgctgtaatgctataaatgccctttagaacatggtgtttcactagtgaattacatttaagaataacattagattctgaaatcatgactgtaccatttattgttttaaagtcagagatcatccatccattctttgaatttttcatatatgatactgataggtggtgcattctcattttcctcatacatagtgattacaaagtacccacattcaggatgaagtatgcttttattgactgaaggtatgttgaagatcaataggcttgtttgtatgtatgttgactgtaaacagaatacaagccctctaaaccaaattttgaagatgatacatgctagaattgtacctttccaaggtgaacagaacagcaagagcaggaaaaagatgttttgagatgtggattgcacattaaggagcaactgggaagttgaacagatgaaaataattggtgacatggaaagcagattgttttatttcttggtttagttacacttctaattagagaaacattttttgtggtcattctacagtgttttatttggtcctgtgtctttcggaggttaatagttatcttaatcctgccatcccttttgtcaggtttgaagcttgacatggaaaaatagtcttaatcgatattgatttttttattttaatcattcataaatttcttagtaatgcttactattcaatagcatgtgtctttctgagagttccatatagtccagtagtacattataatacacacaaaaaaattaatacatatttagattgcattcaagctacctatactagggaagcattctctggttttcactattggcagtttaaaaaattgttcttcacatttggagatgacagaattgacttgccataagtaaagggttgatgatagatttatgccaaatcctccatatcccgtggctggacccatgtgaatagtggctcgcacgagcactgtctggtagctctctagctggctggagtgtaggattgcattgttaagttatggagggaaaaagtcattatgggattgattcctttgaggattgatatttcttcttaaaaggattcaatcccataattatgaccatcagctctcatgattacctaaccagttaatcaaaccaaccatagtactagtttactttttagagccagtattaatcctaaagtagataagtgtagatttggttaagtgttctttaaacatagtgaatttccattctattaaatagaacttgagaaatgtcagttatataaaaagttatgttgtaagtgaatatattctatgataaatacctaaacttgaagcaaaatctcctgtcaagggtttgtgtgtgtgtgtgtgtttaactttcttatctatagattattattttgagaaattcataggttttcacttatacattttgagcttgtggacatatggagatgtgtgttcattctctaaatgagtgcctactatgtgctgggctcgaggaatacaaaggtagacaatatagattttgtctttgccctctgtggtggttgacaatgttagcttaatctggagtattcttgaggagccttttgctcataggctttaattttgtctgtgacttttgccaggctttggggaaattgactgccttcactcttccctgaaactttgaagtccacataagggctttctcatcagatggcagaaattataatttattaacctaaacaaccttacagtgttttcgctttgaattgtatgaattcttagaactgagaagctaaacaacagtgataacaattttacattatcttttctttctccttttgtttctctaaaggtctcccaggccttcccagtcaaaattttcgttatttttagtcatgtcaccatgatgtgagatttctgagctctgttagatacatttagaaatgtccctatttatcaaatggtgttttgtaccccataagttatcccttatgccctgtgacttctgtgaaatctttgtttttaagtgccagtaacaaattttagaccatctagatgagggtagagagagcttatgcattgtttttatacatcactgttgatctatacaagatttgagttatcagaagggttttgcttttatttgcatatgaaatttttattaacatgaatatgggcacagagcaaatagcttcttagactgctgccttctgaaggtggcttctgtatctttctcagaggaggaggaatagacttaaacgacttctttgtcctccttcaattttttttttaatgaaaaagtatactagggcttaggcatgtgtgatttacagttatttgttctgaaggctgcagagaattgaaaatccagcaggctatttgtgtatgaaatcatgagcatcgataacgtggataacgtagttccatgttggcagaacttgacacttgtctataagtgcttcccaagcctcctgaaaaactgaagacatttacattaggcttttcagtataattttaatttaggataggttttttagcaatgtatctgggattgagttttgctattgtgttttgacactttaagagttcttgatgtttacataataagactttcttatgtgacttagctgctgttttaaggagagccaagacgttttgttaggaattcctaatttttagcttagtgtaggtttggacatttaaggtgtagtgttaaataggaaacattaagtatttcatcttagtttcttgtggttttgtgattttgttgtatttaataaccaaaggaacattccccattaaatcagtaagagtaaaatttttcaaactggggaaaacgcattttaggttttttaaagaaaaattattttaaaatgtgacttagaaataaccatactaattacattaggcatttggggtgatcatggaaaattataaaatatttttagcactttagtcctttttctgttaatgcagttttacttttaagaaagtaaaatttattctggaaaatatgaattacagcgctaaacctggttttgttgtgtgtgaatatattatatggtaacttttgtaaaatgttactctacatgaagatttcactttggccagtcattggtatatatcactacaaacttaattttatttatggaaataagaacctctcattggatgactattcaaatttcaaagcagacttcttgaattgtttacgtaacttttgcctgaaggatttagactgctttctaatagtgaaactaatatatatggtggccagagtgtaatatatgctaatactttggcatgggagatatttatcatgagtttttactattaaaaaatgttatacatttgcctacgagttttataaatgatgttgccttcagaatttgtgtgaaggtacaaaactaaaaatatcatgtatctgatgtgcaatggaaagtcttgtcatcattagatatgagttcttgattatattctgaatattgatgattagaaaaatcttatgttctgttgctcttaacaacagacccacacacaacaaaaagcatgctatttgagtaactcttacgacttacaaggctgagggctgtggtgtgcattattctttagggtcttccaccagcagtgcctcctattaacctgtgacaaacaagtctctcaatgttaaagaactggacatgtgttttttatgttttttgttaggaatcagaaagtataataatatgcttggtttctttttcctatagtaacattttacaaaagagctgctaggcaggtattttattctcaaagtgatctcaaactggatgtaaaattttaaattatttttttaatagtagtataagaattctggctgctattagttattgtttgttttctgggttagaagctattcgaaaagtccagtttctgtcccagtgtagcaaaatgtagttcctcggttgtttttctttaaatgctttataattttacactacctttttaatatacaaacctcattcttcattggataacttgaaggctttgatttctttaaaaatttaaattttagtgtgtatattactttgacagttccctcatctttgagatgcactgatcactgtgcttgaaaaagacaatactgaagattgtactatgaagtttattgaataattttcataaattatttatccaaatgagagatttttagatttttgtattctgcttagttttaaaaaaaaaaaatagtagtttaaaagagaggctagtaagtttgatgctattcttgccaaacaaactcagccaaaatctttaaagtaacaagagggaaaaggatgactaatcgttctgcttctgagtacattttccaaaacgttggaaagaaacttctgaattgaaatcttgaatgtattgaatctgtcaaggtacacagcggtgcctttgtaaatgttcattactttatttaatcaggtgataagtggtgtaatgtagcagagcttaagaatagaactcaattatcactttttgtgaacaagttggaattgtcatgttactgtgtaattgatttgctttacaatgaacaataaatttaataaaat

SEQ ID NO: 20931 - DNA, 3008 bp, Homo sapiens
cccagcgcctgccgccgacgccgccgcctcctcccgccgcgcggaccgtggagcggggtcgcagccgcctgcccgccctgcggtgggccaggatgtcgggcttcctggaggagctgctcggcgagaagctggtgacgggcggcggcgaggaggtggacgtgcactcgctgggcgcccgcggcatctcgctgctgggtctctacttcggctgcagcctcagcgccccctgcgcgcagctcagcgccagcctggccgccttctacgggcgcctgcggggggacgcggcggccgggccggggccgggagcgggggccggggcggcggcggagcccgagccgcggcggcgcctggagatcgtcttcgtgtcctcggaccaggaccagcggcagtggcaggacttcgtgcgggacatgccgtggctggcgctgccctacaaggagaagcacaggaagctcaaactttggaacaaataccgaatttccaacattccatcactaatattcctcgacgccaccactgggaaggttgtgtgcaggaacgggctgctggtgatccgagatgacccagaaggtctggagttcccctggggaccgaaacccttcagggaagtcattgcagggcccttgcttagaaacaatgggcagtctctggagagcagcagcctggaggggtctcacgtgggcgtctatttctccgcacattggtgtccgccctgccgaagcctcacccgggtcctggtggaatcctaccggaagatcaaggaggcaggccagaacttcgagatcatcttcgttagtgcagacaggtcggaggagtccttcaaacagtacttcagtgagatgccctggctcgccgtcccctacacggatgaggcccggcggtcgcgcctcaaccggctgtacggaatccaaggcatccccacgctcatcatgctggacccgcagggcgaggtgatcacgcggcaggggcgggtggaggtgctgaacgacgaggactgccgggagttcccctggcaccccaagcccgtgctggagctctccgactccaacgccgcgcagcttaacgagggcccctgcctcgtcctttttgtagattctgaggatgacggagagtccgaggcggccaagcagctgattcagccgatagctgagaaaatcattgccaagtacaaagccaaagaggaggaggcaccccttctgttcttcgtagccggggaggatgacatgactgactccctgcgagattacaccaacctgcctgaggctgcccctttgctcaccatcctggacatgtcagcccgggccaagtacgtgatggacgtggaggagatcacccccgccatcgtggaggcctttgtgaatgacttcctagcagagaagctcaaaccggagcccatctagcgtggctccggcctcctgagacgttatttaaaactcagccttctcctcctccccctccttccttccgcccttggacttacccagcgtgccccgaatcccaccacccaagtgtccagcctctctgtggtgccttgtttctgcagtaaactcctcagccagcaccctggggtgtggaatcagcagcggcagagtccaccgtgtttggagactctgtttgggagcacgggatggccgggggcccggccagagcggggctgcatggctttcgcaaagtcactagcttttggtgaaggatctgccagggtgtcctgggcagagtgagcgtggagggccggtgggtcccgctcgggctctgactctgacgtcggcacacacggccccggacggccagaggggaaccgccgggtgacacctgcgtggaggctgagctgagaaagggcctccgcttagagctgcgggtgaggacgtccttttctaagcaacacagtcttcctcggtctgagagaaaagcagcccactcttgtgttctcaggcaggggatctccaaatgcaaaaggaagcttgtagaggttttttgggtgagaagaaaaatgtagctaaggtaatggttcatatcatacaaacagctcccacgatcctgaaattctgttaacgaatccttctctttggacatcttcccaagaaacttagccctgagtcctaggaggagcacctctgcaccagcacggacctctcgctccacccagctctgtgcccaaggcccctgatctctgctgaggtgcccacacccacgttcgatcacccctgccattcccttttattttcttttttttgagatggagtcttgctctgtcgcccaggctggagtgcagtggcaccatcttggctcacttcaacctccgcccccaaggttcaagtgattctcctgcctcagcctcccgagtagctgggattacaggcacccgccaccgtacctggctaatttttgtatttttagtagagatggggtttcaccatgttggccaggctggtctcgaactcctgacctcaggtgatccacccgcctcggcctcccaaagtgctgggattacaggcgtgagccgccgtgcccggcccccttttcttttcaaagcagaactacaaagatgagaaattaccagaagcctcgccttttcctaagcaccagcggaaggagctgtgccccgggatggagtgagggtggagggcgcgtcagccacgggtgggccttgtgtcgccttgtatcggcccaggtaggttgttggcctcttacttgggctgacctgacccccgaaagagaaacagacaactctgttctcaggattggggatggacggcttcggccaagcgttttagcctcattcactcaggccccactcagcactctgccagccaagaccattgatttggaaaatccggtccccacccgctaatgagctgttgacactgttgttccttgctgaattggattgttgacttgtagttcagaggcgtacaactagttggcgattagacttgttatgtgatgttaccagcctgaaatgcgatcaccccgtaggaaataaagcaggcatctctggacctcatcca

SEQ ID NO: 20932 - DNA, 1200 bp, Homo sapiens
aaacgtgccccttcaccggaaccgagcaacggtaactgtgccccttcaccggaaccgagcaatggcagacgtgtcccttcaccggaacccagcaacgctcaaactttggaacaaataccgaatttccaacattccatcactaatattcctcgacgccaccactgggaaggttgtgtgcaggaacgggctgctggtgatccgagatgacccagaaggtctggagttcccctggggaccgaaacccttcagggaagtcattgcagggcccttgcttagaaacaatgggcagtctctggagagcagcagcctggaggggtctcacgtgggcgtctatttctccgcacattggtgtccgccctgccgaagcctcacccgggtcctggtggaatcctaccggaagatcaaggaggcaggccagaacttcgagatcatcttcgttagtgcagacaggtcggaggagtccttcaaacagtacttcagtgagatgccctggctcgccgtcccctacacggatgaggcccggcggtcgcgcctcaaccggctgtacggaatccaaggcatccccacgctcatcatgctggacccgcagggcgaggtgatcacgcggcaggggcgggtggaggtgctgaacgacgaggactgccgggagttcccctggcaccccaagcccgtgctggagctctccgactccaacgccgcgcagcttaacgagggcccctgcctcgtcctttttgtagattctgaggatgacggagagtccgaggcggccaagcagctgattcagccgatagctgagaaaatcattgccaagtacaaagccaaagaggaggaggcaccccttctgttcttcgtagccggggaggatgacatgactgactccctgcgagattacaccaacctgcctgaggctgcccctttgctcaccatcctggacatgtcagcccgggccaagtacgtgatggacgtggaggagatcacccccgccatcgtggaggcctttgtgaatgacttcctagcagagaagctcaaaccggagcccatctagcgtggctccggcctcctgagacgttatttaaaactcagccttctcctcctccccctccttccttccgcccttggacttacccagcgtgccccgaatcccaccacccaagtgtccagcctctctgtggtgccttgtttctgcagtaaactcctcag

SEQ ID NO: 20933 - DNA, 985 bp, Homo sapiens
gtgtccgccctgccgaagcctcacccgggtcctggtggaatcctaccggaagatcaaggaggcaggccagaacttcgagatcatcttcgttagtgcagacaggtcggaggagtccttcaaacagtacttcagtgagatgccctggctcgccgtcccctacacggatgaggcccggcggtcgcgcctcaaccggctgtacggaatccaagattctgaggatgacggagagtccgaggcggccaagcagctgattcagccgatagctgagaaaatcattgccaagtacaaagccaaagaggaggaggcaccccttctgttcttcgtagccggggaggatgacatgactgactccctgcgagattacaccaacctgcctgaggctgcccctttgctcaccatcctggacatgtcagcccgggccaagtacgtgatggacgtggaggagatcacccccgccatcgtggaggcctttgtgaatgacttcctagcagagaagctcaaaccggagcccatctagcgtggctccggcctcctgagacgttatttaaaactcagccttctcctcctccccctccttccttccgcccttggacttacccagcgtgccccgaatcccaccacccaagtgtccagcctctctgtggtgccttgtttctgcagtaaactcctcagccagcaccctggggtgtggaatcagcagcggcagagtccaccgtgtttggagactctgtttgggagcacgggatggccgggggcccggccagagcggggctgcatggctttcgcaaagtcactagcttttggtgaaggatctgccagggtgtcctgggcagagtgagcgtggagggccggtgggtcccgctcgggctctgactctgacgtcggcacacacggccccggacggccagaggggaaccgccgggtgacacctgcgtggaggctgagctgagaaagggcctccgcttagagctgcgggtgaggacgt

SEQ ID NO: 20934 - DNA, 2681 bp, Homo sapiens
aaacgtgccccttcaccggaaccgagcaacggtaactgtgccccttcaccggaaccgagcaatggcagacgtgtcccttcaccggaacccagcaacgctcaaactttggaacaaataccgaatttccaacattccatcactaatattcctcgacgccaccactgggaaggttgtgtgcaggaacgggctgctggtgatccgagatgacccagaaggtctggagttcccctggggaccgaaacccttcagggaagtcattgcagggcccttgcttagaaacaatgggcagtctctggagagcagcagcctggaggggtctcacgtgggcgtctatttctccgcacattggtgtccgccctgccgaagcctcacccgggtcctggtggaatcctaccggaagatcaaggaggcaggccagaacttcgagatcatcttcgttagtgcagacaggtcggaggagtccttcaaacagtacttcagtgagatgccctggctcgccgtcccctacacggatgaggcccggcggtcgcgcctcaaccggctgtacggaatccaaggcatccccacgctcatcatgctggacccgcagggcgaggtgatcacgcggcaggggcgggtggaggtgctgaacgacgaggactgccgggagttcccctggcaccccaagcccgtgctggagctctccgactccaacgccgcgcagcttaacgagggcccctgcctcgtcctttttgtagattctgaggatgacggagagtccgaggcggccaagcagctgattcagccgatagctgagaaaatcattgccaagtacaaagccaaagaggaggaggcaccccttctgttcttcgtagccggggaggatgacatgactgactccctgcgagattacaccaacctgcctgaggctgcccctttgctcaccatcctggacatgtcagcccgggccaagtacgtgatggacgtggaggagatcacccccgccatcgtggaggcctttgtgaatgacttcctagcagagaagctcaaaccggagcccatctagcgtggctccggcctcctgagacgttatttaaaactcagccttctcctcctccccctccttccttccgcccttggacttacccagcgtgccccgaatcccaccacccaagtgtccagcctctctgtggtgccttgtttctgcagtaaactcctcagccagcaccctggggtgtggaatcagcagcggcagagtccaccgtgtttggagactctgtttgggagcacgggatggccgggggcccggccagagcggggctgcatggctttcgcaaagtcactagcttttggtgaaggatctgccagggtgtcctgggcagagtgagcgtggagggccggtgggtcccgctcgggctctgactctgacgtcggcacacacggccccggacggccagaggggaaccgccgggtgacacctgcgtggaggctgagctgagaaagggcctccgcttagagctgcgggtgaggacgtccttttctaagcaacacagtcttcctcggtctgagagaaaagcagcccactcttgtgttctcaggcaggggatctccaaatgcaaaaggaagcttgtagaggttttttgggtgagaagaaaaatgtagctaaggtaatggttcatatcatacaaacagctcccacgatcctgaaattctgttaacgaatccttctctttggacatcttcccaagaaacttagccctgagtcctaggaggagcacctctgcaccagcacggacctctcgctccacccagctctgtgcccaaggcccctgatctctgctgaggtgcccacacccacgttcgatcacccctgccattcccttttattttcttttttttgagatggagtcttgctctgtcgcccaggctggagtgcagtggcaccatcttggctcacttcaacctccgcccccaaggttcaagtgattctcctgcctcagcctcccgagtagctgggattacaggcacccgccaccgtacctggctaatttttgtatttttagtagagatggggtttcaccatgttggccaggctggtctcgaactcctgacctcaggtgatccacccgcctcggcctcccaaagtgctgggattacaggcgtgagccgccgtgcccggcccccttttcttttcaaagcagaactacaaagatgagaaattaccagaagcctcgccttttcctaagcaccagcggaaggagctgtgccccgggatggagtgagggtggagggcgcgtcagccacgggtgggccttgtgtcgccttgtatcggcccaggtaggttgttggcctcttacttgggctgacctgacccccgaaagagaaacagacaactctgttctcaggattggggatggacggcttcggccaagcgttttagcctcattcactcaggccccactcagcactctgccagccaagaccattgatttggaaaatccggtccccacccgctaatgagctgttgacactgttgttccttgctgaattggattgttgacttgtagttcagaggcgtacaactagttggcgattagacttgttatgtgatgttaccagcctgaaatgcgatcaccccgtaggaaataaagcaggcatctctggacctcatccaccctgggcctctgctgtccttgatcaca

SEQ ID NO: 20935 - DNA, 5202 bp, Homo sapiens
cgggcgccgggcacgcgggccaggccttccccacaactgatggggttgaaatttcctttccggctcagcagggagaaaagatatggtggggtgcttaacagaggaggttagacaccggcgggaaccagaggagcccaagcgcggcgcctgggcctcggggctgcaggagtcctcggtgggggtatggaggtcgccggggaaggaggacggttcagttgctaggcaacccggcctggacccgcctctcgctcgcgttgctgggagactacaaggccgggaggagggcggcgaaagggccctacgtgctgacgctaattgtatatgagcgcgagcggcgggctcttgggtcttttttagcgccatctgctcgcggcgccgcctcctgctcctcccgctgctgctgccgctgccgccctgagtcactgcctgcgcagctccggccgcctggctccccatactagtcgccgatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcacgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaagatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactgtaatagcctaaacacaactcttatttacttacagccttatgtttttgtattttcttggtagactaggtaatttttttttaaaggacaggaaactgatattttaaagaccaatttgttctacctagcattttaactagtttttctgccagctatgttgaatgcacaaattctgtcacgcatgttcattcattgctacataatttggttcttctggaatatttttatgtagctcttggagtacagctatgaaaattaacaactgttaaaggaaataccttttttttttttttgtaattttttccttgaagaaccaaagtattttttcagctggttgttgaatagggttaagtccgcttggattagctgtgcctttcattactttgttacagaaatgcagtgacttatactaagacaatttattgtttaaaaaaaaaattggcaagacaactatatggttaagaatttccagtatgaccacacccaataactgttattagagtgttaatggattattgtgttttaggtgacatagttaactgtaaagtaacctgactcagtatagttactggtaccacagtgaggtgaataaaacgggattttcagaagttagcctgaatttaactgtatttttaaatttaacctccattaactaagcatcttttctttgtggtagggtctaccttctgcttccctggaaaggatgaatttacatcatttgacaagcctattttcaagttatttgttgtttgtttgcttgtttttgtttttgcagctaaaataaaaatttcaaatacaattttagttcttacaagataatgtcttaattttgtaccaattcaggtagaagtagaggcctaccttgaattaagggttatactcagtttttaacacattgttgaagaaaaggtaccagctttggaacgagatgctatactaataagcaagtgtaaaaaaaaaaaaaaaagaggaagaaaatcttaagtgattgatgctgttttcttttaaaaaaaaaaaaaaaaattcattttctttgggttagagctagagagaaggccccaagcttctatggtttcttctaattcttattgcttaaagtatgagtatgtcacttacccgtgcttctgtttactgtgtaattaaaatgggtagtactgtttacctaactacctcatggatgtgttaaggcatattgagttaaatctcatataatgtttctcaatcttgttaaaagctcaaaattttgggcctatttgtaatgccagtgtgacactaagcattttgttcacaccacgctttgataactaaactggaaaacaaaggtgttaagtacctctgttctggatctgggcagtcagcactctttttagatctttgtgtggctcctatttttatagaagtggagggatgcactatttcacaaggtccaagatttgttttcagatatttttgatgactgtattgtaaatactacagggatagcactatagtattgtagtcatgagacttaaagtggaaataagactatttttgacaaaagatgccattaaatttcagactgtagagccacatttacaatacctcaggctaattactgttaattttggggttgaacttttttttgacagtgagggtggattattggattgtcattagaggaaggtctagatttcctgctcttaataaaattacattgaattgatttttagaggtaatgaaaacttcctttctgagaagttagtgttaaggtcttggaatgtgaacacattgtttgtagtgctatccattcctctcctgagattttaacttactactggaaatccttaaccaattataatagctttttttctttattttcaaaatgatttcctttgctttgattagacactatgtgctttttttttttaaccatagttcatcgaaatgcagctttttctgaacttcaaagatagaatcccatttttaatgaactgaagtagcaaaatcatctttttcattctttaggaaatagctattgccaaagtgaaggtgtagataatacctagtcttgttacataaaggggatgtggtttgcagaagaattttctttataaaattgaagttttaagggacgtcagtgtttatgccatttttccagttccaaaatgattccattccattctagaaatttgaagtatgtaacctgaaatccttaataaaatttggatttaattttataaaatgtactggtgatattttgggtgtttttttttaaatgaatgtatatactttttttttgaagagtggagagtagtgatgtctagagggagctattttgtgctgaggccactatgttctgtaaatatataattttaagagcaacctcacaatccctgctaagtggagtttattatttgaagactaaaatggaattccatagttcctgataggttatattctgggttattattctgagttatctacaaacatttttgagatttgtctttacactctgattgtagtttccagcagcccatgcacactgccaagtaagtctcattttttcctgttagaaatggtgaaatatcatataatcacttataaagaaaactgatatgaaaaaattttagagttgtttgctttatggtcactcaagtagggtaagtgttccacaaattccacaagttgatagtttaacatggatgtctgaaagccacatatataatttcttaggattcttaaattagtaaatctagcttactgaagcagtattagcatcactattttagattgcaaaaataccttaattgtgtggaactggcttgtagagtggtacttaagaaaaatgggattctacctctatttctgttttagcacacttaatcaggaaaggatatattaactttcataaaaatatttttgttgtgtgaataggttaatgatatggtaaggcccctaaaataactgaattaattgtttattgtaattgtaggccattcccattattaaaaataaagacaaaacttgaagtaactgaaaatcttatcgtgctatgtagaaatattgaactaatattcaaatatttgaatgctttggtttcagggattggtttaaaattggagtccttttttatgggttagtcttacaaaaatttaagcctttatatttttgactttaaatcaaaacaaatgttattttaaatgtacagaatagattggtagtgcagaagagtgtaagttcttcataggagctttagaaaagagaaatatgtgctaattcagtttttttttaatctgcactgtacatatatacttggtaattatgagcttgattttgtttttggaaatatgtgttcataatttaggtaatttgctacttaaagcactaagtctctgatacctgaaaagtacatgtaaatggtgatggtgaaataatactgcagttaacttaatagatgtatactggtgatttttgtatgctggattaaaactccagatattaaaatataacctggataaaaagccaa

SEQ ID NO: 20936 - DNA, 1896 bp, Homo sapiens
tcgcggcgccgcctcctgctcctcccgctgctgctgccgctgccgccctgagtcactgcctgcgcagctccggccgcctggctccccatactagtcgccgatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcacgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaagatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactggtctaccttctgcttccctggaaaggatgaatttacatcatttgacaagcctattttcaagttatttgttgtttgtttgcttgtttttgtttttgcagctaaaataaaaatttcaaatacaattttagttcttacaagataatgtcttaattttgtaccaattcaggtagaagtagaggcctaccttgaattaagggttatactcagtttttaacacattgttgaagaaaaggtaccagctttggaacgagatgctatactaataagcaagtgtaaaaaaaaaaaaaaaagaggaagaaaatcttaagtgattgatgctgttttcttttaaaaaaaaaaaaaaaaattcattttctttgggttagagctagagagaaggccccaagcttctatggtttcttctaattcttattgcttaaagtatgagtatgtcacttacccgtgcttctgtttactgtgtaattaaaatgggtagtactgtttacctaactacctcatggatgtgttaaggcatattgagttaaatctcatataatgtttctcaatcttgttaaaagctcaaa

SEQ ID NO: 20937 - DNA, 2031 bp, Homo sapiens
cttttttagcgccatctgctcgcggcgccgcctcctgctcctcccgctgctgctgccgctgccgccctgagtcactgcctgcgcagctccggccgcctggctccccatactagtcgccgcaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcacgatcttgaaaggaagtatgctgttctctatcagcctctatttgataaggaggaattgaaagaaaaggccaagattgaagatgagaaaaaagatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactgtaatagcctaaacacaactcttatttacttacagccttatgtttttgtattttcttggtagactaggtaatttttttttaaaggacaggaaactgatattttaaagaccaatttgttctacctagcattttaactagtttttctgccagctatgttgaatgcacaaattctgtcacgcatgttcattcattgctacataatttggttcttctggaatatttttatgtagctcttggagtacagctatgaaaattaacaactgttaaaggaaataccttttttttttttttgtaattttttccttgaagaaccaaagtattttttcagctggttgttgaatagggttaagtccgcttggattagctgtgcctttcattactttgttacagaaatgcagtgacttatactaagacaatttattgtttaaaaaaaaaattggcaagacaactatatggttaagaatttccagtatgaccacacccaataactgttattagagtgttaatggattattgtgttttaggtgacatagttaactgtaaagtaacctgactcagtatagttactggtaccacagtgaggtgaataaaacgggattttcagaagttagcctgaatttaactgtatttttaaatttaacctccattaactaagcatcttttctttgtggtagggtctaccttctgcttccctggaaaggatgaatttacatcatttgacaagcctattttcaagttatttgttgtttgtttgcttgtttttgtttttgcagctaaaataaaaatttcaaatacaat

SEQ ID NO: 20938 - DNA, 1675 bp, Homo sapiens
ctacgtgctgacgctaattgtatatgagcgcgagcggcgggctcttgggtcttttttagcgccatctgctcgcggcgccgcctcctgctcctcccgctgctgctgccgctgccgccctgagtcactgcctgcgcagctccggccgcctggctccccatactagtcgccgatatttggagttcttacaacatggcagacattgacaacacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcacgatcttgaaaggaagtatgctgttctctatcagcctctatttgataagcgatttgaaattattaatgcaatttatgaacctacggaagaagaatgtgaatggaaaccagatgaagaagatgagatttcggaattgaaagaaaaggccaagattgaagatgagaaaaaagatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactgtaatagcctaaacacaactcttatttacttacagccttatgtttttgtattttcttggtagactaggtaatttttttttaaaggacaggaaactgatattttaaagaccaatttgttctacctagcattttaactagtttttctgccagctatgttgaatgcacaaattctgtcacgcatgttcattcattgctacataatttggttcttctggaatatttttatgtagctcttggagtacagctatgaaaattaacaactgttaaaggaaataccttttttttttttttgtaattttttccttgaagaaccaaagtattttttcagctggttgttgaatagggttaagtccgcttggatta

SEQ ID NO: 20939 - DNA, 1597 bp, Homo sapiens
gtgctgacgctaattgtatatgagcgcgagcggcgggctcttgggtcttttttagcgccatctgctcgcggcgccgcctcctgctcctcccgctgctgctgccgctgccgccctgagtcactgcctgcgcagctccggccgcctggctccccatactagtcgccgcctgcctagggtagttaaaagacgagtgaatgctctcaaaaacctgcaagttaaatgtgcacagatagaagccaaattctatgaggaagttcacgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaagatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactgtaatagcctaaacacaactcttatttacttacagccttatgtttttgtattttcttggtagactaggtaatttttttttaaaggacaggaaactgatattttaaagaccaatttgttctacctagcattttaactagtttttctgccagctatgttgaatgcacaaattctgtcacgcatgttcattcattgctacataatttggttcttctggaatatttttatgtagctcttggagtacagctatgaaaattaacaactgttaaaggaaataccttttttttttttttgtaattttttccttgaagaaccaaagtattttttcagctggttgttgaatagggttaagtccgcttggattagctgtgcctttcattactttgttacagaaatgcagtgacttatactaagacaatttattgttt

SEQ ID NO: 20940 - DNA, 1967 bp, Homo sapiens
gctgacgctaattgtatatgagcgcgagcggcgggctcttgggtcttttttagcgccatctgctcgcggcgccgcctcctgctcctcccgctgctgctgccgctgccgccctgagtcactgcctgcgcagctccggccgcctggctccccatactagtcgccgatatttggagttcttacaacatggcagacattgacaacctgcctagggtagttaaaagacgagtgaatgctctcaaaaacctgcaagttaaatgtgcacagatagaagccaaattctatgaggaagttcacgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaagatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactgtaatagcctaaacacaactcttatttacttacagccttatgtttttgtattttcttggtagactaggtaatttttttttaaaggacaggaaactgatattttaaagaccaatttgttctacctagcattttaactagtttttctgccagctatgttgaatgcacaaattctgtcacgcatgttcattcattgctacataatttggttcttctggaatatttttatgtagctcttggagtacagctatgaaaattaacaactgttaaaggaaataccttttttttttttttgtaattttttccttgaagaaccaaagtattttttcagctggttgttgaatagggttaagtccgcttggattagctgtgcctttcattactttgttacagaaatgcagtgacttatactaagacaatttattgtttaaaaaaaaaattggcaagacaactatatggttaagaatttccagtatgaccacacccaataactgttattagagtgttaatggattattgtgttttaggtgacatagttaactgtaaagtaacctgactcagtatagttactggtaccacagtgaggtgaataaaacgggattttcagaagttagcctgaatttaactgtatttttaaatttaacctccattaactaagcatcttttctttgtggtagggtctaccttctgcttccctggaaaggatgaatttacatcatttgacaagcctattttcaagttatttgttgtttgtttgcttgttt

SEQ ID NO: 20941 - DNA, 1838 bp, Homo sapiens
cttttttagcgccatctgctcgcggcgccgcctcctgctcctcccgctgctgctgccgctgccgccctgagtcactgcctgcgcagctccggccgcctggctccccatactagtcgccgatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcacgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaagatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggtaatgtttaccaaatgagcaaataattctctgtggttaacacattgagaagcaaattgaatgacttatgtattcctttgctataatcattctgtgatttgggataaaaacattttggaaaacatgattttagaattctacagccaaacaatgtatgtataaggtttcaataaataaattgcaaaactcagcaacatttttttatttcaaataattttgttctgctgcagggttatcagctctttgaagaagtcaaaagctgcagtaaacttttccaacgttggctgcagtaactattttcaataaaagctgtctggatgtctcaagttgtgttgggaaatttttcatattagaagctttcaaattaaattgtattatcatcaaagtctgtaatcatgaaaatctgttgatccgtagagtaacttgtattaaattttccctacattatgagccagtttacctactatgtacatacttcatggatgcattttgaactttaatataggaaggggaagaagaaggagatgaggaaaatgatccagactatgacccaaaggtgagcaaaattagtgctgctttctattaaatttaagatagctaaagtaagagt

SEQ ID NO: 20942 - DNA, 1074 bp, Homo sapiens
ggcggaggctgcgaattccgacgggagggaggggctgtggagggacgagtccccgaggcggggagggggcgggggaggctgcgacgctcccgggctctccgcccattgggggcggccgcgcggggaggggaaacccccggcggcttcgctccacacgtggtaatgggcttcatggccactggctgggcctggttggagacccttgccctcggtctgtgcttactttgaaagttgtagagacggtggaatgtgaaaaggaaggatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcacgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaagatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaa

SEQ ID NO: 20943 - DNA, 1981 bp, Homo sapiens
aaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcacgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaagatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatggtctaccttctgcttccctggaaaggatgaatttacatcatttgacaagcctattttcaagttatttgttgtttgtttgcttgtttttgtttttgcagctaaaataaaaatttcaaatacaattttagttcttacaagataatgtcttaattttgtaccaattcaggtagaagtagaggcctaccttgaattaagggttatactcagtttttaacacattgttgaagaaaaggtaccagctttggaacgagatgctatactaataagcaagtgtaaaaaaaaaaaaaaaagaggaagaaaatcttaagtgattgatgctgttttcttttaaaaaaaaaaaaaaaaattcattttctttgggttagagctagagagaaggccccaagcttctatggtttcttctaattcttattgcttaaagtatgagtatgtcacttacccgtgcttctgtttactgtgtaattaaaatgggtagtactgtttacctaactacctcatggatgtgttaaggcatattgagttaaatctcatataatgtttctcaatcttgttaaaagctcaaaattttgggcctatttgtaatgccagtgtgacactaagcattttgttcacaccacgctttgataactaaactggaaaacaaaggtgttaagtacctctgttctggatctgggcagtcagcactctttttagatctttgtgtggctcctatttttatagaagtggagggatgcactatttcacaaggtccaagatttgttttcagatatttttgatgactgtattgtaaatactacagggatagcactatagt

SEQ ID NO: 20944 - DNA, 2639 bp, Homo sapiens
attcggctgcggtacatctcggcactctagctgcagccgggagaggccttgccgccaccgctgtcgcccaagcctccactgccgctgccacctcagcgccggcctctgcatccccagctccagctccgctctgcgccgctgctgccatcgccgctgccacctccgcagcccgggcctccgccgccgccactcaagcatccgtgagtcattttctgcccatctctggtcgcgcggtctccctggtagagtttgtaggcttgcaagatggcagaagcagattttaaaatggtctcggaacctgtcgcccatggggttgccgaagaggagatggctagctcgactagtgattctggggaagaatctgacagcagtagctctagcagcagcactagtgacagcagcagcagcagcagcactagtggcagcagcagcggcagcggcagcagcagcagcagcagcggcagcactagcagccgcagccgcttgtatagaaagaagagggtacctgagccttccagaagggcgcggcgggccccgttgggaacaaatttcgtggataggctgcctcaggcagttagaaatcgtgtgcaagcgcttagaaacattcaagatgaatgtgacaaggtagataccctgttcttaaaagcaattcatgatcttgaaagaaaatatgctgaactcaacaagcctctgtatgataggcggtttcaaatcatcaatgcagaatacgagcctacagaagaagaatgtgaatggaattcagaggatgaggagttcagcagtgatgaggaggtgcaggataacacccctagtgaaatgcctcccttagagggtgaggaagaagaaaaccctaaagaaaacccagaggtgaaagctgaagagaaggaagttcctaaagaaattcctgaggtgaaggatgaagaaaaggaagttcctaaagaaattcctgaggtaaaggctgaagaaaaagcagattctaaagactgtatggaggcaacccctgaagtaaaagaagatcctaaagaagtcccccaggtaaaggcagatgataaagaacagcctaaagcaacagaggctaaggcaagggctgcagtaagagagactcataaaagagttcctgaggaaaggcttcaggacagtgtagatcttaaaagagctaggaagggaaagcctaaaagagaagaccctaaaggcattcctgactattggctgattgttttaaagaatgttgacaagctcgggcctatgattcagaagtatgatgagcccattctgaagttcttgtcggatgttagcctgaagttctcaaaacctggccagcctgtaagttacacctttgaatttcattttctacccaacccatacttcagaaatgaggtgctggtgaagacatatataataaaggcaaaaccagatcacaatgatcccttcttttcttggggatgggaaattgaagattgcaaaggctgcaagatagactggagaagaggaaaagatgttactgtgacaactacccagagtcgcacaactgctactggagaaattgaaatccagccaagagtggttcctaatgcatcattcttcaacttctttagtcctcctgagattcctatgattgggaagctggaaccacgagaagatgctatcctggatgaggactttgaaattgggcagattttacatgataatgtcatcctgaaatcaatctattactatactggagaagtcaatggtacctactatcaatttggcaaacattatggaaacaagaaatacagaaaataagtcaatctgaaagatttttcaagaatcttaaaatctcaagaagtgaagcagattcatacagccttgaaaaaagtaaaaccctgacctgtaacctgaacactattattccttatagtcaagtttttgtggtttcttggtagtctatattttaaaaatagtcctaaaaagtgtctaagtgccagtttattctatctaggctgttgtagtataatattcttcaaaatatgtaagctgttgtcaattatctaaagcatgttagtttggtgctacacagtgttgatttttgtgatgtcctttggtcatgtttctgttagactgtagctgtgaaactgtcagaattgttaactgaaacaaatatttgcttgaaaaaaaaagttcatgaagtaccaatgcaagtgttttatttttttcttttttccagcccataagactaagggtttaaatctgcttgcactagctgtgccttcattagtttgctatagaaatccagtacttatagtaaataaaacagtgtattttgaagtttgactgcttgaaaaagattagcatacatctaatgtgaaaagaccacatttgattcaactgagaccttgtgtatgtgacatatagtggcctataaatttaatcataatgatgttattgtttaccactgaggtgttaatataacatagtatttttgaaaaagtttcttcatcttatattgtgtaattgtaaactaaagataccgtgttttctttgtattgtgttctaccttccctttcactgaaaatgatcacttcatttgatactgtttttcatgttcttgtattgcaacctaaaataaataaatattaaagtgtgttatactataaaaa

SEQ ID NO: 20945 - DNA, 2555 bp, Homo sapiens
attcggctgcggtacatctcggcactctagctgcagccgggagaggccttgccgccaccgctgtcgcccaagcctccactgccgctgccacctcagcgccggcctctgcatccccagctccagctccgctctgcgccgctgctgccatcgccgctgccacctccgcagcccgggcctccgccgccgccactcaagcagattttaaaatggtctcggaacctgtcgcccatggggttgccgaagaggagatggctagctcgactagtgattctggggaagaatctgacagcagtagctctagcagcagcactagtgacagcagcagcagcagcagcactagtggcagcagcagcggcagcggcagcagcagcagcagcagcggcagcactagcagccgcagccgcttgtatagaaagaagagggtacctgagccttccagaagggcgcggcgggccccgttgggaacaaatttcgtggataggctgcctcaggcagttagaaatcgtgtgcaagcgcttagaaacattcaagatgaatgtgacaaggtagataccctgttcttaaaagcaattcatgatcttgaaagaaaatatgctgaactcaacaagcctctgtatgataggcggtttcaaatcatcaatgcagaatacgagcctacagaagaagaatgtgaatggaattcagaggatgaggagttcagcagtgatgaggaggtgcaggataacacccctagtgaaatgcctcccttagagggtgaggaagaagaaaaccctaaagaaaacccagaggtgaaagctgaagagaaggaagttcctaaagaaattcctgaggtgaaggatgaagaaaaggaagttcctaaagaaattcctgaggtaaaggctgaagaaaaagcagattctaaagactgtatggaggcaacccctgaagtaaaagaagatcctaaagaagtcccccaggtaaaggcagatgataaagaacagcctaaagcaacagaggctaaggcaagggctgcagtaagagagactcataaaagagttcctgaggaaaggcttcaggacagtgtagatcttaaaagagctaggaagggaaagcctaaaagagaagaccctaaaggcattcctgactattggctgattgttttaaagaatgttgacaagctcgggcctatgattcagaagtatgatgagcccattctgaagttcttgtcggatgttagcctgaagttctcaaaacctggccagcctgtaagttacacctttgaatttcattttctacccaacccatacttcagaaatgaggtgctggtgaagacatatataataaaggcaaaaccagatcacaatgatcccttcttttcttggggatgggaaattgaagattgcaaaggctgcaagatagactggagaagaggaaaagatgttactgtgacaactacccagagtcgcacaactgctactggagaaattgaaatccagccaagagtggttcctaatgcatcattcttcaacttctttagtcctcctgagattcctatgattgggaagctggaaccacgagaagatgctatcctggatgaggactttgaaattgggcagattttacatgataatgtcatcctgaaatcaatctattactatactggagaagtcaatggtacctactatcaatttggcaaacattatggaaacaagaaatacagaaaataagtcaatctgaaagatttttcaagaatcttaaaatctcaagaagtgaagcagattcatacagccttgaaaaaagtaaaaccctgacctgtaacctgaacactattattccttatagtcaagtttttgtggtttcttggtagtctatattttaaaaatagtcctaaaaagtgtctaagtgccagtttattctatctaggctgttgtagtataatattcttcaaaatatgtaagctgttgtcaattatctaaagcatgttagtttggtgctacacagtgttgatttttgtgatgtcctttggtcatgtttctgttagactgtagctgtgaaactgtcagaattgttaactgaaacaaatatttgcttgaaaaaaaaagttcatgaagtaccaatgcaagtgttttatttttttcttttttccagcccataagactaagggtttaaatctgcttgcactagctgtgccttcattagtttgctatagaaatccagtacttatagtaaataaaacagtgtattttgaagtttgactgcttgaaaaagattagcatacatctaatgtgaaaagaccacatttgattcaactgagaccttgtgtatgtgacatatagtggcctataaatttaatcataatgatgttattgtttaccactgaggtgttaatataacatagtatttttgaaaaagtttcttcatcttatattgtgtaattgtaaactaaagataccgtgttttctttgtattgtgttctaccttccctttcactgaaaatgatcacttcatttgatactgtttttcatgttcttgtattgcaacctaaaataaataaatattaaagtgtgttatactat

SEQ ID NO: 20946 - DNA, 2511 bp, Homo sapiens
cttgctcgcggagagaggagctaggagcctcggccaatgggagccggcgttgttggaggccacggcggcgcagccccaaagcgagcgaagctagggtcgccgccactgccgcaggaggcgtgaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattggctggagacatgaaaagtaaagtagtcgtcacagaaaaagcagcggcaacggctgaagagccagatcccaaaggaattccagagttctggtttaccatcttcagaaatgtggacatgctgagtgaattagtccaggaatatgatgaaccaatcttgaaacacctgcaggatattaaagtgaaattttctgaccctggacagcctatgtcttttgtgttagagttccactttgaacccaacgactactttaccaactcagtcctgacaaaaacctacaagatgaaatcagaaccagataaggctgatcccttttcctttgaaggtcctgagattgtggactgtgacgggtgtactattgactggaagaaaggaaagaatgttactgtcaaaaccatcaagaaaaagcagaagcataagggtcgaggcactgttagaacaattacgaaacaagtacccaatgagtcctttttcaacttcttcaatccattgaaagcatccggggatggagaatcactggatgaagattctgaattcacattagcctctgattttgaaattggacactttttccgtgagcggatagtcccgcgggctgtgctgtacttcactggggaggccatagaagatgatgacaattttgaagaaggtgaagaaggagaagaggaggaattagaaggtgacgaggagggagaagacgaggatgatgcggaaattaaccccaaggtgtaatttttgtctgttaatcattcatacgtttctagaaggaacccagccagccggcggaatgcaagcagcagtaggaagcggaggcgggtgcctggcagaccggctgtcgggactccaggcctgtgggcggggcctcggtccttgccgcagcacaatcccgtggacagagcttactccatctaactcgttttcaagtgcatgattttcactttcacttttcctttttccttattattttgcttaacttgtacagtggcaactgaaatgcatttcagaaataggaggtttcgtccagcaccctctgcagccttggtgcctgtagctctggacttccctgggcctttccctgtgggagggccctgtagaccacatcagggtggggtgggggtcacttggcaaaaagggccgaggtctggtgatgtggttcccaggatctggaacctctcccacccctcctgcagttggactgaattcttccctttcatccgaagaaacccacttgctgtttccagccgctgaatctgctgagtgtgcagcctgcatcacctgctgtatgccgatcatctcagaaagggctgtgtagagtagggccctgttctccttaggatgttgcttcttgatttttttttttttttaggggtgggtcagggttgtgacacaccagcccaggtgagagctgctgcgggtcacctcatatttatttatcccttcttgcctgtgaggactgcggcttttcgctgtggctcgtccttaacgtttctgaaccaccttggtgccctgagcaggaagatgtgccacttcctagcaggcgcaaggcctgtgcggaagaaacgccgctccctgccaccagggctgaagatgcgagcccgtcctcatgacgcaggcgccaccctgctgccggagccgggcttcggcagtcttctccactgagggactgggctgggaagtcctgcgtttcagtggagcgtatgagcgtcaagtcctgctttctcagtagccccattgcggggccccaccattcatcctgtctgaaggtcctgggtttggtgtgaccgcttggcggctggtgggtggggttttcaagtgggtgacggcgctctccggcagccggggatggccgtgtccgcactgaccaggcctgtggagagtgctcggcctaaccttagaacacatttgtaactgaatacagtgttttcaatttgtacagaatagttagaatattctattaaagtggtgaaacattga

SEQ ID NO: 20947 - DNA, 2479 bp, Homo sapiens
cttgctcgcggagagaggagctaggagcctcggccaatgggagccggcgttgttggaggccacggcggcgcagccccaaagcgagcgaagctagggtcgccgccactgccgcaggaggcgtgaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattggctggagacatgaaaagtaaagtagtcgtcacagaaaaagcagcggcaacggctgaagagccagatcccaaaggaattccagagttctggtttaccatcttcagaaatgtggacatgctgagtgaattagtccaggaatatgatgaaccaatcttgaaacacctgcaggatattaaagtgaaattttctgaccctggacagcctatgtcttttgtgttagagttccactttgaacccaacgactactttaccaactcagtcctgacaaaaacctacaagatgaaatcagaaccagataaggctgatcccttttcctttgaaggtcctgagattgtggactgtgacgggtgtactattgactggaagaaaggaaagaatgttactgtcaaaaccatcaagaaaaagcagaagcataagggtcgaggcactgttagaacaattacgaaacaagtacccaatgagtcctttttcaacttcttcaatccattgaaaggcaaggggcagagtaaatcaaaagatgaagattctgaattcacattagcctctgattttgaaattggacactttttccgtgagcggatagtcccgcgggctgtgctgtacttcactggggaggccatagaagatgatgacaattttgaagaaggtgaagaaggagaagaggaggaattagaaggtgacgaggagggagaagacgaggatgatgcggaaattaaccccaagaaggaacccagccagccggcggaatgcaagcagcagtaggaagcggaggcgggtgcctggcagaccggctgtcgggactccaggcctgtgggcggggcctcggtccttgccgcagcacaatcccgtggacagagcttactccatctaactcgttttcaagtgcatgattttcactttcacttttcctttttccttattattttgcttaacttgtacagtggcaactgaaatgcatttcagaaataggaggtttcgtccagcaccctctgcagccttggtgcctgtagctctggacttccctgggcctttccctgtgggagggccctgtagaccacatcagggtggggtgggggtcacttggcaaaaagggccgaggtctggtgatgtggttcccaggatctggaacctctcccacccctcctgcagttggactgaattcttccctttcatccgaagaaacccacttgctgtttccagccgctgaatctgctgagtgtgcagcctgcatcacctgctgtatgccgatcatctcagaaagggctgtgtagagtagggccctgttctccttaggatgttgcttcttgatttttttttttttttaggggtgggtcagggttgtgacacaccagcccaggtgagagctgctgcgggtcacctcatatttatttatcccttcttgcctgtgaggactgcggcttttcgctgtggctcgtccttaacgtttctgaaccaccttggtgccctgagcaggaagatgtgccacttcctagcaggcgcaaggcctgtgcggaagaaacgccgctccctgccaccagggctgaagatgcgagcccgtcctcatgacgcaggcgccaccctgctgccggagccgggcttcggcagtcttctccactgagggactgggctgggaagtcctgcgtttcagtggagcgtatgagcgtcaagtcctgctttctcagtagccccattgcggggccccaccattcatcctgtctgaaggtcctgggtttggtgtgaccgcttggcggctggtgggtggggttttcaagtgggtgacggcgctctccggcagccggggatggccgtgtccgcactgaccaggcctgtggagagtgctcggcctaaccttagaacacatttgtaactgaatacagtgttttcaatttgtacagaatagttagaatattctattaaagtggtgaaacattgagtcagc

SEQ ID NO: 20948 - DNA, 860 bp, Homo sapiens
ggtcggggcaggcagcggcggccgcggcggggcctggggcttggggcctggagcccgggcctggggcgctggcgggaggcccctcccaactcccggcgcgcctcgcccggctgcccgcctcactgaaggtcaaggcgctttgttctgcgccgcgggcggcctcctgggcggcggccccttggaggaggcgaagacggcgagaggcggcggccgctcaaatctcccgctagcccagcccgccccgcgtgcgggggctgtggcggttacacggccgggcgcgccggagcgttcaggcttcccgtttttaaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattggctggagacatgaaaagtaaagtagtcgtcacagaaaaagcagcggcaacggctgaagagccagatcccaaaggaattccagagttctggtttaccatcttcagaaatgtggacatgctgagtgaattagtccag

SEQ ID NO: 20949 - DNA, 1941 bp, Homo sapiens
cttgctcgcggagagaggagctaggagcctcggccaatgggagccggcgttgttggaggccacggcggcgcagccccaaagcgagcgaagctagggtcgccgccactgccgcaggaggcgtgagggaaaagtgttttaggcttccagagtagaaatctgatattacttcgtttgattcttcgaccactatggtgataggaagtagctgatctctgcaggaaactgctgttacctggcctcagctgaatttttgtgggacctcctgaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattggctggagacatgaaaagtaaagtagtcgtcacagaaaaagcagcggcaacggctgaagagccagatcccaaaggaattccagagttctggtttaccatcttcagaaatgtggacatgctgagtgaattagtccaggaatatgatgaaccaatcttgaaacacctgcaggatattaaagtgaaattttctgaccctggacagcctatgtcttttgtgttagagttccactttgaacccaacgactactttaccaactcagtcctgacaaaaacctacaagatgaaatcagaaccagataaggctgatcccttttcctttgaaggtcctgagattgtggactgtgacgggtgtactattgactggaagaaaggaaagaatgttactgtcaaaaccatcaagaaaaagcagaagcataagggtcgaggcactgttagaacaattacgaaacaagtacccaatgagtcctttttcaacttcttcaatccattgaaagcatccggggatggagaatcactggatgaagattctgaattcacattagcctctgattttgaaattggacactttttccgtgagcggatagtcccgcgggctgtgctgtacttcactggggaggccatagaagatgatgacaattttgaagaaggtgaagaaggagaagaggaggaattagaaggtgacgaggagggagaagacgaggatgatgcggaaattaaccccaagaaggaacccagccagccggcggaatgcaagcagcagtaggaagcggaggcgggtgcctggcagaccggctgtcgggactccaggcctgtgggcggggcctcggtccttgccgcagcacaatcccgtggacagagcttactccatctaactcgttttcaagtgcatgattttcactttcacttttcctttttccttattattttgcttaacttgtacagtggcaactgaaatgcatttcagaaataggaggtttcgtccagcaccctctgcagccttggtgcctgtagctctggacttccctgggcctttccctgtgggagggccctgtagaccacatcagggtggggtgggggtcacttggcaaaaagggccgaggtctggtgatgtggttcccaggatctggaacctctcccacccctcctgcagttggactgaattcttccctttcatccgaagaaacccacttgctgtttccagccgctgaatctgctgagtgtgcagcctgcatcacctgctgtatgccgatcatctcaga

SEQ ID NO: 20950 - DNA, 535 bp, Homo sapiens
aggcgtgaggtgcggagacacgggtgctgggccggctggagtgcagtggcttgatcttggctcacggcaacctctgcctcctgtattcaagcgattctcctgcctcagcctcccgagtagctgggattacaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaaga

SEQ ID NO: 20951 - DNA, 587 bp, Homo sapiens
gtgaggtgcggagacacgggtgctgggccggaagtagctgatctctgcaggaaactgctgttacctggcctcagctgaatttttgtgggacctcctgagggcttggcaccgcagaagtctctgaagagacagtctgctgctgtttggaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattggctggagacatgaaaagtaaag

SEQ ID NO: 20952 - DNA, 625 bp, Homo sapiens
aaagtgttttaggcttccagagtagaaatctgatattacttcgtttgattcttcgaccactatggtgataggaagtagctgatctctgcaggaaactgctgttacctggcctcagctgaatttttgtgggacctcctgagagacgaggtttccccatgttgcccaggctggtctgaaactcctgagcttcaggtgatctgtgataggggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaagagaatttatcaccggcgatgttgaaccaacagatgcggaatcggaatggcacagtgaaaatgaagaggaagagaaattgg

SEQ ID NO: 20953 - DNA, 572 bp, Homo sapiens
cgtgaggtgcggagacacgggtgctgggccggtttacggggtgaaaatagacttttaaaaattctcttaccttagaaatatacaaatatgtagattaggttgttggaccttaaaggaagtagctgatctctgcaggaaactgctgttacctggcctcagctgaatttttgtgggacctcctgagggcttggcaccgcagaagtctctgaagagacagtctgctgctgtttggaggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctcacatagaagccaagttctatgaagaggtacatgacttggaaagaaagtatgcagcgctataccagcctctctttgacaagagaaga

SEQ ID NO: 20954 - DNA, 544 bp, Homo sapiens
gtgaggtgcggagacacgggtgctgggccgggaaaagtgttttaggcttccagagtagaaatctgatattacttcgtttgattcttcgaccactatggtgataggaagtagctgatctctgcaggaaactgctgttacctggcctcagctgaatttttgtgggacctcctgagggcttggcaccgcagaagtctctgaagagacagtctgctgctgtttggagagacgaggtttccccatgttgcccaggctggtctgaaactcctgagcttcaggtgatctgtgataggggggataaaaacattcagatggcagatcacagtttttcagatggggttccttcagattccgtggaagctgctaaaaatgcaagtaacacagaaaagctcacagatcaggtgatgcagaatcctcgagttctggcagctttacaggagcgacttgacaatgtccctcacaccccttccagctacatcgaaactttacctaaagcagtaaaaagaagaattaatgcattgaaacaacttcaggtgagatgtgctca

SEQ ID NO: 20955 - DNA, 2321 bp, Homo sapiens
tctaagaggtgatcaaacgccagctatggagagagatgcagaggaaagcgaagacatatgcactggcatttgtagaagggcctggatgggggtgaggagcacacggaaaatggtctgaggccatctatgcagttcctgaagaagcacctcgggcagctactgacactcccagcccagctctacaggggtgggtacatgggtgggctgggaacagggtgtctgtccaacaggcgggtgttgagggcccagaagatgtcagggtagcaacaggaggaatctggtgcagtatgagcacacggccgtcagctgatagtgggaagccagtcaagtgccgcgaaagcaggaggcggggccgcggccaacgtcattcccgcggccgcacgtcaccgccacttgccgcatccgcaagatctctctggaccagctcgggtgcagggcctctgcgggagccctcctagacctctgcggcttctcctctaacatggccgactcggaaaaccaggggcctgcggagcctagccaggcggcggcagcggcggaggcagcggcagaggaggtaatggcggaaggcggtgcgcagggtggagactgtgacagcgcggctggtgaccctgacagcgcggctggtcagatggctgaggagccccagacccctgcagagaatgccccaaagccgaaaaatgactttatcgagagcctgcctaattcggtgaaatgccgagtcctggccctcaaaaagctgcagaagcgatgcgataagatagaagccaaatttgataaggaatttcaggctctggaaaaaaagtataatgacatctataagcccctactcgccaagatccaagagctcaccggcgagatggaggggtgtgcatggaccttggagggggaggaggaggaggaagaggagtacgaggatgacgaggaggagggggaagacgaggaggaggaggaggctgcggcagaggctgccgcgggggccaaacatgacgatgcccacgccgagatgcctgatgacgccaagaagtaaggggggcagagatggatgaagagaaagcccacgaagaaaaaagcctggttttgtttttcccagaatatcgatggacttaaaaaggctcaggtttttgaccaaaatacaatgtgaatttattctgacattcctaaaatagattaaattaaagcaattagatcctggccagctcgattcaaatttgactttcattttgaacataataaatatatcaaaaggtgttaaagaaaactgaattaaacccaaaattatgttttcatggtctcttctctgaggattgaggtttacaaagggtgttagcagatgcgaagtaaagaacgtcactttgaaacccattcatcacacagcatacgctacacatggaacacccaagccatgactgaacacgttctcagtgcttaattcttaaatttctttactcatgacatttcgcagtgcagagaaggcagaacccaagaaaaacgtcatctttgagactttgcttttgtaacgcagacatcagctttacacttcacaggagattgatggcattgaggaagattgcaatggagatcatgacactactgttaataaggccaggaaaactgccatttcaagttctgaaaaatgttttgagtatttgaatttagagaaacaacatggttccaagaaggagggtgtaaaacctgtaaaatactgtcaacatatgtattcattagttacaatctcatgtttgtgttttcttagtactgtctatttacaaacacgtaaaaaataccccaaatatgtttaagtattaaatcactttacctagcgttttagaaatattaatttacttgaagagatgtagaatgtagcaaattatgtaaagcatgtgtatccagcgttatgtactttgcgccttgtgacgtctttctgtcatgtagcttttagggtgtagctgtgaaaatcatcagaactcttcactgaagctaatgtttggaaaaaatatatacttgaagaaccaatccaagtgtgtgcccctacccccagctcagaagtagaaagggtttaagtttgcttgtattagctgtgccttcattattttgctatgtaaatgtgacatattaattataaaatggtgcataatcaaattttactgcttgaggacagatgcatacagtaaggatttttaggaagaatatatttaatgtaaagactcttagcttctgtgtgggttttgaattatgtgtgagccagtgatctataaagaaacataagcttaaagttgtttatcactgtggtgttaataaaacagtattttcaaaaaata

SEQ ID NO: 20956 - DNA, 1889 bp, Homo sapiens
agctcgggtgcagggcctctgcgggagccctcctagacctctgcggcttctcctctaacatggccgactcggaaaaccaggggcctgcggagcctagccaggcggcggcagcggcggaggcagcggcagaggaggtaatggcggaaggcggtgcgcagggtggagactgtgacagcgcggctggtgaccctgacagcgcggctggtcagatggctgaggagccccagacccctgcagagaatgccccaaagccgaaaaatgactttatcgagagcctgcctaattcggtgaaatgccgagtcctggccctcaaaaagctgcagaagcgatgcgataagatagaagccaaatttgataaggaatttcaggctctggaaaaaaagtataatgacatctataagcccctactcgccaagatccaagagctcaccggcgagatggaggggtgtgcatggaccttggagggggaggagaggaggaagagggtacgaggatgacgaggaggagggggaagacgaggaggaggaggaggctgcggcagaggctgccgcgggggccaaacatgacgatgcccacgccgagatgcctgatgacgccaagaagtaaggggggcagagatggatgaagagaaagcccacgaagaaaaaagcctggttttgtttttcccagaatatcgatggacttaaaaaggctcaggtttttgaccaaaatacaatgtgaatttattctgacattcctaaaatagattaaattaaagcaattagatcctggccagctcgattcaaatttgactttcattttgaacataataaatatatcaaaaggtgttaaagaaaactgaattaaacccaaaattatgttttcatggtctcttctctgaggattgaggtttacaaagggtgttagcagatgcgaagtaaagaacgtcactttgaaacccattcatcacacagcatacgctacacatggaacacccaagccatgactgaacacgttctcagtgcttaattcttaaatttctttactcatgacatttcgcagtgcagagaaggcagaacccaagaaaaacgtcatctttgagactttgcttttgtaacgcagacatcagctttacacttcacaggagattgatggcattgaggaagattgcaatggagatcatgacactactgttaataaggccaggaaaactgccatttcaagttctgaaaaatgttttgagtatttgaatttagagaaacaacatggttccaagaaggagggtgtaaaacctgtaaaatactgtcaacatatgtattcattagttacaatctcatgtttgtgttttcttagtactgtctatttacaaacacgtaaaaaataccccaaatatgtttaagtattaaatcactttacctagcgttttagaaatattaatttacttgaagagatgtagaatgtagcaaattatgtaaagcatgtgtatccagcgttatgtactttgcgccttgtgacgtctttctgtcatgtagcttttagggtgtagctgtgaaaatcatcagaactcttcactgaagctaatgtttggaaaaaatatatacttgaagaaccaatccaagtgtgtgcccctacccccagctcagaagtagaaagggtttaagtttgcttgtattagctgtgccttcattattttgctatgtaaatgtgacatattaattataaaatggtgcataatcaaattttactgcttgaggacagatgcatacagtaaggatttttaggaagaatatatttaatgtaaagactcttagcttctgtgtgggttttgaattatgtgtgagccagtgatctataaagaaacataagcttaaagttgtttatcactgtggtgttaataaaacagtattttc

SEQ ID NO: 20957 - DNA, 1252 bp, Homo sapiens
gacagcgggttccggtgaccacgaaggcggcaaaggcgacggaatggaggaggtgcctcacgactgtccaggggccgacagcgcccaggcgggcagaggggcttcatgtcagggatgccccaaccagcggctgtgcgcttctggagcgggggccactccggacacggctatagaggaaatcaaagagaaaatgaagactgtaaaacacaaaatcttggtattgtctgggaaaggcggtgttgggaaaagcacattcagcgcccaccttgcccatggcctagcagaggatgaaaacacacagattgctcttctagacatcgatatatgtgggccatcgattcccaagataatgggattggaaggagagcaggttcaccagagtggctcaggctggtctccagtgtacgtggaagacaacctgggggtgatgtcagtgggcttcctgctcagcagtcctgatgatgctgttatctggaggggacccaagaaaaacggcatgatcaagcagttcctccgagatgtggactggggagaggtcgactacctcattgtggacaccccacctgggacgtcggatgaacacctctcggtcgtccggtacctggccacagcacacatcgatggagcagtgatcatcaccactccccaggaggtgtcactccaggatgtccggaaagaaatcaacttctgccgcaaggtgaagctgcccatcatcggggtggtggagaacatgagtggcttcatctgtcctaagtgcaagaaagaatctcagatattccctcccacaaccgggggcgcggagctcatgtgccaggacttggaggtccctctcctcggcagagtgcccctggatccgctcataggtaagaattgtgacaaaggccagtcttttttcattgacgccccagattccccagccacgttagcctacagaagtataattcagagaatccaagagttttgtaatctccatcagtcaaaagaagagaacctcatcagttcctgaaacgagagaatgttcaggaccaagcagttaccgagcgaggcactcactgggcagcacatccagccagacccgaccagctccgggatggggtgggtcacagcaaaaggaccagatgctggtgtggtccgaagccactttctcagagacactttaatcattgagtatttgtacacttttctttagaacatatataaagggcattctctacaaatgtgccgttttaagaataaaaccccctcaaatctc

SEQ ID NO: 20958 - DNA, 1195 bp, Homo sapiens
aggcggcaaaggcgacggaatggaggaggtgcctcacgactgtccaggggccgacagcgcccaggcgggcagaggggcttcatgtcagggatgccccaaccagcggctgtgcgcttctggagcgggggccactccggacacggctatagaggaaatcaaagagaaaatgaagactgtaaaacacaaaatcttggtattgtctgggaaaggcggtgttgggaaaagcacattcagcgcccaccttgcccatggcctagcagaggatgaaaacacacagattgctcttctagacatcgatatatgtgggccatcgattcccaagataatgggattggaaggagagcagtacgtggaagacaacctgggggtgatgtcagtgggcttcctgctcagcagtcctgatgatgctgttatctggaggggacccaagaaaaacggcatgatcaagcagttcctccgagatgtggactggggagaggtcgactacctcattgtggacaccccacctgggacgtcggatgaacacctctcggtcgtccggtacctggccacagcacacatcgatggagcagtgatcatcaccactccccaggaggtgtcactccaggatgtccggaaagaaatcaacttctgccgcaaggtgaagctgcccatcatcggggtggtggagaacatgagtggcttcatctgtcctaagtgcaagaaagaatctcagatattccctcccacaaccgggggcgcggagctcatgtgccaggacttggaggtccctctcctcggcagagtgcccctggatccgctcataggtaagaattgtgacaaaggccagtcttttttcattgacgccccagattccccagccacgttagcctacagaagtataattcagagaatccaagagttttgtaatctccatcagtcaaaagaagagaacctcatcagttcctgaaacgagagaatgttcaggaccaagcagttaccgagcgaggcactcactgggcagcacatccagccagacccgaccagctccgggatggggtgggtcacagcaaaaggaccagatgctggtgtggtccgaagccactttctcagagacactttaatcattgagtatttgtacacttttctttagaacatatataaagggcattctctacaaatgtgccgttttaagaataaaaccccctcaaatctc

SEQ ID NO: 20959 - DNA, 1413 bp, Homo sapiens
aagaagagccacgggcgggcacgcactgcccattggttggaaggcccttcgctctagctgggaggctgacggcccgcgggcgtaagcggactgcagccgcgagctcctggaggcggcgggatggaggcggcggccgagcctggaaacctggccggcgtcaggcacatcatcctggtcctctcaggaaaggggggcgttgggaaaagcaccatctccacggagctggccctggcactgcgccatgcaggcaagaaggtgggaatcctggatgtggacctgtgtggccccagtatcccccgcatgctcggggcgcagggcagggctgtgcaccagtgcgaccgcggctgggcacccgtcttcctggaccgggagcagagcatctcgctcatgtctgtgggcttcctgctggagaagccggacgaggccgtggtgtggagaggccccaagaaaaacgcgctgataaagcagtttgtgtccgacgtggcctggggggagctggactacctggtggtggacacgcccccggggacctccgatgagcacatggccaccatagaagccctgcgtccctaccagcccctgggggccctcgtggtcaccacgccccaggcggtgtccgtgggggacgtgaggcgcgagctgaccttctgtaggaagacgggcttgcgggtgatgggaatcgtggagaatatgagcggcttcacctgcccacactgcacggagtgcaccagcgtcttctccaggggcggcggagaggagctggcccagctcgccggggtgcccttcttaggctccgtgcccctggaccctgcgctcatgaggaccctggaggagggccacgacttcatccaggagttccctgggagccccgccttcgctgcactcacctccatagcccagaagattctggacgcgacgcccgcgtgcctcccctgactaaggccaccttgcagccgctttccagggccaccaagggctctgctccagcctctcagagaaacagaggcctgggctcggttcccgggccctgcaggggcaggcccaggcagcgtcagccggagagcttctccccgaccagcccagccccaggatgtgtcgcaccagcagctctgcctggttggcctgcagtgccgtggtctgcgtgctctgcagctgtgagacgggggcggcctgggctctcttcccatccatgttgcctacctgtgcccctggcagccgcgtgtccacacagttagcggagcgcgggacttctgcagtcctcaggtgaccccgggcctccagcaccctgggtcgctgtcatctgtgtttagctcggggagtgccccctaagggggcgaactgacctcaggcatgttttgtaactgtagaggcgcctgccattaaacgtgtccgctgctgtggcgacagatctga

SEQ ID NO: 20960 - DNA, 1016 bp, Homo sapiens
actgcagccgcgagctcctggaggcggcgggatggaggcggcggccgagcctggaaacctggccggcgtcaggcacatcatcctggtcctctcaggaaaggggggcgttgggaaaagcaccatctccacggagctggccctggcactgcgccatgcaggcaagaagcgctgataaagcagtttgtgtccgacgtggcctggggggagctggactacctggtggtggacacgcccccggggacctccgatgagcacatggccaccatagaagccctgcgtccctaccagcccctgggggccctcgtggtcaccacgccccaggcggtgtccgtgggggacgtgaggcgcgagctgaccttctgtaggaagacgggcttgcgggtgatgggaatcgtggagaatatgagcggcttcacctgcccacactgcacggagtgcaccagcgtcttctccaggggcggcggagaggagctggcccagctcgccggggtgcccttcttaggctccgtgcccctggaccctgcgctcatgaggaccctggaggagggccacgacttcatccaggagttccctgggagccccgccttcgctgcactcacctccatagcccagaagattctggacgcgacgcccgcgtgcctcccctgactaaggccaccttgcagccgctttccagggccaccaagggctctgctccagcctctcagagaaacagaggcctgggctcggttcccgggccctgcaggggcaggcccaggcagcgtcagccggagagcttctccccgaccagcccagccccaggatgtgtcgcaccagcagctctgcctggttggcctgcagtgccgtggtctgcgtgctctgcagctgtgagacgggggcggcctgggctctcttcccatccatgttgcctacctgtgcccctggcagccgcgtgtccacacagttagcggagcgcgggacttctgcagtcctcaggtgaccccgggcctccagcaccctgggtcgctgtcatctgt

SEQ ID NO: 20961 - DNA, 3049 bp, Homo sapiens
acccgcgacagtttcccagcagggctcacagcagcgttccgcgtcatggggatttggcagcgtctgctgctttttggtggggtgtcgctccgggctggtggcggggccactgccccgcttgggggaagccgagcgatggtttgtgggcgccagttgtctggcgccgggagtgagaccctaaaacaaagaagaacacaaatcatgtcccgaggacttccaaagcagaaaccgatagaaggtgttaaacaagttatagttgtggcttctggaaagggtggagtcggaaaatctactacagcagtgaatcttgcacttgcactagcagcgaacgattcgtccaaggccattggtttgctagatgtggatgtgtatggaccttcagttccaaagatgatgaatctgaaaggaaatccggaattatcacagagcaacctaatgaggcctctcttgaattatggtattgcttgtatgtctatgggctttctggttgaagaaagtgaaccagtagtttggagaggccttatggtaatgtcggccattgagaaattgttgaggcaggtagattggggtcaactggactacttagttgtagacatgccaccaggaactggagatgtgcagttatcagtctcacagaatattcctataacaggtgctgtgattgtctccacgccccaggacatcgcattgatggatgcacacaagggtgctgagatgtttcgcagagtccacgtgcccgtccttggccttgtccaaaacatgagtgttttccagtgtccaaaatgtaaacacaaaactcatatttttggtgctgatggtgcaaggaaactagcacagacccttggtcttgaagttctaggagacattcccttacaccttaatataagggaagcttcagatacaggccagccaattgtgttttcacagcctgaaagtgatgaggccaaagcttacttgaggattgctgtggaagtggtaagaagattgccatcaccttcagaatgattccccaagtgtcctggaaatttgcctggtactgacattaagaggacctttggaaatcagcaatgtggtgatggaacctacagaaataatagaaatcataactgttttatttctaaggaaagaatgtcttcatatttgacttgctaagctaaggttcacaaaactttgatgtatcaatgttaactgctatatttaggaattttttgaaagctggtgtgtaccacctgcaaagaactgcattttattttattgaattacccctttagaaatcacgagtttatgatgttacaagtccattttgggagagaactgtacactttttgcaggaccacagaattagtaatttaaatgatatactaaatttgtgtatgggcataagtattacgccttcccaccaggcaatttggactgtctttgaatcctgtctttggtactgtcttggacatgttcttaatatgaacctctgcttcttcatctggatcacactataccccagacttaatgaatttcagtctccaggagtggagcctgaacatatgtatttttagtaagaccatgatgatgttgatgatgattctggtaatcatggcagtaagaataatagctaacatttaacaagttaattataattgttcttccatttgtgtgagtgggtactattatctccattttacagataagtaatttgagatataatttgaaggcactcaaccttgagtgtcttgctgagggttactgtatctagcaggtgatggagcttggatttgaacttgagtaattcgatattagattcatctttttgtacaccaatgtgcttttgttaattaaaaaaagtcggtggtggctaggcgtggtggctcacgcctgtaatcccagcactttgggaggttgaggtgggtggatcatgaggtcaggagttcaagaccagcctgaccaacatggtgaaaccccgtctctactaaaaatacaaaaattagctgggtgtggtggcatatgcctgtaatcccagctactcgggaggctgaggcaggagaatcatttcaacccgggaggctgaggttgcagtgagtggagattgtaccactgcactccagcctggtcaatggagtgcgactccatctcaaaaaaaaaaaaaaaaaaaaaaaaagtcgggggagatgcaatatttagcatttcctcaaactttttttggccatgaaatccaccacccccctcctttttcagagcatttcatgaagttcacatttcaaataatacattttgaaaaacatttatcttgtctaattgaagctcaaagagatagagtcaatgacttttcaaagtcaggtagcagatagttttaaagctgcaagtactgataagtgtgagccattagttaattcgcatttataaagaagtggtctgtcacttttggcaaatgtcttgacatctgttgctctacagttgtcaactagaaaattaggcatagagtttcacattattataagcatgttttcacacaaaaacatgtacattgatgtttattgcaattttatgtgtaataaccaaaaacaacccagattttcttcattgggtaaatgattaaacaaaccatagtacattcataccgtgagtgctactcagcaataaaaaagaacaaactatgggtacaggcagcaacttataattccagagaattatgctgaatgaaaaaggccaatttaaaaaggttttgtaccaaaagattccatttatataacgttcttgaagtgacataattatagaaatggagaacagattagtggtggctgtgttaaggagggggtgaggatgggagagaattgggcgtggctgtgagaaacatgagggatccttgtgatgatggaaatgttctatatcacagctatcgatgtcagtatcccagttgtgatattgtgctatagttttgcaagatgttaccactgggggaaattgggtgaagggcacatggaatctctgtattatttcaactgcatgtaaatctacaattatctcaaaataaaaataaaagttaaaaaaacacaaa

SEQ ID NO: 20962 - DNA, 2685 bp, Homo sapiens
atgtccaaggccattggtttgctagatgtggatgtgtatggaccttcagttccaaagatgatgaatctgaaaggaaatccggaattatcacagagcaacctaatgaggcctctcttgaattatggtattgcttgtatgtctatgggctttctggttgaagaaagtgaaccagtagtttggagaggccttatggtaatgtcggccattgagaaattgttgaggcaggtagattggggtcaactggactacttagttgtagacatgccaccaggaactggagatgtgcagttatcagtctcacagaatattcctataacaggtgctgtgattgtctccacgccccaggacatcgcattgatggatgcacacaagggtgctgagatgtttcgcagagtccacgtgcccgtccttggccttgtccaaaacatgagtgttttccagtgtccaaaatgtaaacacaaaactcatatttttggtgctgatggtgcaaggaaactagcacagacccttggtcttgaagttctaggagacattcccttacaccttaatataagggaagcttcagatacaggccagccaattgtgttttcacagcctgaaagtgatgaggccaaagcttacttgaggattgctgtggaagtggtaagaagattgccatcaccttcagaatgattccccaagtgtcctggaaatttgcctggtactgacattaagaggacctttggaaatcagcaatgtggtgatggaacctacagaaataatagaaatcataactgttttatttctaaggaaagaatgtcttcatatttgacttgctaagctaaggttcacaaaactttgatgtatcaatgttaactgctatatttaggaattttttgaaagctggtgtgtaccacctgcaaagaactgcattttattttattgaattacccctttagaaatcacgagtttatgatgttacaagtccattttgggagagaactgtacactttttgcaggaccacagaattagtaatttaaatgatatactaaatttgtgtatgggcataagtattacgccttcccaccaggcaatttggactgtctttgaatcctgtctttggtactgtcttggacatgttcttaatatgaacctctgcttcttcatctggatcacactataccccagacttaatgaatttcagtctccaggagtggagcctgaacatatgtatttttagtaagaccatgatgatgttgatgatgattctggtaatcatggcagtaagaataatagctaacatttaacaagttaattataattgttcttccatttgtgtgagtgggtactattatctccattttacagataagtaatttgagatataatttgaaggcactcaaccttgagtgtcttgctgagggttactgtatctagcaggtgatggagcttggatttgaacttgagtaattcgatattagattcatctttttgtacaccaatgtgcttttgttaattaaaaaaagtcggtggtggctaggcgtggtggctcacgcctgtaatcccagcactttgggaggttgaggtgggtggatcatgaggtcaggagttcaagaccagcctgaccaacatggtgaaaccccgtctctactaaaaatacaaaaattagctgggtgtggtggcatatgcctgtaatcccagctactcgggaggctgaggcaggagaatcatttcaacccgggaggctgaggttgcagtgagtggagattgtaccactgcactccagcctggtcaatggagtgcgactccatctcaaaaaaaaaaaaaaaaaaaaaaaaagtcgggggagatgcaatatttagcatttcctcaaactttttttggccatgaaatccaccacccccctcctttttcagagcatttcatgaagttcacatttcaaataatacattttgaaaaacatttatcttgtctaattgaagctcaaagagatagagtcaatgacttttcaaagtcaggtagcagatagttttaaagctgcaagtactgataagtgtgagccattagttaattcgcatttataaagaagtggtctgtcacttttggcaaatgtcttgacatctgttgctctacagttgtcaactagaaaattaggcatagagtttcacattattataagcatgttttcacacaaaaacatgtacattgatgtttattgcaattttatgtgtaataaccaaaaacaacccagattttcttcattgggtaaatgattaaacaaaccatagtacattcataccgtgagtgctactcagcaataaaaaagaacaaactatgggtacaggcagcaacttataattccagagaattatgctgaatgaaaaaggccaatttaaaaaggttttgtaccaaaagattccatttatataacgttcttgaagtgacataattatagaaatggagaacagattagtggtggctgtgttaaggagggggtgaggatgggagagaattgggcgtggctgtgagaaacatgagggatccttgtgatgatggaaatgttctatatcacagctatcgatgtcagtatcccagttgtgatattgtgctatagttttgcaagatgttaccactgggggaaattgggtgaagggcacatggaatctctgtattatttcaactgcatgtaaatctacaattatctc

SEQ ID NO: 20963 - DNA, 4485 bp, Homo sapiens
gtagacagatccaggctcaccagtcctgtgccactgggcttttggcgttctgcacaaggcctacccgcagatgccatgcctgctcccccagcctaatgggctttgatgggggaagagggtggttcagcctctcacgatgaggaggaaagagcaagtgtcctcctcggacattctccgggttgtgaaatgtgctcgcaggaggcttttcaggcacagaggagccagctggtcgagctgctggtctcagggtccctggaaggcttcgagagtgtcctggactggctgctgtcctgggaggtcctctcctgggaggactacgagggcttccacctcctgggccagcctctctcccacttggccaggcgccttctggacaccgtctggaataagggtacttgggcctgtcagaagctcatcgcggctgcccaagaagcccaggccgacagccagtcccccaagctgcatggctgctgggacccccactcgctccacccagcccgagacctgcagagtcaccggccagccattgtcaggaggctccacagccatgtggagaacatgctggacctggcatgggagcggggtttcgtcagccagtatgaatgtgatgaaatcaggttgccgatcttcacaccgtcccagagggcaagaaggctgcttgatcttgccacggtgaaagcgaatggattggctgccttccttctacaacatgttcaggaattaccagtcccattggccctgcctttggaagctgccacatgcaagaagtatatggccaagctgaggaccacggtgtctgctcagtctcgcttcctcagtacctatgatggagcagagacgctctgcctggaggacatatacacagagaatgtcctggaggtctgggcagatgtgggcatggctggacccccgcagaagagcccagccaccctgggcctggaggagctcttcagcacccctggccacctcaatgacgatgcggacactgtgctggtggtgggtgaggcgggcagtggcaagagcacgctcctgcagcggctgcacttgctgtgggctgcagggcaagacttccaggaatttctctttgtcttcccattcagctgccggcagctgcagtgcatggccaaaccactctctgtgcggactctactctttgagcactgctgttggcctgatgttggtcaagaagacatcttccagttactccttgaccaccctgaccgtgtcctgttaacctttgatggctttgacgagttcaagttcaggttcacggatcgtgaacgccactgctccccgaccgaccccacctctgtccagaccctgctcttcaaccttctgcagggcaacctgctgaagaatgcccgcaaggtggtgaccagccgtccggccgctgtgtcggcgttcctcaggaagtacatccgcaccgagttcaacctcaagggcttctctgaacagggcatcgagctgtacctgaggaagcgccatcatgagcccggggtggcggaccgcctcatccgcctgctccaagagacctcagccctgcacggtttgtgccacctgcctgtcttctcatggatggtgtccaaatgccaccaggaactgttgctgcaggagggggggtccccaaagaccactacagatatgtacctgctgattctgcagcattttctgctgcatgccacccccccagactcagcttcccaaggtctgggacccagtcttcttcggggccgcctccccaccctcctgcacctgggcagactggctctgtggggcctgggcatgtgctgctacgtgttctcagcccagcagctccaggcagcacaggtcagccctgatgacatttctcttggcttcctggtgcgtgccaaaggtgtcgtgccagggagtacggcgcccctggaattccttcacatcactttccagtgcttctttgccgcgttctacctggcactcagtgctgatgtgccaccagctttgctcagacacctcttcaattgtggcaggccaggcaactcaccaatggccaggctcctgcccacgatgtgcatccaggcctcggagggaaaggacagcagcgtggcagctttgctgcagaaggccgagccgcacaaccttcagatcacagcagccttcctggcagggctgttgtcccgggagcactggggcctgctggctgagtgccagacatctgagaaggccctgctccggcgccaggcctgtgcccgctggtgtctggcccgcagcctccgcaagcacttccactccatcccgccagctgcaccgggtgaggccaagagcgtgcatgccatgcccgggttcatctggctcatccggagcctgtacgagatgcaggaggagcggctggctcggaaggctgcacgtggcctgaatgttgggcacctcaagttgacattttgcagtgtgggccccactgagtgtgctgccctggcctttgtgctgcagcacctccggcggcccgtggccctgcagctggactacaactctgtgggtgacattggcgtggagcagctgctgccttgccttggtgtctgcaaggctctgtatttgcgcgataacaatatctcagaccgaggcatctgcaagctcattgaatgtgctcttcactgcgagcaattgcagaagttagctctattcaacaacaaattgactgacggctgtgcacactccatggctaagctccttgcatgcaggcagaacttcttggcattgaggctggggaataactacatcactgccgcgggagcccaagtgctggccgaggggctccgaggcaacacctccttgcagttcctgggattctggggcaacagagtgggtgacgagggggcccaggccctggctgaagccttgggtgatcaccagagcttgaggtggctcagcctggtggggaacaacattggcagtgtgggtgcccaagccttggcactgatgctggcaaagaacgtcatgctagaagaactctgcctggaggagaaccatctccaggatgaaggtgtatgttctctcgcagaaggactgaagaaaaattcaagtttgaaaatcctgaagttgtccaataactgcatcacctacctaggggcagaagccctcctgcaggcccttgaaaggaatgacaccatcctggaagtctggctccgagggaacactttctctctagaggaggttgacaagctcggctgcagggacaccagactcttgctttgaagtctccgggaggatgttcgtctcagtttgtttgtgagcaggctgtgagtttgggccccagaggctgggtgacatgtgttggcagcctcttcaaaatgagccctgtcctgcctaaggctgaacttgttttctgggaacaccataggtcacctttattctggcagaggagggagcatcagtgccctccaggatagacttttcccaagcctacttttgccattgacttcttcccaagattcaatcccaggatgtacaaggacagcccctcctccatagtatgggactggcctctgctgatcctcccaggcttccgtgtgggtcagtggggcccatggatgtgcttgttaactgagtgccttttggtggagaggcccggcctctcacaaaagaccccttaccactgctctgatgaagaggagtacacagaacacataattcaggaagcagctttccccatgtctcgactcatccatccaggccattccccgtctctggttcctcccctcctcctggactcctgcacacgctccttcctctgaggctgaaattcagaatattagtgacctcagctttgatatttcacttacagcacccccaaccctggcacccagggtgggaagggctacaccttagcctgccctcctttccggtgtttaagacatttttggaaggggacacgtgacagccgtttgttccccaagacattctaggtttgcaagaaaaatatgaccacactccagctgggatcacatgtggacttttatttccagtgaaatcagttactcttcagttaagcctttggaaacagctcgactttaaaaagctccaaatgcagctttaaaaaattaatctgggccagaatttcaaacggcctcactaggcttctggttgatgcctgtgaactgaactctgacaacagacttctgaaatagacccacaagaggcagttccatttcatttgtgccagaatgctttaggatgtacagttatggattgaaagtttacaggaaaaaaaattaggccgttccttcaaagcaaatgtcttcctggattattcaaaatgatgtatgttgaagcctttgtaaattgtcagatgctgtgcaaatgttattattttaaacattatgatgtgtgaaaactggttaatatttataggtcactttgttttactgtcttaagtttatactcttatagacaacatggccgtgaactttatgctgtaaataatcagaggggaataaactgttgagtcaaaac

SEQ ID NO: 20964 - DNA, 1300 bp, Homo sapiens
aacaacagatctgggaaggctgcagagggcacgatggggtctggatcgagggcggctgagaccagagggaaaggtgtgaccctgagtcaccctcgctgtcccggggaaaccacctcccaggacagctgcctactgtggctcctgcctggaattgtcacactgctgtgcaaacagcgtcccgctgcccctttccctttgctgggggaaaatgaagttgtgggagccgctgagtaaactagacctagcagcgagggcacctgatgtggctgctgcctcccgggcaggtcttcaatgctttcttcccttccaggctggggaataactacatcactgccgcgggagcccaagtgctggccgaggggctccgaggcaacacctccttgcagttcctgggattctggggcaacagagtgggtgacgagggggcccaggccctggctgaagccttgggtgatcaccagagcttgaggtggctcagcctggtggggaacaacattggcagtgtgggtgcccaagccttggcactgatgctggcaaagaacgtcatgctagaagaactctgcctggaggagaaccatctccaggatgaaggtgtatgttctctcgcagaaggactgaagaaaaattcaagtttgaaaatcctgaagttgtccaataactgcatcacctacctaggggcagaagccctcctgcaggcccttgaaaggaatgacaccatcctggaagtctggctccgagggaacactttctctctagaggaggttgacaagctcggctgcagggacaccagactcttgctttgaagtctccgggaggatgttcgtctcagtttgtttgtgagcaggctgtgagtttgggccccagaggctgggtgacatgtgttggcagcctcttcaaaatgagccctgtcctgcctaaggctgaacttgttttctgggaacaccataggtcacctttattctggcagaggagggagcatcagtgccctccaggatagacttttcccaagcctacttttgccattgacttcttcccaagattcaatcccaggatgtacaaggacagcccctcctccatagtatgggactggcctctgctgatcctcccaggcttccgtgtgggtcagtggggcccatggatgtgcttgttaactgagtgccttttggtggagaggcccggcctctcacaaaagaccccttaccactgctctgatgaagaggagtacacagaacacataattcaggaagcagctttccccatgtctcgactcatccatccaggccattccccgtctctggtt

SEQ ID NO: 20965 - DNA, 3162 bp, Homo sapiens
ctctcctagacaccatgccacaaggagagtgatctcttcccctgttttcacaatggaggactccggaaagactttcagctccgaggaggaagaagctaactattggaaagatctggcgatgacctacaaacagagggcagaaaatacgcaagaggaactccgagaattccaggagggaagccgagaatatgaagctgaattggagacgcagctgcaacaaattgaaaccaggaacagagacctcctgtccgaaaataaccgccttcgcatggagctggaaaccatcaaggagaagtttgaagtgcagcactctgaaggctaccggcagatctcagccttggaggatgacctcgcgcagaccaaagccattaaagaccaattgcagaaatacatcagagagctggagcaagcaaatgacgacctggaaagagccaagcgcgccacgatcatgtctctcgaagactttgagcagcgcttgaatcaggccatcgaaagaaatgccttcctggaaagtgaacttgatgaaaaagagaatctcctggaatctgttcagagactgaaggatgaagccagagatttgcggcaggaactggccgtgcagcagaagcaggagaaacccaggacccccatgcccagctcagtggaagctgagaggacagacacagctgtgcaggccacgggctccgtgccgtccacgcccattgctcaccgaggacccagctcaagtttaaacacacctgggagcttcagacgtggcctggacgactccaccggggggacccccctcacacctgcggcccggatatcagccctcaacattgtgggagacctactgcggaaagtcggggcactggagtccaaactcgcttcctgccggaacctcgtgtacgatcagtccccaaaccgaacaggtggcccagcctctgggcggagcagcaagaacagagatggcggggagagacggccaagcagcaccagcgtgcctttgggtgataaggggttggacacgagttgccgctggttgtccaaatcaacaaccaggtcgtccagctcctgctgaagcctgttcttggtcttttccagtttatcataagcggccgccttctcctcgtactgctgggtgaggttctcgatctccttctggaacctcttcttcccctcttccagagcttccacggtgctggcaaagtcctgcagcttcttcttcgagtcggagagctacaaggacagcgtccagggtagggtgagagggggaccatgagtggcccctgtccctggccccacagactctgagaagcgaagaccatgtctcctcgttggagaaacccaatagcaggggaagctggggggtcaagcaccatcgcaccaacactccaccgcgatctgcctgcgggggatctcagcgcagagaagttgagaggacccatgaaggaagcaaggacacggggcaggcacctggatgttgagagtggagatgtggcgctccaggttctgcttggcctccatctcctcgtccagctggtcttgcaggctgttccgctcctcctccagctggcgcagcttcgtagacacgttgagcttctgccgggtttcttcttgaagcagctcctgcaaaagggatgcaaagaggtcccagggacctgccccgaggaaggccaccccccaggtcccctggatgatgtggcaggacactcacctgggtgtcctggagctgggaactgagggacgccacgtccttggccagcttaatggccttcccctcggcctcgttaagcatccctgtgacgctctcaacttcattctaagggtgccaagagactggttagtcaaagcctctagaaggggatcctcgttgaaaggagccctttttactcaaaacacatgggctagtacttgaggtgttcactgattgagaaaatacccgtgaggtatgggactctgataaaaaaaaaaaaaaacacacacacacacaaaaaaaacagaatctgtggcttgaagggaactccgtcacctatgagttgggaccctggccctagactctgtggttctaagaacttatttgagccccaatggtattgactgggacctgatcccactaaatggatcctagatccctgccaaggttggtagagacaaagcagcaggtctgagagtccagacgaggtgctctggctggtccactctctaaggctggagaagggagaccaggatggtacttgaacgtcccagggatgctgtcccatcccttccttcctcactcctactctttgaccctgatggccaaagccagagacgcaggccctaaaggtaaaaacgtcctctctgtattctctggcttttactccctagtgtctctgcataagtccctttgaggctgttagcctacccctccatctcttccattgacaaggaggatatgaatgatcttgacactgcttatatgagggcggcaaaagccctgctctcaactgcatgtgagaaaaaaacatctcacttaattcttccctcgccccttggtccctggctgtggacatgttaaacatttgtgaaaactttggccacgtccccatgagtggcaaggcagggtaaatggctatgccaagtgaaagaagaccaaagacaaaaagaccatgtcattcagcagcttaaaacccctcaacagcttcacattgcccagagtaaggatcaacatacatgtaataggttctcaaaagccctacatcatctgggtacaagctccccctccaaccccactctgtactatctccccctacccccaaccccagctgggcactccagctctactggctgtatgtctctctcctaatttttctacttaccacagggcctttgcacacgctgttccctctgcctggtagacttatccatgctccttagggaagcctttcgtggctcctcctcccccaggttaggccccctggttatttacacttgggcatcatgtgccttccctttgctgcatcatttgacattcatttgtgtgattattcatgtctttcccttcccttcccttccccttactcggctggagtcctactggggcagcgacagtgtctcttcttccttgctgttggatctcaggattaagcacagtgcctggcatacagcaggtgctcaataaatacttatcaaattggaaaa

SEQ ID NO: 20966 - DNA, 1867 bp, Homo sapiens
ggggggggcggggcctcgcggccctgcagcctcgtcaggctcagtcccctcccgataaacccctaaatagggactttcccggggggtgaccctggcttttttggcgaaaacccccagtttaaggaggccttccccctggcttcacgttgtggagtcgaaaggaaccttgaagcggagaatgagctcgtgacgtggacccgaggaaaaaacctgccaaccaggatttaatagaattcagctctttcaggctttggagggaaggcgatttgaacgggatttcaatgaaaaaccctgtcccttcggctttttttttttcctctctcgggtctcgtcacgtgatggtcctactttatttttaaaaattaaatggcgcatattccccagcatcctaaatctagtgcaacctagtggcaagtggagaaaaaaataactgccaacctggcttcctacgaggtcccccggagttctcgcaaagttgcgacccagttggcaaaaatacagtgtgtgcaaagactcaactggacattgccaccaagaatcaagagatttttggggactttagcaagaaaacgttatttttaaaagccctgctccaaagctggttacaaatgaatactgcgtttccagtgacaggttgggcgagcagaaaggaaatcttacgacggagtcttgccctgtcgcctaggctagagtgcagtggtgtgatctcggctcactgcaaccgccacctcccggtttcccgtgattctcctgcctcagcctcctgagtagctgggattacagacaccatgccacaaggagagtgatctcttcccctgttttcacaatggaggactccggaaagactttcagctccgaggaggaagaagctaactattggaaagatctggcgatgacctacaaacagagggcagaaaatacgcaagaggaactccgagaattccaggagggaagccgagaatatgaagctgaattggagacgcagctgcaacaaattgaaaccaggaacagagacctcctgtccgaaaataaccgccttcgcatggagctggaaaccatcaaggagaagtttgaagtgcagcactctgaaggctaccggcagatctcagccttggaggatgacctcgcgcagaccaaagccattaaagaccaattgcagaaatacatcagagagctggagcaagcaaatgacgacctggaaagagccaagcgcgccacgatcatgtctctcgaagactttgagcagcgcttgaatcaggccatcgaaagaaatgccttcctggaaagtgaacttgatgaaaaagagaatctcctggaatctgttcagagactgaaggatgaagccagagatttgcggcaggaactggccgtgcagcagaagcaggagaaacccaggacccccatgcccagctcagtggaagctgagaggacagacacagctgtgcaggccacgggctccgtgccgtccacgcccattgctcaccgaggacccagctcaagtttaaacacacctgggagcttcagacgtggcctggacgactccaccggggggacccccctcacacctgcggcccggatatcagccctcaacattgtgggagacctactgcggaaagtcggggcactggagtccaaactcgcttcctgccggaacctcgtgtacgatcagtccccaaaccgaacaggtggcccagcctctgggcggagcagcaagaacagagatggcggggagagacggccaagcagcaccagcgtgcctttgggtgataaggggttggggaagcgcctggaatttgggaagccgccttcacacatgtcttcatcgccgctgccgtcagcccagggggtagtcaagatgttgctttag

SEQ ID NO: 20967 - DNA, 3221 bp, Homo sapiens
ggggccgcaccgcccttcgcagccgcctctgccgccgccgccgcgttggcctcgccgcccctgctcggacaccatgccacaaggagagtgatctcttcccctgttttcacaatggaggactccggaaagactttcagctccgaggaggaagaagctaactattggaaagatctggcgatgacctacaaacagagggcagaaaatacgcaagaggaactccgagaattccaggagggaagccgagaatatgaagctgaattggagacgcagctgcaacaaattgaaaccaggaacagagacctcctgtccgaaaataaccgccttcgcatggagctggaaaccatcaaggagaagtttgaagtgcagcactctgaaggctaccggcagatctcagccttggaggatgacctcgcgcagaccaaagccattaaagaccaattgcagaaatacatcagagagctggagcaagcaaatgacgacctggaaagagccaagcgcgccacgatcatgtctctcgaagactttgagcagcgcttgaatcaggccatcgaaagaaatgccttcctggaaagtgaacttgatgaaaaagagaatctcctggaatctgttcagagactgaaggatgaagccagagatttgcggcaggaactggccgtgcagcagaagcaggagaaacccaggacccccatgcccagctcagtggaagctgagaggacagacacagctgtgcaggccacgggctccgtgccgtccacgcccattgctcaccgaggacccagctcaagtttaaacacacctgggagcttcagacgtggcctggacgactccaccggggggacccccctcacacctgcggcccggatatcagccctcaacattgtgggagacctactgcggaaagtcggggcactggagtccaaactcgcttcctgccggaacctcgtgtacgatcagtccccaaaccgaacaggtggcccagcctctgggcggagcagcaagaacagagatggcggggagagacggccaagcagcaccagcgtgcctttgggtgataaggggttggacacgagttgccgctggttgtccaaatcaacaaccaggtcgtccagctcctgctgaagcctgttcttggtcttttccagtttatcataagcggccgccttctcctcgtactgctgggtgaggttctcgatctccttctggaacctcttcttcccctcttccagagcttccacggtgctggcaaagtcctgcagcttcttcttcgagtcggagagctacaaggacagcgtccagggtagggtgagagggggaccatgagtggcccctgtccctggccccacagactctgagaagcgaagaccatgtctcctcgttggagaaacccaatagcaggggaagctggggggtcaagcaccatcgcaccaacactccaccgcgatctgcctgcgggggatctcagcgcagagaagttgagaggacccatgaaggaagcaaggacacggggcaggcacctggatgttgagagtggagatgtggcgctccaggttctgcttggcctccatctcctcgtccagctggtcttgcaggctgttccgctcctcctccagctggcgcagcttcgtagacacgttgagcttctgccgggtttcttcttgaagcagctcctgcaaaagggatgcaaagaggtcccagggacctgccccgaggaaggccaccccccaggtcccctggatgatgtggcaggacactcacctgggtgtcctggagctgggaactgagggacgccacgtccttggccagcttaatggccttcccctcggcctcgttaagcatccctgtgacgctctcaacttcattctaagggtgccaagagactggttagtcaaagcctctagaaggggatcctcgttgaaaggagccctttttactcaaaacacatgggctagtacttgaggtgttcactgattgagaaaatacccgtgaggtatgggactctgataaaaaaaaaaaaaaacacacacacacacaaaaaaaacagaatctgtggcttgaagggaactccgtcacctatgagttgggaccctggccctagactctgtggttctaagaacttatttgagccccaatggtattgactgggacctgatcccactaaatggatcctagatccctgccaaggttggtagagacaaagcagcaggtctgagagtccagacgaggtgctctggctggtccactctctaaggctggagaagggagaccaggatggtacttgaacgtcccagggatgctgtcccatcccttccttcctcactcctactctttgaccctgatggccaaagccagagacgcaggccctaaaggtaaaaacgtcctctctgtattctctggcttttactccctagtgtctctgcataagtccctttgaggctgttagcctacccctccatctcttccattgacaaggaggatatgaatgatcttgacactgcttatatgagggcggcaaaagccctgctctcaactgcatgtgagaaaaaaacatctcacttaattcttccctcgccccttggtccctggctgtggacatgttaaacatttgtgaaaactttggccacgtccccatgagtggcaaggcagggtaaatggctatgccaagtgaaagaagaccaaagacaaaaagaccatgtcattcagcagcttaaaacccctcaacagcttcacattgcccagagtaaggatcaacatacatgtaataggttctcaaaagccctacatcatctgggtacaagctccccctccaaccccactctgtactatctccccctacccccaaccccagctgggcactccagctctactggctgtatgtctctctcctaatttttctacttaccacagggcctttgcacacgctgttccctctgcctggtagacttatccatgctccttagggaagcctttcgtggctcctcctcccccaggttaggccccctggttatttacacttgggcatcatgtgccttccctttgctgcatcatttgacattcatttgtgtgattattcatgtctttcccttcccttcccttccccttactcggctggagtcctactggggcagcgacagtgtctcttcttccttgctgttggatctcaggattaagcacagtgcctggcatacagcaggtgctcaataaatacttatcaaattggaaaa

SEQ ID NO: 20968 - DNA, 3936 bp, Homo sapiens
ggggggggcggggcctcgcggccctgcagcctcgtcaggctcagtcccctcccgataaacccctaaatagggactttcccggggggtgaccctggcttttttggcgaaaacccccagtttaaggaggccttccccctggcttcacgttgtggagtcgaaaggaaccttgaagcggagaatgagctcgtgacgtggacccgaggaaaaaacctgccaaccaggatttaatagaattcagctctttcaggctttggagggaaggcgatttgaacgggatttcaatgaaaaaccctgtcccttcggctttttttttttcctctctcgggtctcgtcacgtgatggtcctactttatttttaaaaattaaatggcgcatattccccagcatcctaaatctagtgcaacctagtggcaagtggagaaaaaaataactgccaacctggcttcctacgaggtcccccggagttctcgcaaagttgcgacccagttggcaaaaatacagtgtgtgcaaagactcaactggacattgccaccaagaatcaagagatttttggggactttagcaagaaaacgttatttttaaaagccctgctccaaagctggttacaaatgaatactgcgtttccagtgacaggttgggcgagcagaaaggaaatcttacgacggagtcttgccctgtcgcctaggctagagtgcagtggtgtgatctcggctcactgcaaccgccacctcccggtttcccgtgattctcctgcctcagcctcctgagtagctgggattacagacaccatgccacaaggagagtgatctcttcccctgttttcacaatggaggactccggaaagactttcagctccgaggaggaagaagctaactattggaaagatctggcgatgacctacaaacagagggcagaaaatacgcaagaggaactccgagaattccaggagggaagccgagaatatgaagctgaattggagacgcagctgcaacaaattgaaaccaggaacagagacctcctgtccgaaaataaccgccttcgcatggagctggaaaccatcaaggagaagtttgaagtgcagcactctgaaggctaccggcagatctcagccttggaggatgacctcgcgcagaccaaagccattaaagaccaattgcagaaatacatcagagagctggagcaagcaaatgacgacctggaaagagccaagcgcgccacgatcatgtctctcgaagactttgagcagcgcttgaatcaggccatcgaaagaaatgccttcctggaaagtgaacttgatgaaaaagagaatctcctggaatctgttcagagactgaaggatgaagccagagatttgcggcaggaactggccgtgcagcagaagcaggagaaacccaggacccccatgcccagctcagtggaagctgagaggacagacacagctgtgcaggccacgggctccgtgccgtccacgcccattgctcaccgaggacccagctcaagtttaaacacacctgggagcttcagacgtggcctggacgactccaccggggggacccccctcacacctgcggcccggatatcagccctcaacattgtgggagacctactgcggaaagtcggggcactggagtccaaactcgcttcctgccggaacctcgtgtacgatcagtccccaaaccgaacaggtggcccagcctctgggcggagcagcaagaacagagatggcggggagagacggccaagcagcaccagcgtgcctttgggtgataaggggttggacacgagttgccgctggttgtccaaatcaacaaccaggtcgtccagctcctgctgaagcctgttcttggtcttttccagtttatcataagcggccgccttctcctcgtactgctgggtgaggttctcgatctccttctggaacctcttcttcccctcttccagagcttccacggtgctggcaaagtcctgcagcttcttcttcgagtcggagagctacaaggacagcgtccagggtagggtgagagggggaccatgagtggcccctgtccctggccccacagactctgagaagcgaagaccatgtctcctcgttggagaaacccaatagcaggggaagctggggggtcaagcaccatcgcaccaacactccaccgcgatctgcctgcgggggatctcagcgcagagaagttgagaggacccatgaaggaagcaaggacacggggcaggcacctggatgttgagagtggagatgtggcgctccaggttctgcttggcctccatctcctcgtccagctggtcttgcaggctgttccgctcctcctccagctggcgcagcttcgtagacacgttgagcttctgccgggtttcttcttgaagcagctcctgcaaaagggatgcaaagaggtcccagggacctgccccgaggaaggccaccccccaggtcccctggatgatgtggcaggacactcacctgggtgtcctggagctgggaactgagggacgccacgtccttggccagcttaatggccttcccctcggcctcgttaagcatccctgtgacgctctcaacttcattctaagggtgccaagagactggttagtcaaagcctctagaaggggatcctcgttgaaaggagccctttttactcaaaacacatgggctagtacttgaggtgttcactgattgagaaaatacccgtgaggtatgggactctgataaaaaaaaaaaaaaacacacacacacacaaaaaaaacagaatctgtggcttgaagggaactccgtcacctatgagttgggaccctggccctagactctgtggttctaagaacttatttgagccccaatggtattgactgggacctgatcccactaaatggatcctagatccctgccaaggttggtagagacaaagcagcaggtctgagagtccagacgaggtgctctggctggtccactctctaaggctggagaagggagaccaggatggtacttgaacgtcccagggatgctgtcccatcccttccttcctcactcctactctttgaccctgatggccaaagccagagacgcaggccctaaaggtaaaaacgtcctctctgtattctctggcttttactccctagtgtctctgcataagtccctttgaggctgttagcctacccctccatctcttccattgacaaggaggatatgaatgatcttgacactgcttatatgagggcggcaaaagccctgctctcaactgcatgtgagaaaaaaacatctcacttaattcttccctcgccccttggtccctggctgtggacatgttaaacatttgtgaaaactttggccacgtccccatgagtggcaaggcagggtaaatggctatgccaagtgaaagaagaccaaagacaaaaagaccatgtcattcagcagcttaaaacccctcaacagcttcacattgcccagagtaaggatcaacatacatgtaataggttctcaaaagccctacatcatctgggtacaagctccccctccaaccccactctgtactatctccccctacccccaaccccagctgggcactccagctctactggctgtatgtctctctcctaatttttctacttaccacagggcctttgcacacgctgttccctctgcctggtagacttatccatgctccttagggaagcctttcgtggctcctcctcccccaggttaggccccctggttatttacacttgggcatcatgtgccttccctttgctgcatcatttgacattcatttgtgtgattattcatgtctttcccttcccttcccttccccttactcggctggagtcctactggggcagcgacagtgtctcttcttccttgctgttggatctcaggattaagcacagtgcctggcatacagcaggtgctcaataaatacttatcaaattggaaaa

SEQ ID NO: 20969 - DNA, 698 bp, Homo sapiens
agggctttctgtatccctaggtttcttgccttgatgtactggagcaatcagatcacacggcggcttggagaaacccagggaccatgggcgcctccaggctctataccctggtgctggtcctgcagcctcagcgagttctcctgggcatgaaaaagcgaggcttcggggccggccggtggaatggctttgggggcaaagtgcaagaaggagagaccatcgaggatggggctaggagggagctgcaggaggagagcggtctgacagtggacgccctgcacaaggtgggccagatcgtgtttgagttcgtgggcgagcctgagctcatggacgtgcatgtcttctgcacagacagcatccaggggacccccgtggagagcgacgaaatgcgcccatgctggttccagctggatcagatccccttcaaggacatgtggcccgacgacagctactggtttccactcctgcttcagaagaagaaattccacgggtacttcaagttccagggtcaggacaccatcctggactacacactccgcgaggtggacacggtctagcgggagcccagggcagcccctgggcaggagacgtggctgctgaacagccgcaaaccatcttcacctgggggcattgagtggcgcagagccgggtttcatctggaattaactggatggaagggaaaataaagctatctagcggtg

SEQ ID NO: 20970 - DNA, 771 bp, Homo sapiens
agggctttctgtatccctaggtttcttgccttgatgtactggagcaatcagatcacacggcggcttggagagtgagtgcaaggttttatgagtggaattagccctcagcagatgggggagccagaaggcagttggagtgggaagaacccagggaccatgggcgcctccaggctctataccctggtgctggtcctgcagcctcagcgagttctcctgggcatgaaaaagcgaggcttcggggccggccggtggaatggctttgggggcaaagtgcaagaaggagagaccatcgaggatggggctaggagggagctgcaggaggagagcggtctgacagtggacgccctgcacaaggtgggccagatcgtgtttgagttcgtgggcgagcctgagctcatggacgtgcatgtcttctgcacagacagcatccaggggacccccgtggagagcgacgaaatgcgcccatgctggttccagctggatcagatccccttcaaggacatgtggcccgacgacagctactggtttccactcctgcttcagaagaagaaattccacgggtacttcaagttccagggtcaggacaccatcctggactacacactccgcgaggtggacacggtctagcgggagcccagggcagcccctgggcaggagacgtggctgctgaacagccgcaaaccatcttcacctgggggcattgagtggcgcagagccgggtttcatctggaattaactggatggaagggaaaataaagctatctagcggtg

SEQ ID NO: 20971 - DNA, 662 bp, Homo sapiens
ggtcagaggccacgcccccggaagcggcggtgcagaacccagggaccatgggcgcctccaggctctataccctggtgctggtcctgcagcctcagcgagttctcctgggcatgaaaaagcgaggcttcggggccggccggtggaatggctttgggggcaaagtgcaagaaggagagaccatcgaggatggggctaggagggagctgcaggaggagagcggtctgacagtggacgccctgcacaaggtgggccagatcgtgtttgagttcgtgggcgagcctgagctcatggacgtgcatgtcttctgcacagacagcatccaggggacccccgtggagagcgacgaaatgcgcccatgctggttccagctggatcagatccccttcaaggacatgtggcccgacgacagctactggtttccactcctgcttcagaagaagaaattccacgggtacttcaagttccagggtcaggacaccatcctggactacacactccgcgaggtggacacggtctagcgggagcccagggcagcccctgggcaggagacgtggctgctgaacagccgcaaaccatcttcacctgggggcattgagtggcgcagagccgggtttcatctggaattaactggatggaagggaaaataaagctatctagcggtg

SEQ ID NO: 20972 - DNA, 712 bp, Homo sapiens
acgaaaagcgcgcgcggggattccaggagtcgtggtttcttgccttgatgtactggagcaatcagatcacacggcggcttggagaaacccagggaccatgggcgcctccaggctctataccctggtgctggtcctgcagcctcagcgagttctcctgggcatgaaaaagcgaggcttcggggccggccggtggaatggctttgggggcaaagtgcaagaaggagagaccatcgaggatggggctaggagggagctgcaggaggagagcggtctgacagtggacgccctgcacaaggtgggccagatcgtgtttgagttcgtgggcgagcctgagctcatggacgtgcatgtcttctgcacagacagcatccaggggacccccgtggagagcgacgaaatgcgcccatgctggttccagctggatcagatccccttcaaggacatgtggcccgacgacagctactggtttccactcctgcttcagaagaagaaattccacgggtacttcaagttccagggtcaggacaccatcctggactacacactccgcgaggtggacacggtctagcgggagcccagggcagcccctgggcaggagacgtggctgctgaacagccgcaaaccatcttcacctgggggcattgagtggcgcagagccgggtttcatctggaattaactggatggaagggaaaataaagctatctagcggtg

SEQ ID NO: 20973 - DNA, 783 bp, Homo sapiens
gaaaagcgcgcgcggggattccaggagtcgtggtttcttgccttgatgtactggagcaatcagatcacacggcggcttggagagtgagtgcaaggttttatgagtggaattagccctcagcagatgggggagccagaaggcagttggagtgggaagaacccagggaccatgggcgcctccaggctctataccctggtgctggtcctgcagcctcagcgagttctcctgggcatgaaaaagcgaggcttcggggccggccggtggaatggctttgggggcaaagtgcaagaaggagagaccatcgaggatggggctaggagggagctgcaggaggagagcggtctgacagtggacgccctgcacaaggtgggccagatcgtgtttgagttcgtgggcgagcctgagctcatggacgtgcatgtcttctgcacagacagcatccaggggacccccgtggagagcgacgaaatgcgcccatgctggttccagctggatcagatccccttcaaggacatgtggcccgacgacagctactggtttccactcctgcttcagaagaagaaattccacgggtacttcaagttccagggtcaggacaccatcctggactacacactccgcgaggtggacacggtctagcgggagcccagggcagcccctgggcaggagacgtggctgctgaacagccgcaaaccatcttcacctgggggcattgagtggcgcagagccgggtttcatctggaattaactggatggaagggaaaataaagctatctagcggtg

SEQ ID NO: 20974 - DNA, 786 bp, Homo sapiens
ggtcagaggccacgcccccggaagcggcggtgcaggtttcttgccttgatgtactggagcaatcagatcacacggcggcttggagagtgagtgcaaggttttatgagtggaattagccctcagcagatgggggagccagaaggcagttggagtgggaagaacccagggaccatgggcgcctccaggctctataccctggtgctggtcctgcagcctcagcgagttctcctgggcatgaaaaagcgaggcttcggggccggccggtggaatggctttgggggcaaagtgcaagaaggagagaccatcgaggatggggctaggagggagctgcaggaggagagcggtctgacagtggacgccctgcacaaggtgggccagatcgtgtttgagttcgtgggcgagcctgagctcatggacgtgcatgtcttctgcacagacagcatccaggggacccccgtggagagcgacgaaatgcgcccatgctggttccagctggatcagatccccttcaaggacatgtggcccgacgacagctactggtttccactcctgcttcagaagaagaaattccacgggtacttcaagttccagggtcaggacaccatcctggactacacactccgcgaggtggacacggtctagcgggagcccagggcagcccctgggcaggagacgtggctgctgaacagccgcaaaccatcttcacctgggggcattgagtggcgcagagccgggtttcatctggaattaactggatggaagggaaaataaagctatctagcggtg

SEQ ID NO: 20975 - DNA, 822 bp, Homo sapiens
gattccaggagtcgtggtgaccagggaggggagccgggccagcgggcggcaggagactaggggagctgagccatgggcttgggggagagcggggccgggagctcgaaggagaccagaagagcagggtcgggggctcgagggagacgaggagagcggggccgggggtttgggagagagacaaggagagcggggcggaggcttgggggagaccaggagtaaatcacaaaaatttactttggaaaccgtggcttctggcagaaacagatcagtgtcgggacaaagtacacgggcctggtgtgaaactaagccacaaacccatttaccctgtctgacctgcctccgccaccaggacccagtctcagtgaaatgggaaaggttcccttgtcctcctcgaagggcgtgcgatgaggatgtggctcacttcttcagtgccccgcttctcaagcctctaggggaacatacagacaggcaggctgaggggctcccaccccacggcagtgtctaggggtgaatgtttgcagctcctgaagccccagcaggcatgtgttagagggtgctctttcagtttagccttgtaggtggcttgtgttagtcagctgttagactccctgccttatcgcaaggacagagggctttctgtatccctaggtttcttgccttgatgtactggagcaatcagatcacacggcggcttggagaaacccagggaccatgggcgcctccaggctctataccctggtgctggtcctgcagcctcagcgagttctcctgggcatgaaaaagcgaggcttcggggccggccggtggaatggctttgggggc

SEQ ID NO: 20976 - DNA, 1917 bp, Homo sapiens
gacggaggcgcctctctctccccgcccctctcctcggccctttctcttcccagcacctcggctgctgcccggcagcggcagcagctgcgtcggcggcccacacagcagcgagaggcgagaggaggctgcctcgaggatgaagtgcaaacccaaccagacacggacctacgaccccgaggggttcaagaagcgggcggcgtgcctgtgcttccggagcgagcgcgaggacgaggtcctgttagtgagtagcagccggtacccggaccgctggatcgtgccgggcgggggcatggagcccgaggaggagccgggcggtgcggcggtccgagaggtgtacgaagaggcgggagtcaaggggaagttaggccggctcctgggcgtcttcgaacagaaccaggaccccaagcacagaacgtacgtgtatgtactgactgtcacggagctgctggaggattgggaagattcggttagcattgggaggaagcgagagtggttcaaagtcgaagatgccatcaaggttctccagtgccacaagcccgtgcacgccgaatatctggagaaactaaagctgggcggttccccaaccaatggaaactccatggccccatcctcgccagatagcgatccctagtgaatggcatagatgttgttcagatttactttgaaagaatcaagtatgtgaatggatggatgaatggaattgtgaagcacagatgagctctttcacactccaaggacacagctcatcctatgcttttggacacttcttccctgtttattacaatgactattctccaggttgttgcactaccgctgtatctgtacataattctaacttggcacctgtggccttttttgtgctcttatgtgtctgtatttcccggcagagtatacgcccttgaatgccaggaacttgtttccttagtcttttttatatatctagcatataagatattgcttagaatatggtagacatcactgaagatttgtttcagtagttcatattttgtaatgatactgaatggttaaacaatccctttctaatctgtctagcatatatgtgacttttgtttatcaagtgtcacacaactgcttcaaggcagctgtgagatactagaaagcaaaaattcttactcctatgtctgtgtcatcccagatgtgtgcctccagatggcagtatactacactatctgtaaaatatatttgcaaagccaggcacagtgttacgcgtctgcctcaggaggctgaggcagaagaatagcttgagcccaggagctttagtctagcctgagcaatataatgagactccgtctcttaaaatatttgcccaaacattgaacctaaatttgaccatgcccctagaaataattcctaatctttagaaaatagggcagagaaacattattttacaccatggagatgagatcagcagaatccagactataagaaactacaggacacatgacctagtttcttctgtaaataacttgcaaggatgaaagatggaggatgaacctatagatttaaagagacttaagagacatattaaccaattgttaattggatcttatttgaattgtgatttgaccgaactgtaaaacgaatacatttatgagacaatcggggtaatttgaacattggtggggtatttggtattagaataatggttttatcattatgttagaaagaagggtcctcatctacattctcaaacatctgtggctgatatgatatgattcttggaatttgcttcaaaataataagtctggatgttaagtgcattggaaatattgatgaaacgaaattggccttgataattgttgaagctgggtgatggctaaaatgatggttcattatatatgttcatctctatttttgtatgtttggcattttccgtaataaagtttataaaaataa

SEQ ID NO: 20977 - DNA, 2001 bp, Homo sapiens
tgagtaagccagaatggttgatagtgggggaggatgatgacgacgctgcctttgcccctgtcttgtgtgaaacaactgcctgtgggtttcctgcagcgcagtggggagtgagaggagaaacgtcctgccgtgccacacacctcggctgctgcccggcagcggcagcagctgcgtcggcggcccacacagcagcgagaggcgagaggaggctgcctcgaggatgaagtgcaaacccaaccagacacggacctacgaccccgaggggttcaagaagcgggcggcgtgcctgtgcttccggagcgagcgcgaggacgaggtcctgttagtgagtagcagccggtacccggaccgctggatcgtgccgggcgggggcatggagcccgaggaggagccgggcggtgcggcggtccgagaggtgtacgaagaggcgggagtcaaggggaagttaggccggctcctgggcgtcttcgaacagaaccaggaccccaagcacagaacgtacgtgtatgtactgactgtcacggagctgctggaggattgggaagattcggttagcattgggaggaagcgagagtggttcaaagtcgaagatgccatcaaggttctccagtgccacaagcccgtgcacgccgaatatctggagaaactaaagctgggcggttccccaaccaatggaaactccatggccccatcctcgccagatagcgatccctagtgaatggcatagatgttgttcagatttactttgaaagaatcaagtatgtgaatggatggatgaatggaattgtgaagcacagatgagctctttcacactccaaggacacagctcatcctatgcttttggacacttcttccctgtttattacaatgactattctccaggttgttgcactaccgctgtatctgtacataattctaacttggcacctgtggccttttttgtgctcttatgtgtctgtatttcccggcagagtatacgcccttgaatgccaggaacttgtttccttagtcttttttatatatctagcatataagatattgcttagaatatggtagacatcactgaagatttgtttcagtagttcatattttgtaatgatactgaatggttaaacaatccctttctaatctgtctagcatatatgtgacttttgtttatcaagtgtcacacaactgcttcaaggcagctgtgagatactagaaagcaaaaattcttactcctatgtctgtgtcatcccagatgtgtgcctccagatggcagtatactacactatctgtaaaatatatttgcaaagccaggcacagtgttacgcgtctgcctcaggaggctgaggcagaagaatagcttgagcccaggagctttagtctagcctgagcaatataatgagactccgtctcttaaaatatttgcccaaacattgaacctaaatttgaccatgcccctagaaataattcctaatctttagaaaatagggcagagaaacattattttacaccatggagatgagatcagcagaatccagactataagaaactacaggacacatgacctagtttcttctgtaaataacttgcaaggatgaaagatggaggatgaacctatagatttaaagagacttaagagacatattaaccaattgttaattggatcttatttgaattgtgatttgaccgaactgtaaaacgaatacatttatgagacaatcggggtaatttgaacattggtggggtatttggtattagaataatggttttatcattatgttagaaagaagggtcctcatctacattctcaaacatctgtggctgatatgatatgattcttggaatttgcttcaaaataataagtctggatgttaagtgcattggaaatattgatgaaacgaaattggccttgataattgttgaagctgggtgatggctaaaatgatggttcattatatatgttcatctctatttttgtatgtttggcattttccgtaataaagtttataaaaataa

SEQ ID NO: 20978 - DNA, 1060 bp, Homo sapiens
ctattgatgggcccaagcgtaaccaggctcttctgattggccggtgtacttcagtttccgtccaaggtccgcctcctacctccttctgcttcggggagggcatgggatcagctacctgtttctgcctcaaccacggaccaataatatgagatctttgttcaccagttctacagtgatggggtgcttccttttggcttctggaatgggtgcgtttgcttctgaggatctccagtgtcacaacaaacacatgccagccctgttttacagggagccctggaggagttgggatagaggccacattgactgagggtagttgccagggtcctgcagttatacacaaagtccttaggataagaccatggccttgagagcatgtggcttgatcatcttccgaagatgcctcattcccaaagtggacaacaatgcaattgagtttttactgctgcaggcatcagatggcattcatcactggactcctcccaaaggccatgtggaaccaggagaggatgacttggaaacagccctgagggagacccaagaggaagcaggcatagaagcaggccagctgaccattattgaggggttcaaaagggaactcaattatgtggccaggaacaagcctaaaacagtcatttactggctggcggaggtgaaggactatgacgtggagatccgcctctcccatgagcaccaagcctaccgctggctggggctggaggaggcctgccagttggctcagttcaaggagatgaaggcagcgctccaagaaggacaccagtttctttgctccatagaggcctgagctgactggagcagagtcatttgcttcagcaggatccttgtgggccttctaagatgaagccaccctcaggtccagggaaggttgtgctggtatttggctcatgacagccaagagcagatttgtgaaatcggctcaactcccaggtgagagcaagcaaaaatcttggctgggtggaaaggaaggcaaaagagtaaaaattaaaaaggccaggcccagtaagtgtaccttgtactttataaataaacctcaagcagctca

SEQ ID NO: 20979 - DNA, 960 bp, Homo sapiens
ctattgatgggcccaagcgtaaccaggctcttctgattggccggtgtacttcagtttccgtccaaggtccgcctcctacctccttctgcttcggtgcgtttgcttctgaggatctccagtgtcacaacaaacacatgccagccctgttttacagggagccctggaggagttgggatagaggccacattgactgagggtagttgccagggtcctgcagttatacacaaagtccttaggataagaccatggccttgagagcatgtggcttgatcatcttccgaagatgcctcattcccaaagtggacaacaatgcaattgagtttttactgctgcaggcatcagatggcattcatcactggactcctcccaaaggccatgtggaaccaggagaggatgacttggaaacagccctgagggagacccaagaggaagcaggcatagaagcaggccagctgaccattattgaggggttcaaaagggaactcaattatgtggccaggaacaagcctaaaacagtcatttactggctggcggaggtgaaggactatgacgtggagatccgcctctcccatgagcaccaagcctaccgctggctggggctggaggaggcctgccagttggctcagttcaaggagatgaaggcagcgctccaagaaggacaccagtttctttgctccatagaggcctgagctgactggagcagagtcatttgcttcagcaggatccttgtgggccttctaagatgaagccaccctcaggtccagggaaggttgtgctggtatttggctcatgacagccaagagcagatttgtgaaatcggctcaactcccaggtgagagcaagcaaaaatcttggctgggtggaaaggaaggcaaaagagtaaaaattaaaaaggccaggcccagtaagtgtaccttgtactttataaataaacctcaagcagctcaaggttgtccttct

SEQ ID NO: 20980 - DNA, 1047 bp, Homo sapiens
ctattgatgggcccaagcgtaaccaggctcttctgattggccggtgtacttcagtttccgtccaaggtccgcctcctacctccttctgcttcgggtaaaatctcctgtttcctccctcagccaatagcaaaaataacaaaatgactcagcagcttcgtctctgcaagaatggagtggcagatgtccagggaaagtgcgtttgcttctgaggatctccagtgtcacaacaaacacatgccagccctgttttacagggagccctggaggagttgggatagaggccacattgactgagggtagttgccagggtcctgcagttatacacaaagaccatggccttgagagcatgtggcttgatcatcttccgaagatgcctcattcccaaagtggacaacaatgcaattgagtttttactgctgcaggcatcagatggcattcatcactggactcctcccaaaggccatgtggaaccaggagaggatgacttggaaacagccctgagggagacccaagaggaagcaggcatagaagcaggccagctgaccattattgaggggttcaaaagggaactcaattatgtggccaggaacaagcctaaaacagtcatttactggctggcggaggtgaaggactatgacgtggagatccgcctctcccatgagcaccaagcctaccgctggctggggctggaggaggcctgccagttggctcagttcaaggagatgaaggcagcgctccaagaaggacaccagtttctttgctccatagaggcctgagctgactggagcagagtcatttgcttcagcaggatccttgtgggccttctaagatgaagccaccctcaggtccagggaaggttgtgctggtatttggctcatgacagccaagagcagatttgtgaaatcggctcaactcccaggtgagagcaagcaaaaatcttggctgggtggaaaggaaggcaaaagagtaaaaattaaaaaggccaggcccagtaagtgtaccttgtactttataaataaacctcaagcagctcaaggttgtccttct

SEQ ID NO: 20981 - DNA, 1002 bp, Homo sapiens
ctattgatgggcccaagcgtaaccaggctcttctgattggccggtgtacttcagtttccgtccaaggtccgcctcctacctccttctgcttcggttctacagtgatggggtgcttccttttggcttctggaatgggtgcgtttgcttctgaggatctccagtgtcacaacaaacacatgccagccctgttttacagggagccctggaggagttgggatagaggccacattgactgagggtagttgccagggtcctgcagttatacacaaagtccttaggataagaccatggccttgagagcatgtggcttgatcatcttccgaagatgcctcattcccaaagtggacaacaatgcaattgagtttttactgctgcaggcatcagatggcattcatcactggactcctcccaaaggccatgtggaaccaggagaggatgacttggaaacagccctgagggagacccaagaggaagcaggcatagaagcaggccagctgaccattattgaggggttcaaaagggaactcaattatgtggccaggaacaagcctaaaacagtcatttactggctggcggaggtgaaggactatgacgtggagatccgcctctcccatgagcaccaagcctaccgctggctggggctggaggaggcctgccagttggctcagttcaaggagatgaaggcagcgctccaagaaggacaccagtttctttgctccatagaggcctgagctgactggagcagagtcatttgcttcagcaggatccttgtgggccttctaagatgaagccaccctcaggtccagggaaggttgtgctggtatttggctcatgacagccaagagcagatttgtgaaatcggctcaactcccaggtgagagcaagcaaaaatcttggctgggtggaaaggaaggcaaaagagtaaaaattaaaaaggccaggcccagtaagtgtaccttgtactttataaataaacctcaagcagctcaaggttgtccttct

SEQ ID NO: 20982 - DNA, 1074 bp, Homo sapiens
ctattgatgggcccaagcgtaaccaggctcttctgattggccggtgtacttcagtttccgtccaaggtccgcctcctacctccttctgcttcgggggagggcatgggatcagctacctgtttctgcctcaaccacggaccaataatatgagatctttgttcaccagttctacagtgatggggtgcttccttttggcttctggaatgggtgcgtttgcttctgaggatctccagtgtcacaacaaacacatgccagccctgttttacagggagccctggaggagttgggatagaggccacattgactgagggtagttgccagggtcctgcagttatacacaaagtccttaggataagaccatggccttgagagcatgtggcttgatcatcttccgaagatgcctcattcccaaagtggacaacaatgcaattgagtttttactgctgcaggcatcagatggcattcatcactggactcctcccaaaggccatgtggaaccaggagaggatgacttggaaacagccctgagggagacccaagaggaagcaggcatagaagcaggccagctgaccattattgaggggttcaaaagggaactcaattatgtggccaggaacaagcctaaaacagtcatttactggctggcggaggtgaaggactatgacgtggagatccgcctctcccatgagcaccaagcctaccgctggctggggctggaggaggcctgccagttggctcagttcaaggagatgaaggcagcgctccaagaaggacaccagtttctttgctccatagaggcctgagctgactggagcagagtcatttgcttcagcaggatccttgtgggccttctaagatgaagccaccctcaggtccagggaaggttgtgctggtatttggctcatgacagccaagagcagatttgtgaaatcggctcaactcccaggtgagagcaagcaaaaatcttggctgggtggaaaggaaggcaaaagagtaaaaattaaaaaggccaggcccagtaagtgtaccttgtactttataaataaacctcaagcagctcaaggttgtccttct

SEQ ID NO: 20983 - DNA, 1969 bp, Homo sapiens
agtaggaggcggcaagtttgaaaagtgatgacggttgacgtttgctgatttttgactttgcttgtagctgctccccgaactcgccgtcttcctgtcggcggccggcactgtaggtgagcgcgagaggacggaggaaggaagcctgcagacagacgccttctccatcccaaggcgcgggcaggtgccgggacgctgggcctggcggtgttttcgtcgtgctcagcggtgggaggaggcggaagaaaccagagcctgggagattaacaggaaacttccaagatggaaactttgtctttccccagatataatgtagctgagattgtgattcatattcgcaataagatcttaacaggagctgatggtaaaaacctcaccaagaatgatctttatccaaatccaaagcctgaagtcttgcacatgatctacatgagagccttacaaatagtatatggaattcgactggaacatttttacatgatgccagtgaactctgaagtcatgtatccacatttaatggaaggcttcttaccattcagcaatttagttactcatctggactcatttttgcctatctgccgggtgaatgactttgagactgctgatattctatgtccaaaagcaaaacggacaagtcggtttttaagtggcattatcaactttattcacttcagagaagcatgccgtgaaacgtatatggaatttctttggcaatataaatcctctgcggacaaaatgcaacagttaaacgccgcacaccaggaggcattaatgaaactggagagacttgattctgttccagttgaagagcaagaagagttcaagcagctttcagatggaattcaggagctacaacaatcactaaatcaggattttcatcaaaaaacgatagtgctgcaagagggaaattcccaaaagaagtcaaatatttcagagaaaaccaagcgtttgaatgaactaaaattgtcggtggtttctttgaaagaaatacaagagagtttgaaaacaaaaattgtggattctccagagaagttaaagaattataaagaaaaaatgaaagatacggtccagaagcttaaaaatgccagacaagaagtggtggagaaatatgaaatctatggagactcagttgactgcctgccttcatgtcagttggaagtgcagttatatcaaaagaaaatacaggacctttcagataatagggaaaaattagccagtatcttaaaggagagcctgaacttggaggaccaaattgagagtgatgagtcagaactgaagaaattgaagactgaagaaaattcgttcaaaagactgatgattgtgaagaaggaaaaacttgccacagcacaattcaaaataaataagaagcatgaagatgttaagcaatacaaacgcacagtaattgaggattgcaataaagttcaagaaaaaagaggtgctgtctatgaacgagtaaccacaattaatcaagaaatccaaaaaattaaacttggaattcaacaactaaaagatgctgctgaaagggagaaactgaagtcccaggaaatatttctaaacttgaaaactgctttggagaaataccacgacggtattgaaaaggcagcagaggactcctatgctaagatagatgagaagacagctgaactgaagaggaagatgttcaaaatgtcaacctgattaacaaaattacatgtctttttgtaaatggcttgccatcttttaattttctatttagaaagaaaagttgaagcgaatggaagtatcagaagtaccaaataatgttggcttcatcagtttttatacactctcataagtagttaataagatgaatttaatgtaggcttttattaatttataattaaaataacttgtgcagctattcatgtctctactctgccccttgttgtaaatagtttgagtaaaacaaaactagttacctttgaaatatatatatttttttctgttactatca

SEQ ID NO: 20984 - DNA, 1842 bp, Homo sapiens
ggaatggggcgggacttccagtaggaggcggcaagtttgaaaagtgatgacggttgacgtttgctgatttttgactttgcttgtagctgctccccgaactcgccgtcttcctgtcggcggccggcactgtagattaacaggaaacttccaagatggaaactttgtctttccccagatataatgtagctgagattgtgattcatattcgcaataagatcttaacaggagctgatggtaaaaacctcaccaagaatgatctttatccaaatccaaagcctgaagtcttgcacatgatctacatgagagccttacaaatagtatatggaattcgactggaacatttttacatgatgccagtgaactctgaagtcatgtatccacatttaatggaaggcttcttaccattcagcaatttagttactcatctggactcatttttgcctatctgccgggtgaatgactttgagactgctgatattctatgtccaaaagcaaaacggacaagtcggtttttaagtggcattatcaactttattcacttcagagaagcatgccgtgaaacgtatatggaatttctttggcaatataaatcctctgcggacaaaatgcaacagttaaacgccgcacaccaggaggcattaatgaaactggagagacttgattctgttccagttgaagagcaagaagagttcaagcagctttcagatggaattcaggagctacaacaatcactaaatcaggattttcatcaaaaaacgatagtgctgcaagagggaaattcccaaaagaagtcaaatatttcagagaaaaccaagcgtttgaatgaactaaaattgtcggtggtttctttgaaagaaatacaagagagtttgaaaacaaaaattgtggattctccagagaagttaaagaattataaagaaaaaatgaaagatacggtccagaagcttaaaaatgccagacaagaagtggtggagaaatatgaaatctatggagactcagttgactgcctgccttcatgtcagttggaagtgcagttatatcaaaagaaaatacaggacctttcagataatagggaaaaattagccagtatcttaaaggagagcctgaacttggaggaccaaattgagagtgatgagtcagaactgaagaaattgaagactgaagaaaattcgttcaaaagactgatgattgtgaagaaggaaaaacttgccacagcacaattcaaaataaataagaagcatgaagatgttaagcaatacaaacgcacagtaattgaggattgcaataaagttcaagaaaaaagaggtgctgtctatgaacgagtaaccacaattaatcaagaaatccaaaaaattaaacttggaattcaacaactaaaagatgctgctgaaagggagaaactgaagtcccaggaaatatttctaaacttgaaaactgctttggagaaataccacgacggtattgaaaaggcagcagaggactcctatgctaagatagatgagaagacagctgaactgaagaggaagatgttcaaaatgtcaacctgattaacaaaattacatgtctttttgtaaatggcttgccatcttttaattttctatttagaaagaaaagttgaagcgaatggaagtatcagaagtaccaaataatgttggcttcatcagtttttatacactctcataagtagttaataagatgaatttaatgtaggcttttattaatttataattaaaataacttgtgcagctattcatgtctctactctgccccttgttgtaaatagtttgagtaaaacaaaactagttacctttgaaatatatatatttttttctgttactatca

SEQ ID NO: 20985 - DNA, 1133 bp, Homo sapiens
ggaatggggcgggacttccagtaggaggcggcaagtttgaaaagtgatgacggttgacgtttgctgatttttgactttgcttgtagctgctccccgaactcgccgtcttcctgtcggcggccggcactgtaggtgagcgcgagaggacggaggaaggaagcctgcagacagacgccttctccatcccaaggcgcgggcaggtgccgggacgctgggcctggcggtgttttcgtcgtgctcagcggtgggaggaggcggaagaaaccagagcctgggaggagctcaaactatgtagttggaaagtgtcttcatctctcgttaatgaataaattgtaactgaaattgtacttcgaaagaatgatagaatttggatattggaggaggttccaaaaggaaatactggaagtttgggaaagttaggagactaacttggagcagaaatttcattcaattattaaagggtttagaagcctagcagaaaaatttgaatttgatgtggtgggtaagattaacaggaaacttccaagatggaaactttgtctttccccagatataatgtagctgagattgtgattcatattcgcaataagatcttaacaggagctgatggtaaaaacctcaccaagaatgatctttatccaaatccaaagcctgaagtcttgcacatgatctacatgagagccttacaaatagtatatggaattcgactggaacatttttacatgatgccagtgaactctgaagtcatgtatccacatttaatggaaggcttcttaccattcagcaatttagttactcatctggactcatttttgcctatctgccgggtgaatgactttgagactgctgatattctatgtccaaaagcaaaacggacaagtcggtttttaagtggcattatcaactttattcacttcagagaagcatgccgtgaaacgtatatggaatttctttggcaatataaatcctctgcggacaaaatgcaacagttaaacgccgcacaccaggaggcattaatgaaactggagagacttgattctgttccagttgaagagcaagaagagttcaagcagctttcagatggaattcaggagctacaacaatcactaaatcaggattttcatcaaaaaacg

SEQ ID NO: 20986 - DNA, 861 bp, Homo sapiens
tcttgagcccaaccggcatccgtcgcggttggacgtgggcttggcggaatggggcgggacttccagtaggaggcggcaagtttgaaaagtgatgacggttgacgtttgctgatttttgactttgcttgtagctgctccccgaactcgccgtcttcctgtcggcggccggcactgtaggagctcaaactatgtagttggaaagtgtcttcatctctcgttaatgaataaattgtaactgaaattgtacttcgaaagaatgatagaatttggatattggaggaggttccaaaaggaaatactggaagtttgggaaagttaggagactaacttggagcagaaatttcattcaattattaaagggtttagaagcctagcagaaaaatttgaatttgatgtggtgggtaagattaacaggaaacttccaagatggaaactttgtctttccccagatataatgtagctgagattgtgattcatattcgcaataagatcttaacaggagctgatggtaaaaacctcaccaagaatgatctttatccaaatccaaagcctgaagtcttgcacatgatctacatgagagccttacaaatagtatatggaattcgactggaacatttttacatgatgccagtgaactctgaagtcatgtatccacatttaatggaaggcttcttaccattcagcaatttagttactcatctggactcatttttgcctatctgccgggtgaatgactttgagactgctgatattctatgtccaaaagcaaaacggacaagtcggtttttaagtggcattatcaactttattcacttcagagaagcatgccgtgaaacgtatatggaatttctttggcaatat

SEQ ID NO: 20987 - DNA, 885 bp, Homo sapiens
tgtcggcggccggcactgtagattaacaggaaacttccaagatggaaactttgtctttccccagatataatgtagctgagattgtgattcatattcgcaataagatcttaacaggagctgatggtaaaaacctcaccaagaatgatctttatccaaatccaaagcctgaagtcttgcacatgatctacatgagagccttacaaatagtatatggaattcgactggaacatttttacatgatgccagtgaactctgaagtcatgtatccacatttaatggaaggcttcttaccattcagcaatttagttactcatctggactcatttttgcctatctgccgggtgaatgactttgagactgctgatattctatgtccaaaagcaaaacggacaagtcggtttttaagtggcattatcaactttattcacttcagagaagcatgccgtgaaacgtatatggaatttctttggcaatataaatcctctgcggacaaaatgcaacagttaaacgccgcacaccaggaggcattaatgaaactggagagacttgattctgttccagttgaagagcaagaagagttcaagcagctttcagatggaattcaggagctacaacaatcactaaatcaggattttcatcaaaaaacgtgctgcaagagggaaattcccaaaagaagtcaaatatttcagagaaaaccaagcgtttgaatgaactaaaattgtcggtggtttctttgaaagaaatacaagagagtttgaaaacaaaaattgtggattctccagagaagttaaagaattataaagaaaaaatgaaagatacggtccagaagcttaaaaatgccagacaagaagtggtggagaaatatgaaatctatggagactcagt

SEQ ID NO: 20988 - DNA, 1845 bp, Homo sapiens
aaccggcatccgtcgcggttggacgtgggcttggcggaatggggcgggacttccagtaggaggcggcaagtttgaaaagtgatgacggttgacgtttgctgatttttgactttgcttgtagctgctccccgaactcgccgtcttcctgtcggcggccggcactgtaggtgagcgcgagaggacggaggaaggaagcctgcagacagacgccttctccatcccaaggcgcgggcaggtgccgggacgctgggcctggcggtgttttcgtcgtgctcagcggtgggaggaggcggaagaaaccagagcctgggagattaacaggaaacttccaagatggaaactttgtctttccccagatataatgtagctgagattgtgattcatattcgcaataagatcttaacaggagctgatggtaaaaacctcaccaagaatgatctttatccaaatccaaagcctgaagtcttgcacatgatctacatgagagccttacaaatagtatatggaattcgactggaacatttttacatgatgccagtgaactctgaagtcatgtatccacatttaatggaaggcttcttaccattcagcaatttagttactcatctggactcatttttgcctatctgccgggtgaatgactttgagactgctgatattctatgtccaaaagcaaaacggacaagtcggtttttaagtggcattatcaactttattcacttcagagaagcatgccgtgaaacgtatatggaatttctttggcaatataaatcctctgcggacaaaatgcaacagttaaacgccgcacaccaggaggcattaatgaaactggagagacttgattctgttccagttgaagagcaagaagagttcaagcagctttcagatggaattcaggagctacaacaatcactaaatcaggattttcatcaaaaaacgatagtgctgcaagagggaaattcccaaaagaagtcaaatatttcagagaaaaccaagcgtttgaatgaactaaaattgtcggtggtttctttgaaagaaatacaagagagtttgaaaacaaaaattgtggattctccagagaagttaaagaattataaagaaaaaatgaaagatacggtccagaagcttaaaaatgccagaagcctgaacttggaggaccaaattgagagtgatgagtcagaactgaagaaattgaagactgaagaaaattcgttcaaaagactgatgattgtgaagaaggaaaaacttgccacagcacaattcaaaataaataagaagcatgaagatgttaagcaatacaaacgcacagtaattgaggattgcaataaagttcaagaaaaaagaggtgctgtctatgaacgagtaaccacaattaatcaagaaatccaaaaaattaaacttggaattcaacaactaaaagatgctgctgaaagggagaaactgaagtcccaggaaatatttctaaacttgaaaactgctttggagaaataccacgacggtattgaaaaggcagcagaggactcctatgctaagatagatgagaagacagctgaactgaagaggaagatgttcaaaatgtcaacctgattaacaaaattacatgtctttttgtaaatggcttgccatcttttaattttctatttagaaagaaaagttgaagcgaatggaagtatcagaagtaccaaataatgttggcttcatcagtttttatacactctcataagtagttaataagatgaatttaatgtaggcttttattaatttataattaaaataacttgtgcagctattcatgtctctactctgccccttgttgtaaatagtttgagtaaaacaaaactagtt

SEQ ID NO: 20989 - DNA, 567 bp, Homo sapiens
aatgcttattcattcttcaagattcagctcaaaattcacttttctctgtgaattcgtatgtcactccatctaccacacagcctctctcagcttcctcagaaaacagccatatgaaagccaagaagagagtcctcaccaggcaccttgaacttgcacttcccagactccagaaatattaacaggaaacttccaagatggaaactttgtctttccccagatataatgtagctgagattgtgattcatattcgcaataagatcttaacaggagctgatggtaaaaacctcaccaagaatgatctttatccaaatccaaagcctgaagtcttgcacatgatctacatgagagccttacaaatagtatatggaattcgactggaacatttttacatgatgccagtgaactctgaagtcatgtatccacatttaatggaaggcttcttaccattcagcaatttagttactcatctggactcatttttgcctatctgccgggtgaatgactttgagactgctgatattctatgtccaaaagcaaaacggacaagtcggtttttaagtggcatta

SEQ ID NO: 20990 - DNA, 1657 bp, Homo sapiens
ggcgcttgagttggtcgggggcagcggcagatttgaggcttaagcaacttcttccggggaagagtgccagtgcagccactgttacaattcaagatcttgatctatatccatagattggaatattggtgggccagcaatcctcagacgcctcacttaggacaagctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctcatgccatcccacgccggcatgctccaattgaacagcttgctcgccaaggctctttccgaggttttcctgctcttagccagaagatgtcaccctttaaacgccaactatccctacgcatcaatgagttgccttccactatgcagaggaagactgatttccccattaaaaatgcagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagctaatggcactgactcagccttccatgtgcttgctaagccagcccatactgctctagcacccgtagcaatgcctgtgcgtgaaaccaacccttgggcccatgcccctgatgctgctaacaaggaaattgcagccacatgttcggggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatca

SEQ ID NO: 20991 - DNA, 3593 bp, Homo sapiens
gcttgagttggtcgggggcagcggcagctgagctgggatgggagacccaactggcctggccgctccggctctgaggatccctaagggaccaggaaagaagtcctcgaggagtggctcgcgtttgagaccgggatttgaggcttaagcaacttcttccggggaagagtgccagtgcagccactgttacaattcaagatcttgatctatatccatagattggaatattggtgggccagcaatcctcagacgcctcacttaggacaagctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctgaaaggaagttcttcaaaggcttctttggaaaaactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctcatgccatcccacgccggcatgctccaattgaacagcttgctcgccaaggctctttccgaggttttcctgctcttagccagaagatgtcaccctttaaacgccaactatccctacgcatcaatgagttgccttccactatgcagaggaagactgatttccccattaaaaatgcagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagctaatggcactgactcagccttccatgtgcttgctaagccagcccatactgctctagcacccgtagcaatgcctgtgcgtgaaaccaacccttgggcccatgcccctgatgctgctaacaaggaaattgcagccacatgttcggggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtccataccagacagggagcagggggtagcggtcaaaggagcaaaacagactttgtctcctgattagtactcttttcactaatcccaaaggtcccaaggaacaagtccaggcccagagtactgtgaggggtgattttgaaagacatgggaaaaagcattcctagagaaaagctgccttgcaattaggctaaagaagtcaaggaaatgttgctttctgtactccctcttcccttacccccttacaaatctctggcaacagagaggcaaagtatctgaacaagaatctatattccaagcacatttactgaaatgtaaaacacaacaggaagcaaagcaatctccctttgtttttcaggccattcacctgcctcctgtcagtagtggcctgtattagagatcaagaagagtggtttgtgctcaggctggggaacagagaggcacgctatgctgccagaattcccaggagggcatatcagcaactgcccagcagagctatattttgggggagaagttgagcttccattttgagtaacagaataaatattatatatatcaaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaacctatgatggaattctaatgtcattattttaatggaatcaatcgaaatatgctctatagagaatatatcttttatatattgctgcagtttccttatgttaatcctttaacactaaggtaacatgacataatcataccatagaagggaacacaggttaccatattggtttgtaatatgggtcttggtgggttttgttttatcctttaaattttgttcccatgagttttgtggggatggggattctggttttattagctttgtgtgtgtcctcttcccccaaacccccttttggtgagaacatccccttgacagttgcagcctcttgacctcggataacaataagagagctcatctcatttttacttttgaacgttggccttacaatcaaatgtaagttatatatatttgtactgatgaaaatttataatctgctttaacaaaaataaatgttcatggt

SEQ ID NO: 20992 - DNA, 3453 bp, Homo sapiens
gcttgagttggtcgggggcagcggcagctgagctgggatgggagacccaactggcctggccgctccggctctgaggatccctaagggaccaggaaagaagtcctcgaggagtggctcgcgtttgagaccgggatttgaggcttaagcaacttcttccggggaagagtgccagtgcagccactgttacaattcaagatcttgatctatatccatagattggaatattggtgggccagcaatcctcagacgcctcacttaggacaagctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctgaaaggaagttcttcaaaggcttctttggaaaaactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctcatgccatcccacgccggcatgctccaattgaacagcttgctcgccaaggctctttccgaggttttcctgctcttagccagaagatgtcaccctttaaacgccaactatccctacgcatcaatgagttgccttccactatgcagaggaagactgatttccccattaaaaatgcagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtccataccagacagggagcagggggtagcggtcaaaggagcaaaacagactttgtctcctgattagtactcttttcactaatcccaaaggtcccaaggaacaagtccaggcccagagtactgtgaggggtgattttgaaagacatgggaaaaagcattcctagagaaaagctgccttgcaattaggctaaagaagtcaaggaaatgttgctttctgtactccctcttcccttacccccttacaaatctctggcaacagagaggcaaagtatctgaacaagaatctatattccaagcacatttactgaaatgtaaaacacaacaggaagcaaagcaatctccctttgtttttcaggccattcacctgcctcctgtcagtagtggcctgtattagagatcaagaagagtggtttgtgctcaggctggggaacagagaggcacgctatgctgccagaattcccaggagggcatatcagcaactgcccagcagagctatattttgggggagaagttgagcttccattttgagtaacagaataaatattatatatatcaaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaacctatgatggaattctaatgtcattattttaatggaatcaatcgaaatatgctctatagagaatatatcttttatatattgctgcagtttccttatgttaatcctttaacactaaggtaacatgacataatcataccatagaagggaacacaggttaccatattggtttgtaatatgggtcttggtgggttttgttttatcctttaaattttgttcccatgagttttgtggggatggggattctggttttattagctttgtgtgtgtcctcttcccccaaacccccttttggtgagaacatccccttgacagttgcagcctcttgacctcggataacaataagagagctcatctcatttttacttttgaacgttggccttacaatcaaatgtaagttatatatatttgtactgatgaaaatttataatctgctttaacaaaaataaatgttcatggtagaa

SEQ ID NO: 20993 - DNA, 3560 bp, Homo sapiens
gcttgagttggtcgggggcagcggcagctgagctgggatgggagacccaactggcctggccgctccggctctgaggatccctaagggaccaggaaagaagtcctcgaggagtggctcgcgtttgagaccgggatttgaggcttaagcaacttcttccggggaagagtgccagtgcagccactgttacaattcaagatcttgatctatatccatagattggaatattggtgggccagcaatcctcagacgcctcacttaggacaagctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctcatgccatcccacgccggcatgctccaattgaacagcttgctcgccaaggctctttccgaggttttcctgctcttagccagaagatgtcaccctttaaacgccaactatccctacgcatcaatgagttgccttccactatgcagaggaagactgatttccccattaaaaatgcagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagctaatggcactgactcagccttccatgtgcttgctaagccagcccatactgctctagcacccgtagcaatgcctgtgcgtgaaaccaacccttgggcccatgcccctgatgctgctaacaaggaaattgcagccacatgttcggggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtccataccagacagggagcagggggtagcggtcaaaggagcaaaacagactttgtctcctgattagtactcttttcactaatcccaaaggtcccaaggaacaagtccaggcccagagtactgtgaggggtgattttgaaagacatgggaaaaagcattcctagagaaaagctgccttgcaattaggctaaagaagtcaaggaaatgttgctttctgtactccctcttcccttacccccttacaaatctctggcaacagagaggcaaagtatctgaacaagaatctatattccaagcacatttactgaaatgtaaaacacaacaggaagcaaagcaatctccctttgtttttcaggccattcacctgcctcctgtcagtagtggcctgtattagagatcaagaagagtggtttgtgctcaggctggggaacagagaggcacgctatgctgccagaattcccaggagggcatatcagcaactgcccagcagagctatattttgggggagaagttgagcttccattttgagtaacagaataaatattatatatatcaaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaacctatgatggaattctaatgtcattattttaatggaatcaatcgaaatatgctctatagagaatatatcttttatatattgctgcagtttccttatgttaatcctttaacactaaggtaacatgacataatcataccatagaagggaacacaggttaccatattggtttgtaatatgggtcttggtgggttttgttttatcctttaaattttgttcccatgagttttgtggggatggggattctggttttattagctttgtgtgtgtcctcttcccccaaacccccttttggtgagaacatccccttgacagttgcagcctcttgacctcggataacaataagagagctcatctcatttttacttttgaacgttggccttacaatcaaatgtaagttatatatatttgtactgatgaaaatttataatctgctttaacaaaaataaatgttcatggt

SEQ ID NO: 20994 - DNA, 1565 bp, Homo sapiens
caggctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctgaaaggaagttcttcaaaggcttctttggaaaaactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtcca

SEQ ID NO: 20995 - DNA, 2124 bp, Homo sapiens
actggcggccgaggtagaggcagtggcgcttgagttggtcgggggcagcggcagatttgaggcttaagcaacttcttccggggaagagtgccagtgcagccactgttacaattcaagatcttgatctatatccatagattggaatattggtgggccagcaatcctcagacgcctcacttaggacaagctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctcatgccatcccacgccggcatgctccaattgaacagcttgctcgccaaggctctttccgaggttttcctgctcttagccagaagatgtcaccctttaaacgccaactatccctacgcatcaatgagttgccttccactatgcagaggaagactgatttccccattaaaaatgcagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagctaatggcactgactcagccttccatgtgcttgctaagccagcccatactgctctagcacccgtagcaatgcctgtgcgtgaaaccaacccttgggcccatgcccctgatgctgctaacaaggaaattgcagccacatgttcggggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaa

SEQ ID NO: 20996 - DNA, 1418 bp, Homo sapiens
caggctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctgaaaggaagttcttcaaaggcttctttggaaaaactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtcca

SEQ ID NO: 20997 - DNA, 954 bp, Homo sapiens
tggcgcttgagttggtcgggggcagcggcagatttgaggcttaagcaacttcttccggggaagagtgccagtgcagccactgttacaattcaagatcttgatctatatccatagattggaatattggtgggccagcaatcctcagacgcctcacttaggacaagctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctgaaaggaagttcttcaaaggcttctttggaaaaactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctca

SEQ ID NO: 20998 - DNA, 3607 bp, Homo sapiens
caatggataggttagaagtatgaaagagggtgggcctgttgtcatgggggaggtggtggcgcttggtggccactggcggccgaggtagaggcagtggcgcttgagttggtcgggggcagcggcagatttgaggcttaagcaacttcttccggggaagagtgccagtgcagccactgttacaattcaagatcttgatctatatccatagattggaatattggtgggccagcaatcctcagacgcctcacttaggacaaatgaggaaactgaggcttggtgaagttacgaaacttgtccaaaatcacacaacttgtaaagggcacagccaagattcagagccaggctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctcatgccatcccacgccggcatgctccaattgaacagcttgctcgccaaggctctttccgaggttttcctgctcttagccagaagatgtcaccctttaaacgccaactatccctacgcatcaatgagttgccttccactatgcagaggaagactgatttccccattaaaaatgcagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtccataccagacagggagcagggggtagcggtcaaaggagcaaaacagactttgtctcctgattagtactcttttcactaatcccaaaggtcccaaggaacaagtccaggcccagagtactgtgaggggtgattttgaaagacatgggaaaaagcattcctagagaaaagctgccttgcaattaggctaaagaagtcaaggaaatgttgctttctgtactccctcttcccttacccccttacaaatctctggcaacagagaggcaaagtatctgaacaagaatctatattccaagcacatttactgaaatgtaaaacacaacaggaagcaaagcaatctccctttgtttttcaggccattcacctgcctcctgtcagtagtggcctgtattagagatcaagaagagtggtttgtgctcaggctggggaacagagaggcacgctatgctgccagaattcccaggagggcatatcagcaactgcccagcagagctatattttgggggagaagttgagcttccattttgagtaacagaataaatattatatatatcaaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaacctatgatggaattctaatgtcattattttaatggaatcaatcgaaatatgctctatagagaatatatcttttatatattgctgcagtttccttatgttaatcctttaacactaaggtaacatgacataatcataccatagaagggaacacaggttaccatattggtttgtaatatgggtcttggtgggttttgttttatcctttaaattttgttcccatgagttttgtggggatggggattctggttttattagctttgtgtgtgtcctcttcccccaaacccccttttggtgagaacatccccttgacagttgcagcctcttgacctcggataacaataagagagctcatctcatttttacttttgaacgttggccttacaatcaaatgtaagttatatatatttgtactgatgaaaatttataatctgctttaacaaaaataaatgttcatggtagaagcttttgcccatgaagggctgttctttcccctttcctttattagtaaatgaatttatttttcgttcttttggtcttactctccattctactgctgctgtaaatccctag

SEQ ID NO: 20999 - DNA, 552 bp, Homo sapiens
gcggagttctcccgaggaaggtaggctacggccggacccgcgcgggtcaggccaggaggtcccttgggacgtccagctgctccggtctagcgcgctgaccggcggccactgtgtgaggaatttgaggcttaagcaacttcttccggggaagagtgccagtgcagccactgttacaattcaagatcttgatctatatccatagattggaatattggtgggccagcaatcctcagacgcctcacttaggacaaatgaggaaactgaggcttggtgaagttacgaaacttgtccaaaatcacacaacttgtaaagggcacagccaagattcagagccaggctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagct

SEQ ID NO: 21000 - DNA, 3588 bp, Homo sapiens
gaggcagtggcgcttgagttggtcgggggcagcggcagatttgaggcttaagcaacttcttccggggaagagtgccagtgcagccactgttacaattcaagatcttgatctatatccatagattggaatattggtgggccagcaatcctcagacgcctcacttaggacaaatgaggaaactgaggcttggtgaagttacgaaacttgtccaaaatcacacaacttgtaaagggcacagccaagattcagagccaggctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctgaaaggaagttcttcaaaggcttctttggaaaaactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctcatgccatcccacgccggcatgctccaattgaacagcttgctcgccaaggctctttccgaggttttcctgctcttagccagaagatgtcaccctttaaacgccaactatccctacgcatcaatgagttgccttccactatgcagaggaagactgatttccccattaaaaatgcagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagctaatggcactgactcagccttccatgtgcttgctaagccagcccatactgctctagcacccgtagcaatgcctgtgcgtgaaaccaacccttgggcccatgcccctgatgctgctaacaaggaaattgcagccacatgttcggggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtccataccagacagggagcagggggtagcggtcaaaggagcaaaacagactttgtctcctgattagtactcttttcactaatcccaaaggtcccaaggaacaagtccaggcccagagtactgtgaggggtgattttgaaagacatgggaaaaagcattcctagagaaaagctgccttgcaattaggctaaagaagtcaaggaaatgttgctttctgtactccctcttcccttacccccttacaaatctctggcaacagagaggcaaagtatctgaacaagaatctatattccaagcacatttactgaaatgtaaaacacaacaggaagcaaagcaatctccctttgtttttcaggccattcacctgcctcctgtcagtagtggcctgtattagagatcaagaagagtggtttgtgctcaggctggggaacagagaggcacgctatgctgccagaattcccaggagggcatatcagcaactgcccagcagagctatattttgggggagaagttgagcttccattttgagtaacagaataaatattatatatatcaaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaacctatgatggaattctaatgtcattattttaatggaatcaatcgaaatatgctctatagagaatatatcttttatatattgctgcagtttccttatgttaatcctttaacactaaggtaacatgacataatcataccatagaagggaacacaggttaccatattggtttgtaatatgggtcttggtgggttttgttttatcctttaaattttgttcccatgagttttgtggggatggggattctggttttattagctttgtgtgtgtcctcttcccccaaacccccttttggtgagaacatccccttgacagttgcagcctcttgacctcggataacaataagagagctcatctcatttttacttttgaacgttggccttacaatcaaatgtaagttatatatatttgtactgatgaaaatttataatctgctttaacaaaaataaatgttcatggtagaa

SEQ ID NO: 21001 - DNA, 1039 bp, Homo sapiens
gagttctcccgaggaaggtaggctacggccggacccgcgcgggtcaggccaggaggtcccttgggacgtccagctgctccggtctagcgcgctgaccggcggccactgtgtgaggaatttgaggcttaagcaacttcttccggggaagagtgccagtgcagccactgttacaattcaagatcttgatctatatccatagattggaatattggtgggccagcaatcctcagacgcctcacttaggacaagctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctgaaaggaagttcttcaaaggcttctttggaaaaactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctca

SEQ ID NO: 21002 - DNA, 3037 bp, Homo sapiens
gttgtcatgggggaggtggtggcgcttggtggccactggcggccgaggtagaggcagtggcgcttgagttggtcgggggcagcggcagatttgaggcttaagcaacttcttccggggaagagtgccagtgcagccactgttacaattcaagatcttgatctatatccatagattggaatattggtgggccagcaatcctcagacgcctcacttaggacaaatgaggaaactgaggcttggtgaagttacgaaacttgtccaaaatcacacaacttgtaaagggcacagccaagattcagagccaggctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctgaaaggaagttcttcaaaggcttctttggaaaaactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctcatgccatcccacgccggcatgctccaattgaacagcttgctcgccaaggctctttccgaggttttcctgctcttagccagaagatgtcaccctttaaacgccaactatccctacgcatcaatgagttgccttccactatgcagaggaagactgatttccccattaaaaatgcagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtccataccagacagggagcagggggtagcggtcaaaggagcaaaacagactttgtctcctgattagtactcttttcactaatcccaaaggtcccaaggaacaagtccaggcccagagtactgtgaggggtgattttgaaagacatgggaaaaagcattcctagagaaaagctgccttgcaattaggctaaagaagtcaaggaaatgttgctttctgtactccctcttcccttacccccttacaaatctctggcaacagagaggcaaagtatctgaacaagaatctatattccaagcacatttactgaaatgtaaaacacaacaggaagcaaagcaatctccctttgtttttcaggccattcacctgcctcctgtcagtagtggcctgtattagagatcaagaagagtggtttgtgctcaggctggggaacagagaggcacgctatgctgccagaattcccaggagggcatatcagcaactgcccagcagagctatattttgggggagaagttgagcttccattttgagtaacagaataaatattatatatatcaaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaaccta

SEQ ID NO: 21003 - DNA, 3547 bp, Homo sapiens
ggcgcttgagttggtcgggggcagcggcagatttgaggcttaagcaacttcttccggggaagagtgccagtgcagccactgttacaattcaagatcttgatctatatccatagattggaatattggtgggccagcaatcctcagacgcctcacttaggacaaatgaggaaactgaggcttggtgaagttacgaaacttgtccaaaatcacacaacttgtaaagggcacagccaagattcagagccaggctgtaaaaattaaaatgaacaaattacggcaaagttttaggagaaagaaggatgtttatgttccagaggccagtcgtccacatcagtggcagacagatgaagaaggcgttcgcaccggaaaatgtagcttcccggttaagtaccttggccatgtagaagttgatgaatcaagaggaatgcacatctgtgaagatgctgtaaaaagattgaaagctactggaaagaaagcagttaaagcagttctgtgggtctcagcagatggactcagagttgtggatgaaaaaactaaggacctcatagttgaccagacgatagagaaagtttctttctgtgccccagacaggaactttgatagagccttttcttacatatgccgtgatggcaccactcgtcgctggatctgtcactgcttcatggctgtcaaggacacaggtgaaaggttgagccatgcagtaggctgtgcttttgcagcctgtttagagcgcaagcagaagcgggagaaggaatgtggagtgactgctacttttgatgctagtcggaccacttttacaagagaaggatcattccgtgtcacaacagccactgaacaagcagaaagagaggagatcatgaaacaaatgcaagatgccaagaaagctgaaacagataagatagtcgttggttcatcagttgcccctggcaacactgccccatccccatcctctcccacctctcctacttctgatgccacgacctctctggagatgaacaatcctcatgccatcccacgccggcatgctccaattgaacagcttgctcgccaaggctctttccgaggttttcctgctcttagccagaagatgtcaccctttaaacgccaactatccctacgcatcaatgagttgccttccactatgcagaggaagactgatttccccattaaaaatgcagtgccagaagtagaaggggaggcagagagcatcagctccctgtgctcacagatcaccaatgccttcagcacacctgaggaccccttctcatctgctccgatgaccaaaccagtgacagtggtggcaccacaatctcctaccttccaagctaatggcactgactcagccttccatgtgcttgctaagccagcccatactgctctagcacccgtagcaatgcctgtgcgtgaaaccaacccttgggcccatgcccctgatgctgctaacaaggaaattgcagccacatgttcggggaccgagtggggtcaatcttctggtgctgcctctccaggtctcttccaggccggtcatagacgtactccctctgaggccgaccgatggttagaagaggtgtctaagagcgtccgggctcagcagccccaggcctcagctgctcctctgcagccagttctccagcctcctccacccactgccatctcccagccagcatcacctttccaagggaatgcattcctcacctctcagcctgtgccagtgggtgtggtcccagccctgcaaccagcctttgtccctgcccagtcctatcctgtggccaatggaatgccctatccagcccctaatgtgcctgtggtgggcatcactccctcccagatggtggccaacgtatttggcactgcaggccaccctcaggctgcccatccccatcagtcacccagcctggtcaggcagcagacattccctcactacgaggcaagcagtgctaccaccagtcccttctttaagcctcctgctcagcacctcaacggttctgcagctttcaatggtgtagatgatggcaggttggcctcagcagacaggcatacagaggttcctacaggcacctgcccagtggatccttttgaagcccagtgggctgcattagaaaataagtccaagcagcgtactaatccctcccctaccaaccctttctccagtgacttacagaagacgtttgaaattgaactttaagcaatcattatggctatgtatcttgtccataccagacagggagcagggggtagcggtcaaaggagcaaaacagactttgtctcctgattagtactcttttcactaatcccaaaggtcccaaggaacaagtccaggcccagagtactgtgaggggtgattttgaaagacatgggaaaaagcattcctagagaaaagctgccttgcaattaggctaaagaagtcaaggaaatgttgctttctgtactccctcttcccttacccccttacaaatctctggcaacagagaggcaaagtatctgaacaagaatctatattccaagcacatttactgaaatgtaaaacacaacaggaagcaaagcaatctccctttgtttttcaggccattcacctgcctcctgtcagtagtggcctgtattagagatcaagaagagtggtttgtgctcaggctggggaacagagaggcacgctatgctgccagaattcccaggagggcatatcagcaactgcccagcagagctatattttgggggagaagttgagcttccattttgagtaacagaataaatattatatatatcaaaagccaaaatctttatttttatgcatttagaatattttaaatagttctcagatattaagaagttgtatgagttgtaagtaatcttgccaaaggtaaaggggctagttgtaagaaattgtacataagattgatttatcattgatgcctactgaaataaaaagaggaaaggctggaagctgcagacaggatccctagcttgttttctgtcagtcattcattgtaagtagcacattgcaacaacaatcatgcttatgaccaatacagtcactaggttgtagttttttttaaataaaggaaaagcagtattgtcctggttttaaacctatgatggaattctaatgtcattattttaatggaatcaatcgaaatatgctctatagagaatatatcttttatatattgctgcagtttccttatgttaatcctttaacactaaggtaacatgacataatcataccatagaagggaacacaggttaccatattggtttgtaatatgggtcttggtgggttttgttttatcctttaaattttgttcccatgagttttgtggggatggggattctggttttattagctttgtgtgtgtcctcttcccccaaacccccttttggtgagaacatccccttgacagttgcagcctcttgacctcggataacaataagagagctcatctcatttttacttttgaacgttggccttacaatcaaatgtaagttatatatatttgtactgatgaaaatttataatctgctttaacaaaaataaatgttcatggtagaa

SEQ ID NO: 21004 - DNA, 3561 bp, Homo sapiens
aatcctcccgggagccgaggaggctcgcgcgcgtgcatcccgcaccatcccccggccccgggccctggccggcgtcagaccgagctgccgccgccaccaccgcagcagcagcagtcggggagccaggcccagccagggccgcgggaggcgggggcgcccgggccctggatgtcccgcagcgcggcggccagcggcggaccccggaggcctgagcggcacctgcccccagccccctgtggggccccggggcccccagaaacctgcaggacggagccagacggggcgggcaccatgaacaagttacggcagagcctgcggcggaggaagccagcctacgtgcccgaggcgtcgcgcccgcaccagtggcaggcagacgaggacgcggtgcggaagggcacgtgcagcttcccggtcaggtacctgggtcacgtggaggtagaggagtcccggggaatgcacgtgtgtgaagatgcggtgaagaagctgaaggcgatgggccgaaagtccgtgaagtctgtcctgtgggtgtcagccgatgggctccgagtggtggacgacaaaaccaaggatcttctggtcgaccagaccatcgaaaaggtctccttttgtgctcctgaccgcaacctggacaaggctttctcctatatctgtcgtgacgggactacccgccgctggatctgccactgttttctggcactgaaggactccggcgagaggctgagccacgctgtgggctgtgcttttgccgcctgcctggagcgaaaacagcgacgggagaaggaatgtggggtcacggccgccttcgatgccagccgcaccagcttcgcccgcgagggctccttccgcctgtctgggggtgggcggcctgctgagcgagaggccccggacaagaagaaagcagaggcagcagctgcccccactgtggctcctggccctgcccagcctgggcacgtgtccccgacaccagccaccacatcccctggtgagaagggtgaggcaggcacccctgtggctgcaggcaccactgcggccgccatcccccggcgccatgcacccctggagcagctggttcgccagggctccttccgtgggttcccagcactcagccagaagaactcgcctttcaaacggcagctgagcctacggctgaatgagctgccatccacgctgcagcgccgcactgacttccaggtgaagggcacagtgcctgagatggagcctcctggtgccggcgacagtgacagcatcaacgctctgtgcacacagatcagttcatcttttgccagtgctggagcgccagcaccagggccaccacctgccacaacagggacttctgcctggggtgagccctccgtgccccctgcagctgccttccagcctgggcacaagcggacaccttcagaggctgagcgatggctggaggaggtgtcacaggtggccaaggcccagcagcagcagcagcagcaacagcaacagcagcagcagcagcagcagcaacagcagcaagcagcctcagtggccccagtgcccaccatgcctcctgccctgcagcctttccccgcccccgtggggccctttgacgctgcacctgcccaagtggccgtgttcctgccacccccacacatgcagcccccttttgtgcccgcctacccgggcttgggctacccaccgatgccccgggtgcccgtggtgggcatcacaccctcacagatggtggcaaacgccttctgctcagccgcccagctccagcctcagcctgccactctgcttgggaaagctggggccttcccgccccctgccatacccagtgcccctgggagccaggcccgccctcgccccaatggggccccctggccccctgagccagcgcctgccccagctccagagttggacccctttgaggcccagtgggcggcattagaaggcaaagccactgtagagaaaccctccaaccccttttctggcgacctgcaaaagacattcgagattgaactgtagcccgagccgccccacccactccatcatctccaggtgccccacgcctgggggtggaggcacaacctctcccctaaccctgctccctggggctgcgcccctcaacaccctctcaacacccccctccctcaaccaccccgacaaccactacagaaccaacattgtgacgcccaggttgcaacaggatggaattcagggacggacccagcctggctaagggaaccatttcactgccggacttaggctggcaatgcccccttccccaaccccagacacaggggttggccacaatcccactgaatgcccttggttcacactccatttcccagtttctgttgacccccaccttccagtgttggacaggatggaggggggacacttgcttaggggctctcctgggccccacaccagtgcccaccccaaatctggtcgtctcctccccccatgcacagcacaagctaagggctgccctctgcccacacgctgcgttcactgccaatgctgtactcacctccatcaccctccaactttggggcccatgtcttccttgggccaaggtctcatgggggctagggccaagttgggggcccaggaggcggggagggaggaggaggagaagatgcgcagttacctcatgtcggtgcccgctggggaggggtccgggaagaaggggaaggggtgcctggcgggtacttttctatcttttatttccagattttttttgtatctaaacttgaagatttgtattatacaaggacagccaataaaggaagaatataatggtgcccctcgggaaacgagggtgtgtgtagggcgctggtgaggccctagaacctttcctcctgagtcatggactgaaacagagtcagaaggatgtccctgagtgataacctctgagtcatagcgtggtaacaggtaccactgactcagcacctgccaggcgggtattaaaggagccaaaattaatcaccccatttctattccttacagagttagaatcaaggaataaaaaacaaatattatgaactgctggctgggcacagtggctcacgcctgtaatcccagcactttgggaggtcgaggcaggcagatcacttaaggtcaggagttcgagaccagcctggccgccatggagaaacccagtctctaccaaaaattcaaaaattagccgggcgtggtggcaggcgcctgtaattccaggaggctgaggcacaagaatcgcttgaacccaggcagcagaggttgcagtgacctgaggtcacaccattgcactcctgcctgggcaacagaatgagactctgtctcaaaaaaaaaaaacaaaaaaaaaaaaactacttctaattagctcaatattaatattttaacaagttgggttggtaacagtatatctttgcccatgctggcaaattcttgttttgtcagcattttccataactctggccaaagtgtcacctgatgtggcaacgttttacagtcttgctattgtttcttgagtcctttaatctataagatgtatttttaaaaatatataacatataaattttgtttcgttatagctctttaaaa

SEQ ID NO: 21005 - DNA, 1931 bp, Homo sapiens
aaaccaaggcctccaggacgcgattccagacacaatccctacctctccctgcctaagggggtctcagcacaacaactgcctagacggggcgggcaccatgaacaagttacggcagagcctgcggcggaggaagccagcctacgtgcccgaggcgtcgcgcccgcaccagtggcaggcagacgaggacgcggtgcggaagggcacgtgcagcttcccggtcaggtacctgggtcacgtggaggtagaggagtcccggggaatgcacgtgtgtgaagatgcggtgaagaagctgaaggcgatgggccgaaagtccgtgaagtctgtcctgtgggtgtcagccgatgggctccgagtggtggacgacaaaaccaaggatcttctggtcgaccagaccatcgaaaaggtctccttttgtgctcctgaccgcaacctggacaaggctttctcctatatctgtcgtgacgggactacccgccgctggatctgccactgttttctggcactgaaggactccggcgagaggctgagccacgctgtgggctgtgcttttgccgcctgcctggagcgaaaacagcgacgggagaaggaatgtggggtcacggccgccttcgatgccagccgcaccagcttcgcccgcgagggctccttccgcctgtctgggggtgggcggcctgctgagcgagaggccccggacaagaagaaagcagaggcagcagctgcccccactgtggctcctggccctgcccagcctgggcacgtgtccccgacaccagccaccacatcccctggtgagaagggtgaggcaggcacccctgtggctgcaggcaccactgcggccgccatcccccggcgccatgcacccctggagcagctggttcgccagggctccttccgtgggttcccagcactcagccagaagaactcgcctttcaaacggcagctgagcctacggctgaatgagctgccatccacgctgcagcgccgcactgacttccaggtgaagggcacagtgcctgagatggagcctcctggtgccggcgacagtgacagcatcaacgctctgtgcacacagatcagttcatcttttgccagtgctggagcgccagcaccagggccaccacctgccacaacagggacttctgcctggggtgagccctccgtgccccctgcagctgccttccagcctgggcacaagcggacaccttcagaggctgagcgatggctggaggaggtgtcacaggtggccaaggcccagcagcagcagcagcagcaacagcaacagcagcagcagcagcagcagcaacagcagcaagcagcctcagtggccccagtgcccaccatgcctcctgccctgcagcctttccccgcccccgtggggccctttgacgctgcacctgcccaagtggccgtgttcctgccacccccacacatgcagcccccttttgtgcccgcctacccgggcttgggctacccaccgatgccccgggtgcccgtggtgggcatcacaccctcacagatggtggcaaacgccttctgctcagccgcccagctccagcctcagcctgccactctgcttgggaaagctggggccttcccgccccctgccatacccagtgcccctgggagccaggcccgccctcgccccaatggggccccctggccccctgagccagcgcctgccccagctccagagttggacccctttgaggcccagtgggcggcattagaaggcaaagccactgtagagaaaccctccaaccccttttctggcgacctgcaaaagacattcgagattgaactgtagcccgagccgccccacccactccatcatctccaggtgccccacgcctgggggtggaggcacaacctctcccctaaccctgctccctggggctgcgcccctcaacaccctctcaacacccccctccctc

SEQ ID NO: 21006 - DNA, 2713 bp, Homo sapiens
tggctgcctgacttgggagatggatgggctgagggagtggagggggacctcagaggagcaggaccagggagactcccaggacggtaagcaacatttgaggaccattcactaacgcttctctgcaggggtttcctctccatccatttccttgctgggttgtcagtgatgccatctgagttgctgtcagggctgtagcctgacaaagggtttcctaatagatccaaactgtccatttgtggggagcttctgattttctgttgttactggtttcccttagcccaacaccagggtcattaagaaggaaggaatgtgaggaagaaagaaaggcagggcattcaggaagaagtgtggaggcatgggagggttctcatggggccctcctgggcactgggtgacctgtcctttctcccctcaggtaggggtcccacggctgggtggtcctaagccactgggtggatgaaaggccgagggatgttggtcctgcttctgcatgcggtggtcctcggcctgcccagcgcctgggccgtgggggcctgcgcccgcgcttgtcccgccgcctgcgcctgcagcaccgtggagcgcggctgctcggtgcgctgcgaccgcgcgggcctcctgcgggtgccggccgagctcccgtgcgaggcggtctccatcgacctggaccggaacggcctgcgcttcctgggcgagcgagccttcggcacgctgccgtccttgcgccgcctgtcgctgcgccacaacaacctgtccttcatcacgcccggcgccttcaagggcctgccgcgcctggctgagctgcgcctggcgcacaacggcgacctgcgctacctgcacgcgcgcaccttcgcggcgctcagccgcctgcgccgcctagacctagcagcctgccgcctcttcagcgtgcccgagcgcctcctggccgaactgccggccctgcgcgaactcgccgccttcgacaacctgttccgccgcgtgccgggcgcgctgcgcggcctggccaacctgacgcacgcgcacctggagcgcggccgcatcgaggcggtggcctccagctcgctgcagggcctgcgccgcctgcgctcgctcagcctgcaggccaaccgcgtccgtgccgtgcacgctggcgccttcggggactgtggcgtcctggagcatctgctgctcaacgacaacctgctggccgagctcccggccgacgccttccgcggcctgcggcgcctgcgcacgctcaacctgggtggcaacgcgctggaccgcgtggcgcgcgcctggttcgctgacctggccgagctcgagctgctctacctggaccgcaacagcatcgccttcgtggaggagggcgccttccagaacctctcgggtctcctcgcgctgcacctcaacggcaaccgcctcaccgtgctcgcctgggtcgccttccagcccggcttcttcctgggccgcctcttcctcttccgcaacccgtggtgctgcgactgccgtctggagtggctgagggactggatggagggctccggacgtgtcaccgacgtgccgtgcgcctccccgggctccgtggccggcctggacctcagccaggtgaccttcgggcgctcctccgatggcctctgtgtggaccccgaggagctgaacctcaccacgtccagtccaggcccgtccccagaaccagcggccaccaccgtgagcaggttcagcagcctcctctccaagctgctggccccgagggtcccggtggaggaggcggccaacaccactggggggctggccaacgcctccctgtccgacagcctctcctcccgtggggtgggaggcgcgggccggcagccctggtttctcctcgcctcttgtctcctgcccagcgtggcccagcacgtggtgtttggcctgcagatggactgacctggccagaggggggaaagtttgcttaactgggcttgagtgtgtttgtggtaaggggagaggagccggaatggagggcagaggtgaaaatcccagtggagggtggaaggaaccgtttgcctccagagatggccccagggagaacacagggacgtgccactcgagggggaggatggtatggatttctgcttttgtcacacgggcatccattggaaaagagaagcaagaatgaacgtgggccctcgggtgggaagactaggaatcggaagcttctagggcttcacatcccttcccctcccctccccttcccctcatcttccaggcaacagtgcctgcaaggcctgaattagagagacttccattggctaagtagttaagagccgtcccatttctcctggcggggtaacccattacaccgaagtcctttgttttctaccacaatcctcctcctcctctccaggggcctggaaacactaggattcaggaaggtaggcaggacgtgagagaagggagatgggagagagatttaagacaaagggtggcggtggttcctggggtctgagatgtgttaggaggcgtttaaaacaaagatccagttcatttactccacagttattcccagggctggccctagccacaaaggaactttagggcagggtagggaaaaaaggggcagcagggggtgtgtttgtggacaaataaatttgtaaagtccgaggattaaaaaaaaaaaaaggttaaaccggtttctctactgctggacttttcagagtctttcatatgctaacattcattgtgaatctcccaagag

SEQ ID NO: 21007 - DNA, 2297 bp, Homo sapiens
ggctgagggagtggagggggacctcagaggagcaggaccagggagactcccaggacggtaggggtcccacggctgggtggtcctaagccactgggtggatgaaaggccgagggatgttggtcctgcttctgcatgcggtggtcctcggcctgcccagcgcctgggccgtgggggcctgcgcccgcgcttgtcccgccgcctgcgcctgcagcaccgtggagcgcggctgctcggtgcgctgcgaccgcgcgggcctcctgcgggtgccggccgagctcccgtgcgaggcggtctccatcgacctggaccggaacggcctgcgcttcctgggcgagcgagccttcggcacgctgccgtccttgcgccgcctgtcgctgcgccacaacaacctgtccttcatcacgcccggcgccttcaagggcctgccgcgcctggctgagctgcgcctggcgcacaacggcgacctgcgctacctgcacgcgcgcaccttcgcggcgctcagccgcctgcgccgcctagacctagcagcctgccgcctcttcagcgtgcccgagcgcctcctggccgaactgccggccctgcgcgaactcgccgccttcgacaacctgttccgccgcgtgccgggcgcgctgcgcggcctggccaacctgacgcacgcgcacctggagcgcggccgcatcgaggcggtggcctccagctcgctgcagggcctgcgccgcctgcgctcgctcagcctgcaggccaaccgcgtccgtgccgtgcacgctggcgccttcggggactgtggcgtcctggagcatctgctgctcaacgacaacctgctggccgagctcccggccgacgccttccgcggcctgcggcgcctgcgcacgctcaacctgggtggcaacgcgctggaccgcgtggcgcgcgcctggttcgctgacctggccgagctcgagctgctctacctggaccgcaacagcatcgccttcgtggaggagggcgccttccagaacctctcgggtctcctcgcgctgcacctcaacggcaaccgcctcaccgtgctcgcctgggtcgccttccagcccggcttcttcctgggccgcctcttcctcttccgcaacccgtggtgctgcgactgccgtctggagtggctgagggactggatggagggctccggacgtgtcaccgacgtgccgtgcgcctccccgggctccgtggccggcctggacctcagccaggtgaccttcgggcgctcctccgatggcctctgtgtggaccccgaggagctgaacctcaccacgtccagtccaggcccgtccccagaaccagcggccaccaccgtgagcaggttcagcagcctcctctccaagctgctggccccgagggtcccggtggaggaggcggccaacaccactggggggctggccaacgcctccctgtccgacagcctctcctcccgtggggtgggaggcgcgggccggcagccctggtttctcctcgcctcttgtctcctgcccagcgtggcccagcacgtggtgtttggcctgcagatggactgacctggccagaggggggaaagtttgcttaactgggcttgagtgtgtttgtggtaaggggagaggagccggaatggagggcagaggtgaaaatcccagtggagggtggaaggaaccgtttgcctccagagatggccccagggagaacacagggacgtgccactcgagggggaggatggtatggatttctgcttttgtcacacgggcatccattggaaaagagaagcaagaatgaacgtgggccctcgggtgggaagactaggaatcggaagcttctagggcttcacatcccttcccctcccctccccttcccctcatcttccaggcaacagtgcctgcaaggcctgaattagagagacttccattggctaagtagttaagagccgtcccatttctcctggcggggtaacccattacaccgaagtcctttgttttctaccacaatcctcctcctcctctccaggggcctggaaacactaggattcaggaaggtaggcaggacgtgagagaagggagatgggagagagatttaagacaaagggtggcggtggttcctggggtctgagatgtgttaggaggcgtttaaaacaaagatccagttcatttactccacagttattcccagggctggccctagccacaaaggaactttagggcagggtagggaaaaaaggggcagcagggggtgtgtttgtggacaaataaatttgtaaagtccgaggattaaaaaaaaaaaaaggttaaaccggtttctct

SEQ ID NO: 21008 - DNA, 4417 bp, Homo sapiens
ccccggccggttaggccaatgggcgggacgcgcgggcaaggcggggaggggcggggcccatggtctgcgcgcaggtgccgctcggcgcccggcccgcccgttccgccgctgtcgccgccgtcgtgcgtgccgctcggcggaggggacgggcctgcgttctctcctccttcctccccgcctccagctgccggcaggacctttctctcgctgccgctgggaccccgtgtcatcgcccaggccgagcacgatgccccctaaaaagggaggtgatggaattaaaccacccccaatcattggaagatttggaacctcactgaaaattggtattgttggattgccaaatgttgggaaatctactttcttcaatgtgttaaccaatagtcaggcttcagcagaaaacttcccgttctgcactattgatcctaatgagagcagagtacctgtgccagatgaaaggtttgactttctttgtcaataccacaaaccagcaagcaaaattcctgcctttctaaatgtggtggatattgctggccttgtgaaaggagctcacaatgggcagggcctggggaatgcttttttatctcatattagtgcctgtgatggcatctttcatctaacacgtgcttttgaagatgatgatatcacgcacgttgaaggaagtgtagatcctattcgagatatagaaataatacatgaagagcttcagcttaaagatgaggaaatgattgggcccattatagataaactagaaaaggtggctgtgagaggaggagataaaaaactaaaacctgaatatgatataatgtgcaaagtaaaatcctgggttatagatcaaaagaaacctgttcgcttctatcatgattggaatgacaaagagattgaagtgttgaataaacacttatttttgacttcaaaaccaatggtctacttggttaatctttctgaaaaagactacattagaaagaaaaacaaatggttgataaaaattaaagagtgggtggacaagtatgacccaggtgctttggtcattccttttagtggggccttggaactcaagttgcaagaattgagtgctgaggagagacagaagtatctggaagcgaacatgacacaaagtgctttgccaaagatcattaaggctgggtttgcagcactccaactagaatactttttcactgcaggcccagatgaagtgcgtgcatggaccatcaggaaagggactaaggctcctcaggctgcaggaaagattcacacagattttgaaaagggattcattatggctgaagtaatgaaatacgaagattttaaagaggaaggttctgaaaatgcagtcaaggctgctggaaagtacagacaacaaggcagaaattatattgttgaagatggagatattatcttcttcaaatttaacacacctcaacaaccgaagaagaaataaaatttagttattgctcagataaacatacaacttccaaaaggcatctgatttttaaaaaattaaaatttctgaaaaccaatgcgacaaataaagttggggagatgggaatctttgacaaacaaattatttttatttgttttaaaattaaaatactgtgtacccccccccccccatgaaatgcaggttcactaaatgtgaacagctttgcttttcacgtgattaagaccctactccaaattgtagaagcttttcaggaaccatattactctcatgatacttcattaatctccatcatgtatgccaagcctgacacatttgacagtgaggacaatgtggcttgctcctttttgaatctacagataatgcatgttttacagtactccagatgtctacactcaataaaacatttgacaaaaccagccttggtgtgtttggggatgtctgtattgactgactgtggtgtgctgaatgcgatacggcacctggtggttgctgattacagaattttaaggcgtgtgtatgacacagtaactggcagtgtggggcagctgcaattgtatcttaaaagtgagtctttcatgggaatcagaagaatagtataccagggatttgtctcaaaaaagttaattaatttatagatcaacatttattgaaagatgatagcaatgatattatgagggatatgagataggtgactgaccacaaagaagaaaattctgtctcaaaaattaaagaattttgtttgttattgttgttctgaccatattgaaaagaggttcacttttaatctttcctttgaaattattaaattgtaaaaactgacccattgatgtctggtgggttatgttttgcttcaattcagcaatgtgtataaaagttcctacactgattttgaaatactaagatcagactttgaaaattttaaaaattctttcattcttacttttcagatatttgagagcagtcgaagtggtagtatgggtaagttaagcacttcttaacattgtagcagaaaattccaaaagaaagactagaacaaattggtaatttggagaccctttgccacttagccttctcttgtgatgatggcctgaaagctctctcggccctgagcctccctttctctcccatgtttccattcctgtgagacctcccttccttgtccttgtcctctgcccttttgtgctcttctgtgatcacaggaccatttccatggaatgcagattcatacccagccagcctttgcctctactgtatcgctttgggactttaaagatgcagaagtattagaacacacacaaacttaaaatggaaagttaccaaatgtagcactagaggcaagaaaaggggtgattttttaaagatttggctatacttaagatatttaaagaggatgaggttgagtcgtgagtataatttagaagctctccagtgagtatttttttagtatcaaatagtgatcttcttttgctaacataaaaatgagtaaactacagcagagaaataagaataaaactaatgaagggttttttaaaagaactaaataaaacaaataaaactaggctacaggtatagctgaccaagtttgctgtgaaaaatccttgttatatctatttctgtattggagtaatgtgtagattagtggattgttagggatttcagcagtataagaaagaatcaaatatcttgcttttgggtcttctccaaagtaaattgcatggacttcttaaagaagtttgaaatcagtaaaaagacattaggatcatgcaattttactttgtctagcttctaatgtggtaaattgcacattgtgcaacagaaccattaataaaagaaaggagttagttttgaggtaactgcattcattaggggctgaaaataaatgttaaaaatgtttaatttggttagaagttctacaacattgtatgtacatatacaaaatttcattttctctgaaagtcgagaattccaagaactgttacatataatcatatatatgcctatatctaaacgttttccctcctttaatattgataaagttaatatattttaggatgttatgtaaatatttttgcatgtatctgtagctccatcttaatcaaatttatggttaaaagagatttgaggccaggcgtggaggctcacacctataatcccaacactttgggaggccgaggtgggaggatcacttgagcacaggagtttgagaccagcctgtgcaacatcatgaaacatcatctctacataaaaaaatacatatatacaaaaattagctgggcatcatggcacacacctgtagtcccagctacttaggaggctgagatgggaggattgatcgatcgcttgagcctgggaggtggaggctactgtgagccatgatcatgccactgcactccagcctgggcaacagagtgagaccctgtctccaaagagaaagagaaacttgagaaggcttgtgcccaaagcttgaagaaagattgtaatagcatttagttgtgttttatcatgttatcttcataacatgcattttgcatatggctcagagcagagccggatctcccaaggaagcacaaatagtttttgtcgctaacttagttatgagtgaagcctctgttcacttataacttgccagtttcattggtggaataagtccccttactcatgattcatcaatattcctatattaaaattccagtttgatgtttgtctctagttgtctgtgtataatatttccaaagctcctttgtaaaccccgtctcctttcattcagagagtcagagacggtatctcctcctcctgcctcttctattgttctgattagtctacttaaattcacttgatgctctttttattttacaagagacttgagaaatgtcggttgttcctaatggcaaactactttagctgggaaaattcatttcaacttattttaagcttgtaaaatacactgtggtgataaaataaaagagctgggtttga

SEQ ID NO: 21009 - DNA, 1656 bp, Homo sapiens
gttccgccgctgtcgccgccgtcgtgcgtgccgctcggcggaggggacgggcctgcgttctctcctccttcctccccgcctccagctgccggcaggacctttctctcgctgccgctgggaccccgtgtcatcgcccaggccgagcacggaaatctactttcttcaatgtgttaaccaatagtcaggcttcagcagaaaacttcccgttctgcactattgatcctaatgagagcagagtacctgtgccagatgaaaggtttgactttctttgtcaataccacaaaccagcaagcaaaattcctgcctttctaaatgtggtggatattgctggccttgtgaaaggagctcacaatgggcagggcctggggaatgcttttttatctcatattagtgcctgtgatggcatctttcatctaacacgtgcttttgaagatgatgatatcacgcacgttgaaggaagtgtagatcctattcgagatatagaaataatacatgaagagcttcagcttaaagatgaggaaatgattgggcccattatagataaactagaaaaggtggctgtgagaggaggagataaaaaactaaaacctgaatatgatataatgtgcaaagtaaaatcctgggttatagatcaaaagaaacctgttcgcttctatcatgattggaatgacaaagagattgaagtgttgaataaacacttatttttgacttcaaaaccaatggtctacttggttaatctttctgaaaaagactacattagaaagaaaaacaaatggttgataaaaattaaagagtgggtggacaagtatgacccaggtgctttggtcattccttttagtggggccttggaactcaagttgcaagaattgagtgctgaggagagacagaagtatctggaagcgaacatgacacaaagtgctttgccaaagatcattaaggctgggtttgcagcactccaactagaatactttttcactgcaggcccagatgaagtgcgtgcatggaccatcaggaaagggactaaggctcctcaggctgcaggaaagattcacacagattttgaaaagggattcattatggctgaagtaatgaaatacgaagattttaaagaggaaggttctgaaaatgcagtcaaggctgctggaaagtacagacaacaaggcagaaattatattgttgaagatggagatattatcttcttcaaatttaacacacctcaacaaccgaagaagaaataaaatttagttattgctcagataaacatacaacttccaaaaggcatctgatttttaaaaaattaaaatttctgaaaaccaatgcgacaaataaagttggggagatgggaatctttgacaaacaaattatttttatttgttttaaaattaaaatactgtgtacccccccccccccatgaaatgcaggttcactaaatgtgaacagctttgcttttcacgtgattaagaccctactccaaattgtagaagcttttcaggaaccatattactctcatgatacttcattaatctccatcatgtatgccaagcctgacacatttgacagtgaggacaatgtggcttgctcctttttgaatctacagataatgcatgttttacagtactccagatgtctacactcaataaaacatttgacaaaacc

SEQ ID NO: 21010 - DNA, 2071 bp, Homo sapiens
agtggccaagatggggccagggcagcgggtggcttggggatgtgtggatgaatgaggcgctgtcggactaggccgcgcgtcgggagatcggcctacgcctcacgcgggaaagccctggggaaagccttctcccgacgccaggacgcccggtggcccagtccggagaggaggatggggggtggggcccactttgggtgggctgccggccacctctctgtaggccagaggacccgacaggcgctgttcctgtatctgttctttggaggcctgggagttggccaggaacaggtgtcaggacgctgagaagggaaattcctggccctcggggtcagggatcagaggctggaatactactgcaagggcagggccccagcgtggtcctaggaggtacaactctcagccagaagactgggacagttttagttcccagcttctgagacgtgagcttagcggtctttgtgatttcactttgcagtccaagggtgggagtaattctgcacgcatgatttggagacagaactagtaagggacagagaaagtttcgacttgtaaataaaaaggttccgtcgattaatttaccattagaaatagtaaccataatgtagattttggaggttgcttatgaggactgatgagccgtaccttcagtgccaaaggtgggagggacttggtggaaggaccccagtacctgatgccccctaaaaagggaggtgatggaattaaaccacccccaatcattggaagatttggaacctcactgaaaattggtattgttggattgccaaatgttgggaaatctactttcttcaatgtgttaaccaatagtcaggcttcagcagaaaacttcccgttctgcactattgatcctaatgagagcagagtacctgtgccagatgaaaggtttgactttctttgtcaataccacaaaccagcaagcaaaattcctgcctttctaaatgtggtggatattgctggccttgtgaaaggagctcacaatgggcagggcctggggaatgcttttttatctcatattagtgcctgtgatggcatctttcatctaacacgtgcttttgaagatgatgatatcacgcacgttgaaggaagtgtagatcctattcgagatatagaaataatacatgaagagcttcagcttaaagatgaggaaatgattgggcccattatagataaactagaaaaggtggctgtgagaggaggagataaaaaactaaaacctgaatatgatataatgtgcaaagtaaaatcctgggttatagatcaaaagaaacctgttcgcttctatcatgattggaatgacaaagagattgaagtgttgaataaacacttatttttgacttcaaaaccaatggtctacttggttaatctttctgaaaaagactacattagaaagaaaaacaaatggttgataaaaattaaagagtgggtggacaagtatgacccaggtgctttggtcattccttttagtggggccttggaactcaagttgcaagaattgagtgctgaggagagacagaagtatctggaagcgaacatgacacaaagtgctttgccaaagatcattaaggctgggtttgcagcactccaactagaatactttttcactgcaggcccagatgaagtgcgtgcatggaccatcaggaaagggactaaggctcctcaggctgcaggaaagattcacacagattttgaaaagggattcattatggctgaagtaatgaaatacgaagattttaaagaggaaggttctgaaaatgcagtcaaggctgctggaaagtacagacaacaaggcagaaattatattgttgaagatggagatattatcttcttcaaatttaacacacctcaacaaccgaagaagaaataaaatttagttattgctcagataaacatacaacttccaaaaggcatctgatttttaaaaaattaaaatttctgaaaaccaatgcgacaaataaagttggggagatgggaatctttgacaaacaaattatttttatttgttttaaaattaaaatactgtgtacccccccccccccatgaaatgcaggttcac

SEQ ID NO: 21011 - DNA, 709 bp, Homo sapiens
agttctcgagcctcagcctcccgagtagctggaattacaggctgcgcgcctgatggccggctaatttttttgtatttgtttttctttttagtagagacggggtttctccgtgttggccaggctggtctcgactcctggtctcaagcagtctgcccacctcggcctccccctcccaaagtgctgggattacaggcctgagccaccgtgcccggcccaacaaatattgattttagatcagtctttctgggacttctcagcaatgactcttttgacaacggatatgtttacagaactttttaaacatttttgctgaaaaaaaagtggatttagctctgtgttagttttggatcgctatatacaatgccccctaaaaagggaggtgatggaattaaaccacccccaatcattggaagatttggaacctcactgaaaattggtattgttggattgccaaatgttgggaaatctactttcttcaatgtgttaaccaatagtcaggcttcagcagaaaacttcccgttctgcactattgatcctaatgagagcagagtacctgtgccagatgaaaggtttgactttctttgtcaataccacaaaccagcaagcaaaattcctgcctttctaaatgtggtggatattgctggccttgtgaaaggagctcacaatgggcagggcctggggaatgcttttttatctcatattagtgcct

SEQ ID NO: 21012 - DNA, 1270 bp, Homo sapiens
gtgtcatcgcccaggccgagcacgatgccccctaaaaagggaggtgatggaattaaaccacccccaatcattggaagatttggaacctcactgaaaattggtattgttggattgccaaatgttgggaaatctactttcttcaatgtgttaaccaatagtcaggcttcagcagaaaacttcccgttctgcactattgatcctaatgagagcagagtacctgtgccagatgaaaggtttgactttctttgtcaataccacaaaccagcaagcaaaattcctgcctttctaaatgtggtggatattgctggccttgtgaaaggagctcacaatgggcagggcctggggaatgcttttttatctcatattagtgcctgtgatggcatctttcatctaacacgtgcttttgaagatgatgatatcacgcacgttgaaggaagtgtagatcctattcgagatatagaaataatacatgaagagcttcagcttaaagatgaggaaatgattgggcccattatagataaactagaaaaggtggctgtgagaggaggagataaaaaactaaaacctgaatatgatataatgtgcaaagtaaaatcctgggttatagatcaaaagaaacctgttcgcttctatcatgattggaatgacaaagagattgaagtgttgaataaacacttatttttgacttcaaaaccaatggtctacttggttaatctttctgaaaaagactacattagaaagaaaaacaaatggctgctggaaagtacagacaacaaggcagaaattatattgttgaagatggagatattatcttcttcaaatttaacacacctcaacaaccgaagaagaaataaaatttagttattgctcagataaacatacaacttccaaaaggcatctgatttttaaaaaattaaaatttctgaaaaccaatgcgacaaataaagttggggagatgggaatctttgacaaacaaattatttttatttgttttaaaattaaaatactgtgtacccccccccccccatgaaatgcaggttcactaaatgtgaacagctttgcttttcacgtgattaagaccctactccaaattgtagaagcttttcaggaaccatattactctcatgatacttcattaatctccatcatgtatgccaagcctgacacatttgacagtgaggacaatgtggcttgctcctttttgaatctacagataatgcatgttttacagtactccagatgtctacactcaataaaacatttgacaaaa

SEQ ID NO: 21013 - DNA, 485 bp, Homo sapiens
atatagctaattgaagattctcatcttgtgtgtaagcccagtttgcagcaaatgtggactaattttatatagcaggtgcttttgaagatgatgatatcacgcacgttgaaggaagtgtagatcctattcgagatatagaaataatacatgaagagcttcagcttaaagatgaggaaatgattgggcccattatagataaactagaaaaggtggctgtgagaggaggagataaaaaactaaaacctgaatatgatataatgtgcaaagtaaaatcctgggttatagatcaaaagaaacctgttcgcttctatcatgattggaatgacaaagagattgaagtgttgaataaacacttatttttgacttcaaaaccaatggtctacttggttaatctttctgaaaaagactacattagaaagaaaaacaaatggttgataaaaattaaagagtgggtggacaagtatgacccaggtgctttggtcatt

SEQ ID NO: 21014 - DNA, 2184 bp, Homo sapiens
tggtgctgatgtgtgaactgtctcgggaggatgcccctgtgcgctggtacaaggatgggctggaagtggaggagagcgaggccctggtgctggagagggatgggccacgctgccgcctggtgctacctgctgctcagcccgaggacgggggcgagtttgtatgtgatgctggagatgactcggccttcttcactgtcactgtcacagccccaccagagaggattgtgcacccggcagcccgctccctggatctgcattttggggctccagggcgcgtggagctgcgctgtgaggtggccccagctgggtctcaggtgcgctggtacaaggacgggctggaagtggaggcatcagatgccctgcagctgggtgccgaggggcccacccgcaccctgaccctgccccacgcccagcctgaggacgccggggagtatgtgtgtgagacccggcatgaggccatcaccttcaatgtcatcctggctgagcctccagtgcagttccttgctctagagacaactccaagcccgctctgtgtggcccctggggagccagtggtgctgagctgtgaactgtcccgggctggcgcccccgtggtctggagccacaatgggaggcccgtgcaggagggcgagggcctagagctccatgccgagggcccccgccgagtcctctgcatccaggctgcaggcccagcccatgcagggctctacacctgccagtctggagcagcccccggagccccaagcctcagcttcaccgtccaggtggctgagccactgctggtgaagctggtctcggagctgacaccactcactgtccacgagggcgatgatgccacgttccggtgtgaagtctccccaccagatgccgatgtcacctggctgcgcaatggggccgtcgtcactccagggccccaggtggagatggcccagaatggttcaagccgcatcttaaccttgcgaggctgccaactgggggatgcagggaccgtgactttgcgggcagggagcacggccacaagtgcccggctccatgttcgagagacagagctgctgttcctacggcggttgcaggatgtgcgggcagaggaaggccaggatgtgtgtctcgaagtggagacaggccgagtgggtgcagcgggggccgtgcgctgggtgcgaggtgggcagcccctgccccacgactctcgcctgtccatggcccaggatgggcacatccaccgcctcttcatccatggtgtcatactggccgaccagggcacctacggctgcgagagccaccacgatcgcaccctggccaggctcagcgtgaggcgtgagtgccccgtcctctcttaatgcattacccaccctacaccacagccttttctggctgtcctggagtccctcaggcccccaccaaagtgcccctcatcgctgagaaaagtcacccatggccgtcccagcagcagcttgcccaaagcaaaacttttctttttctaatattttttatttaccttagaagtccatgtggattttgcattccattgcatatttccaagtcggctttgctataaacacaaatattctccagaaagacttgccatgggcatccttcaggcatgtattctagggatacacatacccacttaagtagcagggatggctgtcaaacagcaccccacacctcccacccaaagctggagccctctgtttcctatgtgacctcatgcaagttaacctctttgagccaagtctccttaaaaatggggctgagaccaggtgcagtggctcacgcctataatcctaacactttgggaggccaaggcaggaggatcccttgaggccaggagttcgaggccatcctgggcaacatagcaagaacccatctccacaaaaaaaaataaaaattagccgggcatggtagttactagggaggctgaggcagaaggattgcttgaacccaggaggttgaggctatagtgagctatgatcatgtcacggcattccagcctgggtgacagcaagaccctgtctcaaattttaaaaatggggttgatccccgtctcaagtgtctctgggaacattaactgagataacatgaaaattcttacacagagcttggtgaatggttgtcatttgtgacacatctcttctaacttatttcattcaagaaatcatcacaataaacctgtgtcccaatgtt

SEQ ID NO: 21015 - DNA, 5711 bp, Homo sapiens
ggctcctaagagcaggaagccaggcagcgggcaggggaggctgcggggccactcgctggagaggcaaacaggaaggactgccccctgagcgccaggcttcgggcccgggaatcgccgccgccgccgccgcagagctgcagctcggggccgagggtaaggaggcgagccgggagcgggaggcccgggagagctccgcgggtccccgcgcccagtccccagccgcgccccgaccccgccgccccgggcctcggctcgccctccgcacccccccctgcccccccaccgttcgccgctgcaggcggtcggccgccgcgatgaaggcgagctcgggggatcaggggagccccccgtgcttcctgcgcttcccgcggcctgtgcgggtggtaagtggcgccgaggccgagctcaagtgcgtggtcctgggggagccgccgcctgtagtggtgtgggagaagggcgggcagcagctggcggcctcggaacgcctgagcttcccggcggacggcgcggagcacggcctgctgctgaccgccgcactgcccaccgacgcgggggtctacgtgtgccgcgcccgcaacgcggccggcgaggcctacgcggcggccgccgtcaccgtgctggagccgccggcctccgaccccgagctgcagcccgccgagcgcccgctgccatcgccggggtccggggagggcgccccggtcttcctcacggggcctcgatcccagtgggtgctgcggggggcggaggtggtgctgacgtgccgggcggggggcctccccgagcccacactgtactgggagaaggacgggatggccctggacgaagtgtgggacagcagccacttcgcgctccagccgggccgcgccgaggacggccccggcgcgagcctggcactgcgcatcctggcggctcggctgccggattccggcgtctacgtgtgccacgcccgcaacgcgcacggccacgcgcaggcgggggcgctgctccaggtgcaccagccccccgagagcccgcccgcggaccccgacgaggcccccgcgccggtggtggagccgctcaagtgcgcgcctaagaccttctgggtgaacgagggcaagcacgccaagttccgctgctacgtgatgggcaagcccgagcccgagatcgaatggcactgggagggccgcccgctgctcccggaccgccgccgcctcatgtaccgcgaccgcgacggcggcttcgtgctcaaggtgctttactgccaggccaaggatcgtgggctctacgtctgcgccgcgcgcaactcggcgggccagacgctcagtgccgtgcagctgcacgtgaaagagccccgcctccggttcacacggcccctgcaggacgtggagggccgtgagcacgggattgccgtgctggaatgtaaagtacccaactcccgcatccccacggcctggttccgtgaggaccagcggctgctgccctgccgcaagtacgagcagatcgaagagggcactgtccggcgcctcatcatccacaggctgaaggcagacgatgatggtatctacctgtgcgagatgcggggccgggtgcgcaccgtggccaacgtcacagtcaaagggcccatcctgaagcgcctgccccggaagctcgacgtcctggaaggagagaatgctgtgctgctagtggaaactctagaggccggggtcgagggacgctggagccgtgatggggaggagctgccggtcatctgccagagcagctcaggccacatgcatgccctggtccttccaggggtcacccgagaggatgctggcgaggtcacctttagcctgggcaactcccgtaccactacgcttctcagagtaaaatgtgtcaagcacagtcccccaggaccccccatattggcagagatgttcaagggccacaagaacacggtcctgttgacctggaagcctcccgagccagctcccgagaccccattcatctaccggctggagcggcaggaagtgggctctgaagactggattcagtgcttcagcatcgagaaagccggagccgtggaggtgccgggcgactgtgtgccctccgagggtgactaccgcttccgcatctgcacagtcagcggacatggccgtagtccccacgtggtgttccacggttctgctcaccttgtgcccacagctcgcctggtggcaggtctggaggatgtgcaggtatacgacggggaagatgccgtcttctccctcgatctctccaccatcatccagggtacctggttccttaatggggaagagctcaagagtaacgagccggagggccaggtggaacctggggccctgcggtaccgtatagagcagaagggtctgcagcacagactcatcctgcatgccgtcaagcaccaggacagcggtgccctggtcggcttcagctgccccggcgtgcaggactcagctgccctcacaatccaagagagcccggtgcacatcctgagcccccaggacagggtgtcgttgaccttcacaacctcagagcgggtggtgctgacttgtgagctctcaagggtggacttcccggcaacctggtacaaggatgggcagaaggtggaggagagcgagttgctggtggtgaagatggatgggcgcaaacaccgtctgatcctgcctgaggccaaagtccaggacagtggcgagtttgagtgcaggacagaaggggtctcggccttcttcggcgtcactgtccaagatcctcccgtgcacatcgtggacccccgagaacatgtgttcgtgcatgccataacttccgagtgtgtcatgctggcctgtgaggtggaccgagaggacgcccctgtgcgttggtacaaggacgggcaggaggtggaggagagtgacttcgtggtgctggagaatgaggggccccatcgccgcctggtgctgcccgccacccagccctcagacgggggcgagtttcagtgcgtcgctggagatgagtgtgcctacttcactgtcaccatcacagacgtctcctcgtggatcgtgtatcccagcggcaaggtgtatgtggcagccgtgcgcctggagcgtgtggtgctgacctgtgagctatgccggccctgggcagaggtgcgctggaccaaggatggagaggaggtggtggagagccccgcgctgctcctgcagaaggaagacactgtccgccgcctggtgctgcccgctgtccagctcgaggactccggcgagtacttgtgtgaaattgacgatgagtcggcctccttcactgtcaccgtcacagaacccccagtgcggatcatataccctcgcgatgaggtgaccttgatcgccgtgaccttggagtgtgtggtgctgatgtgtgaactgtctcgggaggatgcccctgtgcgctggtacaaggatgggctggaagtggaggagagcgaggccctggtgctggagagggatgggccacgctgccgcctggtgctacctgctgctcagcccgaggacgggggcgagtttgtatgtgatgctggagatgactcggccttcttcactgtcactgtcacagagcctccagtgcagttccttgctctagagacaactccaagcccgctctgtgtggcccctggggagccagtggtgctgagctgtgaactgtcccgggctggcgcccccgtggtctggagccacaatgggaggcccgtgcaggagggcgagggcctagagctccatgccgagggcccccgccgagtcctctgcatccaggctgcaggcccagcccatgcagggctctacacctgccagtctggagcagcccccggagccccaagcctcagcttcaccgtccaggtggctgagccccctgtgcgggtggtagctcccgaggcagcccagacgagggttcggagcaccccaggcggggacctagagctggtggtgcacctctccgggccagggggccctgtacgctggtacaaggacggggagcgactggcaagccaggggcgggtgcagctggagcaggccggggccaggcaggtgctgcgggtgcagggggcacggagcggggacgctggggagtacctgtgcgatgcgccccaggacagccgcatcttccttgtcagcgtggaagagccactgctggtgaagctggtctcggagctgacaccactcactgtccacgagggcgatgatgccacgttccggtgtgaagtctccccaccagatgccgatgtcacctggctgcgcaatggggccgtcgtcactccagggccccagagacagagctgctgttcctacggcggttgcaggatgtgcgggcagaggaaggccaggatgtgtgtctcgaagtggagacaggccgagtgggtgcagcgggggccgtgcgctgggtgcgaggtgggcagcccctgccccacgactctcgcctgtccatggcccaggatgggcacatccaccgcctcttcatccatggtgtcatactggccgaccagggcacctacggctgcgagagccaccacgatcgcaccctggccaggctcagcgtgaggccgaggcagctgagggtgctgcggcctctggaggacgtgaccatcagtgaggggggcagtgccaccttccagctggagctgtcccaggaaggtgtgaccggggagtgggcccggggtggagtacagctgtatccaggacccaagtgtcacatccactcggacggccaccgtcaccgactggtactcaatggcctgggcctggccgactcaggctgtgtctccttcacagcggattccctgcgctgcgcagccagactcattgtgagagaggtcccagtgaccatcgtgcgggggccacacgacctagaggtgaccgagggcgacacagctacgttcgagtgcgagctttcccaagctttggctgatgttacctgggagaaggacgggaacgcgcttacgcctagcccgcggctccggctccaggccctcggcacgcgccgccttctccagctgcgacgctgcggcccctcggacgccgggacctacagctgcgcggtggggacggcccgcgccggaccggtccgcctgaccgtgcgcgagcgtactgtggcggtactctccgagctgcggtcggtgagcgcccgcgaaggcgacggcgctacgttcgagtgcaccgtgtcggaggtcgagaccacggggcgctgggagctcggaggccgcccgctgagacccggagcccgcgtccgcatccgacaggaagggaagaaacacattctggtgcttagcgagctgcgcgccgaggacgccggtgaagtccgcttccaggcggggcccgcccagtccctggctctactggaagtggaggcattgcctctccagatgtgccgccacccccctcgcgagaagaccgttctggtgggccgccgggcggtgctggaggtgactgtgtcccgctcggggggccacgtgtgctggctgcgggagggggccgagctgtgcccgggagataagtatgagatgcgcagccacggccccacccacagcctggtcatccatgacgttcgacctgaggaccaaggcacttactgctgccaggccggccaggacagcacccacacacggctgctggtagagggcaactaggagaacctaaccaggccaggcgggtgcccttggacagcttggaaggcgtttgcccttaccctgggcaggggtagagagacaaggaacaataaaagtgctacagctc

SEQ ID NO: 21016 - DNA, 3297 bp, Homo sapiens
ctccgcacccccccctgcccccccaccgttcgccgctgcaggcggtcggccgccgcgatgaaggcgagctcgggggatcaggggagccccccgtgcttcctgcgcttcccgcggcctgtgcgggtggtaagtggcgccgaggccgagctcaagtgcgtggtcctgggggagccgccgcctgtagtggtgtgggagaagggcgggcagcagctggcggcctcggaacgcctgagcttcccggcggacggcgcggagcacggcctgctgctgaccgccgcactgcccaccgacgcgggggtctacgtgtgccgcgcccgcaacgcggccggcgaggcctacgcggcggccgccgtcaccgtgctggagccgccggcctccgaccccgagctgcagcccgccgagcgcccgctgccatcgccggggtccggggagggcgccccggtcttcctcacggggcctcgatcccagtgggtgctgcggggggcggaggtggtgctgacgtgccgggcggggggcctccccgagcccacactgtactgggagaaggacgggatggccctggacgaagtgtgggacagcagccacttcgcgctccagccgggccgcgccgaggacggccccggcgcgagcctggcactgcgcatcctggcggctcggctgccggattccggcgtctacgtgtgccacgcccgcaacgcgcacggccacgcgcaggcgggggcgctgctccaggtgcaccagccccccgagagcccgcccgcggaccccgacgaggcccccgcgccggtggtggagccgctcaagtgcgcgcctaagaccttctgggtgaacgagggcaagcacgccaagttccgctgctacgtgatgggcaagcccgagcccgagatcgaatggcactgggagggccgcccgctgctcccggaccgccgccgcctcatgtaccgcgaccgcgacggcggcttcgtgctcaaggtgctttactgccaggccaaggatcgtgggctctacgtctgcgccgcgcgcaactcggcgggccagacgctcagtgccgtgcagctgcacgtgaaagagccccgcctccggttcacacggcccctgcaggacgtggagggccgtgagcacgggattgccgtgctggaatgtaaagtacccaactcccgcatccccacggcctggttccgtgaggaccagcggctgctgccctgccgcaagtacgagcagatcgaagagggcactgtccggcgcctcatcatccacaggctgaaggcagacgatgatggtatctacctgtgcgagatgcggggccgggtgcgcaccgtggccaacgtcacagtcaaagggcccatcctgaagcgcctgccccggaagctcgacgtcctggaaggagagaatgctgtgctgctagtggaaactctagaggccggggtcgagggacgctggagccgtgatggggaggagctgccggtcatctgccagagcagctcaggccacatgcatgccctggtccttccaggggtcacccgagaggatgctggcgaggtcacctttagcctgggcaactcccgtaccactacgcttctcagagtaaaatgtgtcaagcacagtcccccaggaccccccatattggcagagatgttcaagggccacaagaacacggtcctgttgacctggaagcctcccgagccagctcccgagaccccattcatctaccggctggagcggcaggaagtgggctctgaagactggattcagtgcttcagcatcgagaaagccggagccgtggaggtgccgggcgactgtgtgccctccgagggtgactaccgcttccgcatctgcacagtcagcggacatggccgtagtccccacgtggtgttccacggttctgctcaccttgtgcccacagctcgcctggtggcaggtctggaggatgtgcaggtatacgacggggaagatgccgtcttctccctcgatctctccaccatcatccagggtacctggttccttaatggggaagagctcaagagtaacgagccggagggccaggtggaacctggggccctgcggtaccgtatagagcagaagggtctgcagcacagactcatcctgcatgccgtcaagcaccaggacagcggtgccctggtcggcttcagctgccccggcgtgcaggactcagctgccctcacaatccaagagagcccggtgcacatcctgagcccccaggacagggtgtcgttgaccttcacaacctcagagcgggtggtgctgacttgtgagctctcaagggtggacttcccggcaacctggtacaaggatgggcagaaggtggaggagagcgagttgctggtggtgaagatggatgggcgcaaacaccgtctgatcctgcctgaggccaaagtccaggacagtggcgagtttgagtgcaggacagaaggggtctcggccttcttcggcgtcactgtccaagatcctcccgtgcacatcgtggacccccgagaacatgtgttcgtgcatgccataacttccgagtgtgtcatgctggcctgtgaggtggaccgagaggacgcccctgtgcgttggtacaaggacgggcaggaggtggaggagagtgacttcgtggtgctggagaatgaggggccccatcgccgcctggtgctgcccgccacccagccctcagacgggggcgagtttcagtgcgtcgctggagatgagtgtgcctacttcactgtcaccatcacagacgtctcctcgtggatcgtgtatcccagcggcaaggtgtatgtggcagccgtgcgcctggagcgtgtggtgctgacctgtgagctatgccggccctgggcagaggtgcgctggaccaaggatggagaggaggtggtggagagccccgcgctgctcctgcagaaggaagacactgtccgccgcctggtgctgcccgctgtccagctcgaggactccggcgagtacttgtgtgaaattgacgatgagtcggcctccttcactgtcaccgtcacagagtcttaccaaagtcaggacagttcaaataacaatccggagttatgcgtcctcttgaaaaagccgaagacccggcggctctggtcccgcttccccccatggcgacgaacagctggcactgagtagcagctgcccccatagtttggggcccacattcctctgtcccacctccctgccattgctttttgcctctccccagactgcttcagccgctaacctaacctggcccctgtgggcatttgagtttgcgacccctgtgttaaaccaataaacatgcaaataaatgta

SEQ ID NO: 21017 - DNA, 5841 bp, Homo sapiens
ctccgcacccccccctgcccccccaccgttcgccgctgcaggcggtcggccgccgcgatgaaggcgagctcgggggatcaggggagccccccgtgcttcctgcgcttcccgcggcctgtgcgggtggtaagtggcgccgaggccgagctcaagtgcgtggtcctgggggagccgccgcctgtagtggtgtgggagaagggcgggcagcagctggcggcctcggaacgcctgagcttcccggcggacggcgcggagcacggcctgctgctgaccgccgcactgcccaccgacgcgggggtctacgtgtgccgcgcccgcaacgcggccggcgaggcctacgcggcggccgccgtcaccgtgctggagccgccggcctccgaccccgagctgcagcccgccgagcgcccgctgccatcgccggggtccggggagggcgccccggtcttcctcacggggcctcgatcccagtgggtgctgcggggggcggaggtggtgctgacgtgccgggcggggggcctccccgagcccacactgtactgggagaaggacgggatggccctggacgaagtgtgggacagcagccacttcgcgctccagccgggccgcgccgaggacggccccggcgcgagcctggcactgcgcatcctggcggctcggctgccggattccggcgtctacgtgtgccacgcccgcaacgcgcacggccacgcgcaggcgggggcgctgctccaggtgcaccagccccccgagagcccgcccgcggaccccgacgaggcccccgcgccggtggtggagccgctcaagtgcgcgcctaagaccttctgggtgaacgagggcaagcacgccaagttccgctgctacgtgatgggcaagcccgagcccgagatcgaatggcactgggagggccgcccgctgctcccggaccgccgccgcctcatgtaccgcgaccgcgacggcggcttcgtgctcaaggtgctttactgccaggccaaggatcgtgggctctacgtctgcgccgcgcgcaactcggcgggccagacgctcagtgccgtgcagctgcacgtgaaagagccccgcctccggttcacacggcccctgcaggacgtggagggccgtgagcacgggattgccgtgctggaatgtaaagtacccaactcccgcatccccacggcctggttccgtgaggaccagcggctgctgccctgccgcaagtacgagcagatcgaagagggcactgtccggcgcctcatcatccacaggctgaaggcagacgatgatggtatctacctgtgcgagatgcggggccgggtgcgcaccgtggccaacgtcacagtcaaagggcccatcctgaagcgcctgccccggaagctcgacgtcctggaaggagagaatgctgtgctgctagtggaaactctagaggccggggtcgagggacgctggagccgtgatggggaggagctgccggtcatctgccagagcagctcaggccacatgcatgccctggtccttccaggggtcacccgagaggatgctggcgaggtcacctttagcctgggcaactcccgtaccactacgcttctcagagtaaaatgtgtcaagcacagtcccccaggaccccccatattggcagagatgttcaagggccacaagaacacggtcctgttgacctggaagcctcccgagccagctcccgagaccccattcatctaccggctggagcggcaggaagtgggctctgaagactggattcagtgcttcagcatcgagaaagccggagccgtggaggtgccgggcgactgtgtgccctccgagggtgactaccgcttccgcatctgcacagtcagcggacatggccgtagtccccacgtggtgttccacggttctgctcaccttgtgcccacagctcgcctggtggcaggtctggaggatgtgcaggtatacgacggggaagatgccgtcttctccctcgatctctccaccatcatccagggtacctggttccttaatggggaagagctcaagagtaacgagccggagggccaggtggaacctggggccctgcggtaccgtatagagcagaagggtctgcagcacagactcatcctgcatgccgtcaagcaccaggacagcggtgccctggtcggcttcagctgccccggcgtgcaggactcagctgccctcacaatccaagagagcccggtgcacatcctgagcccccaggacagggtgtcgttgaccttcacaacctcagagcgggtggtgctgacttgtgagctctcaagggtggacttcccggcaacctggtacaaggatgggcagaaggtggaggagagcgagttgctggtggtgaagatggatgggcgcaaacaccgtctgatcctgcctgaggccaaagtccaggacagtggcgagtttgagtgcaggacagaaggggtctcggccttcttcggcgtcactgtccaagatcctcccgtgcacatcgtggacccccgagaacatgtgttcgtgcatgccataacttccgagtgtgtcatgctggcctgtgaggtggaccgagaggacgcccctgtgcgttggtacaaggacgggcaggaggtggaggagagtgacttcgtggtgctggagaatgaggggccccatcgccgcctggtgctgcccgccacccagccctcagacgggggcgagtttcagtgcgtcgctggagatgagtgtgcctacttcactgtcaccatcacagacgtctcctcgtggatcgtgtatcccagcggcaaggtgtatgtggcagccgtgcgcctggagcgtgtggtgctgacctgtgagctatgccggccctgggcagaggtgcgctggaccaaggatggagaggaggtggtggagagccccgcgctgctcctgcagaaggaagacactgtccgccgcctggtgctgcccgctgtccagctcgaggactccggcgagtacttgtgtgaaattgacgatgagtcggcctccttcactgtcaccgtcacagaacccccagtgcggatcatataccctcgcgatgaggtgaccttgatcgccgtgaccttggagtgtgtggtgctgatgtgtgaactgtctcgggaggatgcccctgtgcgctggtacaaggatgggctggaagtggaggagagcgaggccctggtgctggagagggatgggccacgctgccgcctggtgctacctgctgctcagcccgaggacgggggcgagtttgtatgtgatgctggagatgactcggccttcttcactgtcactgtcacagccccaccagagaggattgtgcacccggcagcccgctccctggatctgcattttggggctccagggcgcgtggagctgcgctgtgaggtggccccagctgggtctcaggtgcgctggtacaaggacgggctggaagtggaggcatcagatgccctgcagctgggtgccgaggggcccacccgcaccctgaccctgccccacgcccagcctgaggacgccggggagtatgtgtgtgagacccggcatgaggccatcaccttcaatgtcatcctggctgagcctccagtgcagttccttgctctagagacaactccaagcccgctctgtgtggcccctggggagccagtggtgctgagctgtgaactgtcccgggctggcgcccccgtggtctggagccacaatgggaggcccgtgcaggagggcgagggcctagagctccatgccgagggcccccgccgagtcctctgcatccaggctgcaggcccagcccatgcagggctctacacctgccagtctggagcagcccccggagccccaagcctcagcttcaccgtccaggtggctgagccccctgtgcgggtggtagctcccgaggcagcccagacgagggttcggagcaccccaggcggggacctagagctggtggtgcacctctccgggccagggggccctgtacgctggtacaaggacggggagcgactggcaagccaggggcgggtgcagctggagcaggccggggccaggcaggtgctgcgggtgcagggggcacggagcggggacgctggggagtacctgtgcgatgcgccccaggacagccgcatcttccttgtcagcgtggaagagccactgctggtgaagctggtctcggagctgacaccactcactgtccacgagggcgatgatgccacgttccggtgtgaagtctccccaccagatgccgatgtcacctggctgcgcaatggggccgtcgtcactccagggccccaggtggagatggcccagaatggttcaagccgcatcttaaccttgcgaggctgccaactgggggatgcagggaccgtgactttgcgggcagggagcacggccacaagtgcccggctccatgttcgagagacagagctgctgttcctacggcggttgcaggatgtgcgggcagaggaaggccaggatgtgtgtctcgaagtggagacaggccgagtgggtgcagcgggggccgtgcgctgggtgcgaggtgggcagcccctgccccacgactctcgcctgtccatggcccaggatgggcacatccaccgcctcttcatccatggtgtcatactggccgaccagggcacctacggctgcgagagccaccacgatcgcaccctggccaggctcagcgtgaggccgaggcagctgagggtgctgcggcctctggaggacgtgaccatcagtgaggggggcagtgccaccttccagctggagctgtcccaggaaggtgtgaccggggagtgggcccggggtggagtacagctgtatccaggacccaagtgtcacatccactcggacggccaccgtcaccgactggtactcaatggcctgggcctggccgactcaggctgtgtctccttcacagcggattccctgcgctgcgcagccagactcattgtgagagaggtcccagtgaccatcgtgcgggggccacacgacctagaggtgaccgagggcgacacagctacgttcgagtgcgagctttcccaagctttggctgatgttacctgggagaaggacgggaacgcgcttacgcctagcccgcggctccggctccaggccctcggcacgcgccgccttctccagctgcgacgctgcggcccctcggacgccgggacctacagctgcgcggtggggacggcccgcgccggaccggtccgcctgaccgtgcgcgagcgtactgtggcggtactctccgagctgcggtcggtgagcgcccgcgaaggcgacggcgctacgttcgagtgcaccgtgtcggaggtcgagaccacggggcgctgggagctcggaggccgcccgctgagacccggagcccgcgtccgcatccgacaggaagggaagaaacacattctggtgcttagcgagctgcgcgccgaggacgccggtgaagtccgcttccaggcggggcccgcccagtccctggctctactggaagtggaggcattgcctctccagatgtgccgccacccccctcgcgagaagaccgttctggtgggccgccgggcggtgctggaggtgactgtgtcccgctcggggggccacgtgtgctggctgcgggagggggccgagctgtgcccgggagataagtatgagatgcgcagccacggccccacccacagcctggtcatccatgacgttcgacctgaggaccaaggcacttactgctgccaggccggccaggacagcacccacacacggctgctggtagagggcaactaggagaacctaaccaggccaggcgggtgcccttggacagcttggaaggcgtttgcccttaccctgggcaggggtagagagacaaggaacaataaa

SEQ ID NO: 21018 - DNA, 5138 bp, Homo sapiens
tctcagctcccagctccccgctcccggctcccggcgcccggcgcccggcgcggagctgttcctcaaacgacacgcagccgaggtgggtgggtgtggggacgcgggagccagtgtcgtcggatcggcccgcagtccgctgtcctgctgagcccggaggccgcctggatggagccgccgctcccggtcggagcccagccgcttgccactgtcgagggtatggagatgaagggtcctctccgggagccctgcgccctgaccctagcccagaggaacgggcaatatgagttaataatccagttgcatgagaaggaacagcatgttcaagatatcattcctataaatagccacttcagatgtgttcaagaagcagaagaaactcttttgattgacatagcttctaacagtggctgcaaaattcgggttcagggggactggatcagagagcgccgctttgaaatccctgatgaggaacactgtttgaagttcctctcagctgtccttgctgctcagaaagctcagtcacagcttcttgttccagagcaaaaggactcatctagctggtaccagaaattagacactaaggacaaaccttctgttttttcagggcttcttggatttgaagacaatttttcttctatgaatttggacaagaaaataaattcacaaaatcagcctactgggattcatcgggaacccccacctccacccttttcagtgaataaaatgcttccacgtgaaaaagaagcttctaacaaggagcagcccaaagtgaccaacaccatgcggaagctctttgtaccaaatacccaatctgggcagcgggagggtctcatcaaacatatcctggcaaagcgagagaaagaatatgtcaacattcagactttcagattttttgttggaacttggaatgtgaatggccagtctccagatagcgggttagaaccttggctgaactgtgatcccaatcctcctgatatctactgcattggattccaagaactggacttgagcacagaagccttcttctactttgaatctgtgaaggaacaagaatggtccatggctgtagagagaggtttgcattccaaagccaagtataagaaagttcaactggtgcgccttgttgggatgatgcttcttatatttgccagaaaggatcagtgtcgatacattcgtgatattgctacagaaacagttggaactggaatcatggggaaaatgggaaacaaaggtggggtagctgtgagatttgtatttcacaacaccaccttttgcattgtcaattcccatctggctgcacacgtggaggactttgagagaaggaatcaagattataaggacatttgtgcgagaatgagttttgtggtcccaaatcagaccctcccgcagttgaacatcatgaaacatgaggttgtcatttggttgggagatttgaattatagactttgcatgcctgatgccaatgaggtgaaaagtcttattaataagaaagaccttcagagactcttgaaattcgaccagctaaatattcagcgcacacagaaaaaagcttttgttgacttcaatgaaggggaaatcaagttcatccccacttataagtatgactctaaaacagaccggtgggattccagtgggaaatgccgggttccagcctggtgtgaccgaattctttggagaggaacaaatgttaatcagcttaattatcggagtcacatggaactgaaaaccagcgaccacaagcctgttagcgccctcttccatattggggtgaaggttgtggatgaacgaaggtaccggaaagtctttgaagatagtgtacgcatcatggacagaatggaaaatgacttccttccttccttagaactcagcaggagggagtttgtgtttgaaaatgtgaagtttcggcaactacaaaaggagaagttccagatcagcaacaatggacaggttccctgccatttttctttcatccctaaacttaatgacagccagtactgcaagccatggcttcgggctgaaccttttgagggctacttggagccaaatgagacagtggacatttctcttgatgtgtatgtcagcaaagactctgtaaccatcctgaactcgggagaagataagattgaagatattctcgtccttcacctggatcgaggcaaagattacttcttgactatcagtggaaattacctcccaagttgttttggcacatccttagaggctctgtgccgtatgaaaagaccaatccgagaagttcctgttaccaaactcatagacttggagaaatcccttctgcaaatggttcctttggatgaaggtgccagtgagagaccccttcaggttcccaaggagatctggcttctagtagatcacctattcaaatacgcctgtcaccaggaggacctgttccagacccctggaatgcaggaagagctccagcagatcattgattgtctggataccagcattcctgagacaatccctggcagcaaccactctgtggctgaagcactgctcattttcttggaagccctgccagagccagtcatctgttacgagctgtatcagcgatgtcttgactctgcttatgatccccggatctgccgacaggtgatctcccagcttccgagatgccatagaaatgttttccgttacttgatggcattccttcgagaactcttaaaattctctgaatacaatagcgtcaatgccaacatgatcgctactctcttcactagtcttctcctgaggcctccacccaaccttatggcaagacagactccaagtgaccgccagcgtgctattcagttccttctgggctttctgcttgggagcgaagaagactaaggcttttactgttctctgatattctagaagcagacgatctcgggctccaagtatttcagaatgatttaaaaagtcatgccacaggaagggtctattgcagaatttcaagttctgtttatagtaaaaaggaagagcgtttcctaatccctcctttaccatatcctacacagaaaaatacttttagacttatattgccaagccaaagttaccatattttggtgtttttgtgttttctctttataaggcaaaaagatctgtatttacactccttcacctagggatgtgtttgttgccctcctacccaattgtcatgattgtccttagtaccctaggcctagattctgagatcttcccattctaggcctacaagcactacttgctgtagctgagacttgtctagagtcctttgttttgcacttttgacccaccccttcctggatcactcctttgcactccactcccctcgttctgtcactttgaacgaagtctgagtgaggctagtgactccttgggtgtcctcaacagtgaattcactgtctgcgtgcagttattacatgcatttgtgcatttctactacaatggcatctttatgtctctgtaacattggccttttcatggctccacactgggtggaaccatattctcttagatcacatttagtagcataactgtagggactattagagatggcatctcatcgatgagagagaatcacaatcagaatggaagcactttgagtatctgaagagtgagagcattcatgtttgacaggtcctgcttcccactatccttttcctgttattattcaaattttacacaaggactaatcctgggtgtctctgagacccatctcctgcctagacatccacctccagagcaacactggccccacagtaaaagaggaagtcttgtacctcaggcaggcccatctagagctattgctccttcccacagcaaaggtattgtggatgacccttagaatccattctctggtcttctgaaataccaagggcagatgtcacctccttcctcagcaggactgactctgggctctacaaccagctccttcacataaagggtttagagactccccttggctcccagtcaccatatccagtgttgtgtaaagagactggccaacaggaccaaccaagcaccttacctctcccatacaagatgaccctctgagcttttcatttattcaagctctgtggtacagcctttttttaaaataaattaatctatattggttgacaaacaagccaccaaccactgactgcaaaactgcctgatgcagttgggttcctcctggttttcttttgttacaaccacccttgcctgtttacattaattgcaaggagcataacgtacaggctgtatgtacaatcctgggcattgactctgtgacatttctagcatatccaaggcaccaccagtgatttctcctgtttcttggtgggggtgggggggaaggtacgtattctgcaatatggctaaaccctttcctgattgagagttaaagcaataggagtcaagttactggtgccacagatctggaggtatgataggtcaggggctaggtgttgaacttagttaatggaagactgagagcagaacaggtttgtcatctccgcaaggccagaaagtgatcacaaaaagaggcagatgatagacactggggtagggtcataccacagggaaatacctttcctgggcttgttttctagcatatcactgacctgggatctttgggtgatcaagggtgtggttagtggaggctctgtgctgcacgtatgcagtatcctatctctttctacatcagatcaaaacactaagttggtgtactgcctcgaccttttttcagctcatcctggaacatatacagagttgagagttttagacaatctctaggtagaggagacaagatgtagacccagacagaagaaatctgcttccctaccatggctattccagcaccccaacctgtaattgccaagtcctctaaggtactaatttgtagctgctctgaagtaaggatttcggattcagctggtagggaaagactctgcacctgctgtcttagggaagaaatggttcaaatccatgtggtgacattgcattagtctccctttcactgttttcttattctgtaattgtttgttatatttcccaaaaacgtcttgatcactaagcaaagctgctagtgggattctatatttcgtgtcatcttttttattataatttattgcaaatttttttctgaataaatatatgttgtgtgaaaaagcaaa

SEQ ID NO: 21019 - DNA, 5162 bp, Homo sapiens
tctcagctcccagctccccgctcccggctcccggcgcccggcgcccggcgcggagctgttcctcaaacgacacgcagccgaggtgggtgggtgtggggacgcgggagccagtgtcgtcggatcggcccgcagtccgctgtcctgctgagcccggaggccgcctggatggagccgccgctcccggtcggagcccagccgcttgccactgtcgagggtatggagatgaagggtcctctccgggagccctgcgccctgaccctagcccagaggaacgggcaatatgagttaataatccagttgcatgagaaggaacagcatgttcaagatatcattcctataaatagccacttcagatgtgttcaagaagcagaagaaactcttttgattgacatagcttctaacagtggctgcaaaattcgggttcagggggactggatcagagagcgccgctttgaaatccctgatgaggaacactgtttgaagttcctctcagctgtccttgctgctcagaaagctcagtcacagcttcttgttccagagcaaaaggactcatctagctggtaccagaaattagacactaaggacaaaccttctgttttttcagggcttcttggatttgaagacaatttttcttctatgaatttggacaagaaaataaattcacaaaatcagcctactgggattcatcgggaacccccacctccacccttttcagtgaataaaatgcttccacgtgaaaaagaagcttctaacaaggagcagcccaaagtgaccaacaccatgcggaagctctttgtaccaaatacccaatctgggcagcgggagggtctcatcaaacatatcctggcaaagcgagagaaagaatatgtcaacattcagactttcagattttttgttggaacttggaatgtgaatggccagtctccagatagcgggttagaaccttggctgaactgtgatcccaatcctcctgatatctactgcattggattccaagaactggacttgagcacagaagccttcttctactttgaatctgtgaaggaacaagaatggtccatggctgtagagagaggtttgcattccaaagccaagtataagaaagttcaactggtgcgccttgttgggatgatgcttcttatatttgccagaaaggatcagtgtcgatacattcgtgatattgctacagaaacagttggaactggaatcatggggaaaatgggaaacaaaggtggggtagctgtgagatttgtatttcacaacaccaccttttgcattgtcaattcccatctggctgcacacgtggaggactttgagagaaggaatcaagattataaggacatttgtgcgagaatgagttttgtggtcccaaatcagaccctcccgcagttgaacatcatgaaacatgaggttgtcatttggttgggagatttgaattatagactttgcatgcctgatgccaatgaggtgaaaagtcttattaataagaaagaccttcagagactcttgaaattcgaccagctaaatattcagcgcacacagaaaaaagcttttgttgacttcaatgaaggggaaatcaagttcatccccacttataagtatgactctaaaacagaccggtgggattccagtgggaaatgccgggttccagcctggtgtgaccgaattctttggagaggaacaaatgttaatcagcttaattatcggagtcacatggaactgaaaaccagcgaccacaagcctgttagcgccctcttccatattggggtgaaggttgtggatgaacgaaggtaccggaaagtctttgaagatagtgtacgcatcatggacagaatggaaaatgacttccttccttccttagaactcagcaggagggagtttgtgtttgaaaatgtgaagtttcggcaactacaaaaggagaagttccagatcagcaacaatggacaggttccctgccatttttctttcatccctaaacttaatgacagccagtactgcaagccatggcttcgggctgaaccttttgagggctacttggagccaaatgagacagtggacatttctcttgatgtgtatgtcagcaaagactctgtaaccatcctgaactcgggagaagataagattgaagatattctcgtccttcacctggatcgaggcaaagattacttcttgactatcagtggaaattacctcccaagttgttttggcacatccttagaggctctgtgccgtatgaaaagaccaatccgagaagttcctgttaccaaactcatagacttggaagaagacagcttcctagaaaaggagaaatcccttctgcaaatggttcctttggatgaaggtgccagtgagagaccccttcaggttcccaaggagatctggcttctagtagatcacctattcaaatacgcctgtcaccaggaggacctgttccagacccctggaatgcaggaagagctccagcagatcattgattgtctggataccagcattcctgagacaatccctggcagcaaccactctgtggctgaagcactgctcattttcttggaagccctgccagagccagtcatctgttacgagctgtatcagcgatgtcttgactctgcttatgatccccggatctgccgacaggtgatctcccagcttccgagatgccatagaaatgttttccgttacttgatggcattccttcgagaactcttaaaattctctgaatacaatagcgtcaatgccaacatgatcgctactctcttcactagtcttctcctgaggcctccacccaaccttatggcaagacagactccaagtgaccgccagcgtgctattcagttccttctgggctttctgcttgggagcgaagaagactaaggcttttactgttctctgatattctagaagcagacgatctcgggctccaagtatttcagaatgatttaaaaagtcatgccacaggaagggtctattgcagaatttcaagttctgtttatagtaaaaaggaagagcgtttcctaatccctcctttaccatatcctacacagaaaaatacttttagacttatattgccaagccaaagttaccatattttggtgtttttgtgttttctctttataaggcaaaaagatctgtatttacactccttcacctagggatgtgtttgttgccctcctacccaattgtcatgattgtccttagtaccctaggcctagattctgagatcttcccattctaggcctacaagcactacttgctgtagctgagacttgtctagagtcctttgttttgcacttttgacccaccccttcctggatcactcctttgcactccactcccctcgttctgtcactttgaacgaagtctgagtgaggctagtgactccttgggtgtcctcaacagtgaattcactgtctgcgtgcagttattacatgcatttgtgcatttctactacaatggcatctttatgtctctgtaacattggccttttcatggctccacactgggtggaaccatattctcttagatcacatttagtagcataactgtagggactattagagatggcatctcatcgatgagagagaatcacaatcagaatggaagcactttgagtatctgaagagtgagagcattcatgtttgacaggtcctgcttcccactatccttttcctgttattattcaaattttacacaaggactaatcctgggtgtctctgagacccatctcctgcctagacatccacctccagagcaacactggccccacagtaaaagaggaagtcttgtacctcaggcaggcccatctagagctattgctccttcccacagcaaaggtattgtggatgacccttagaatccattctctggtcttctgaaataccaagggcagatgtcacctccttcctcagcaggactgactctgggctctacaaccagctccttcacataaagggtttagagactccccttggctcccagtcaccatatccagtgttgtgtaaagagactggccaacaggaccaaccaagcaccttacctctcccatacaagatgaccctctgagcttttcatttattcaagctctgtggtacagcctttttttaaaataaattaatctatattggttgacaaacaagccaccaaccactgactgcaaaactgcctgatgcagttgggttcctcctggttttcttttgttacaaccacccttgcctgtttacattaattgcaaggagcataacgtacaggctgtatgtacaatcctgggcattgactctgtgacatttctagcatatccaaggcaccaccagtgatttctcctgtttcttggtgggggtgggggggaaggtacgtattctgcaatatggctaaaccctttcctgattgagagttaaagcaataggagtcaagttactggtgccacagatctggaggtatgataggtcaggggctaggtgttgaacttagttaatggaagactgagagcagaacaggtttgtcatctccgcaaggccagaaagtgatcacaaaaagaggcagatgatagacactggggtagggtcataccacagggaaatacctttcctgggcttgttttctagcatatcactgacctgggatctttgggtgatcaagggtgtggttagtggaggctctgtgctgcacgtatgcagtatcctatctctttctacatcagatcaaaacactaagttggtgtactgcctcgaccttttttcagctcatcctggaacatatacagagttgagagttttagacaatctctaggtagaggagacaagatgtagacccagacagaagaaatctgcttccctaccatggctattccagcaccccaacctgtaattgccaagtcctctaaggtactaatttgtagctgctctgaagtaaggatttcggattcagctggtagggaaagactctgcacctgctgtcttagggaagaaatggttcaaatccatgtggtgacattgcattagtctccctttcactgttttcttattctgtaattgtttgttatatttcccaaaaacgtcttgatcactaagcaaagctgctagtgggattctatatttcgtgtcatcttttttattataatttattgcaaatttttttctgaataaatatatgttgtgtgaaaaagcaaa

SEQ ID NO: 21020 - DNA, 3068 bp, Homo sapiens
cttacttcgaaggctgtgctccgctcaccatccagagcggaggtgcggaccttaaactcactcctggagaaagatctgcaagtgcgcagagagaagactggcagtggagcatgcatctggagggcagagacggcaggcggtaccccggcgcgccggcggtggagctcctgcagacgtccgtgcccagcggactcgctgaacttgtggccggcaagcgcaggcttcctcggggagccggtggagctgacccctcgcactcctgccccaggggggctgccgggcagagctcttgggctcctgcaggccaggagtttgcttcattcctcacaaaagggaggtctcactcttctttgccccagatgtccagctccaggtctaaagattcctgctttacagaaaacactcctttgctgaggaattccttacaggagaaagggtcacggtgcatacctgtttaccatccagagttcatcactgctgaagagtcttgggaagacagctctgctgactgggagcgaagatacctgctaagcagggaggtgtctggtctgtctgcatctgcctcctccgagaagggagaccttctggacagcccgcacatccgactccgtctttccaagctgaggcgctgtgtgcagtggctgaaagtcatgggcctgtttgcctttgtggtgctgtgttctattttgttcagcctatatccggatcaaggaaagctctggcagctgttggccttatcaccgctggagaactactccgtgaaccttagcagccacgtggactccacgctgctgcaggtggacctggcaggggccctagtggccagtgggccgagtcgtcctgggagggaagagcacatcgtggtggagctgacccaggctgacgctttgggctccaggtggcggcggccacagcaggtcactcacaactggacggtgtatttaaatccgaggagaagcgagcactcagtgatgagcaggacctttgaggtactgaccagagagacggtgtccatcagcatccgggcctccctgcagcagacccaggctgtccctcttttgatggctcatcagtacctccgcggaagtgtagaaacccaggtgaccatcgcgacggccatcctcgcgggcgtctacgcgctgatcatatttgagagacccagcctgacccatgtggtggagtggattgattttgagacgctggccctgctgtttggcatgatgatcttagtagccatattttcagaaacgggatttttcgattattgtgctgtaaaggcataccggctctcccggggacgggtgtgggccatgatcatcatgctctgtctcatcgcggccgtcctctctgccttcttggacaacgtcaccaccatgctcctcttcacgcctgtgaccataaggttgtgtgaggtgctcaaccttgatccaagacaagtcctgattgcagaagtgatcttcacaaacattggaggagctgccactgccatcggggaccctccaaatgtcattattgtttccaaccaagagctgaggaagatgggcctggactttgccggattcactgcacacatgttcattgggatttgccttgttctcctggtctgctttccgctcctcagactcctttactggaacagaaagctttataacaaggaacccagtgagattgttgaactgaagcacgagattcacgtctggcgcctgactgctcagcgcatcagcccggccagccgcgaggagacagctgtgcgccgcctgctgctggggaaggtgctggcactggagcacctgctcgcccggaggctgcacaccttccacagacagatctcacaggaggacaaaaattgggagaccaatatccaagaactccaaaaaaagcataggatatctgacgggattctgctcgccaaatgcctgacagtgttgggatttgttatcttcatgtttttcctcaattcgtttgtccctggcattcatcttgatcttggatggattgctattctgggtgccatctggttgctaattttagctgatattcatgattttgagataattctacacagagtggaatgggcaacccttctgttttttgcagcgctctttgttctgatggaggcattggcacatctccacttaatagaatatgttggagaacaaactgctttgctaataaagatggtcccagaggagcagcgcctcatagccgccattgtcctggtggtgtgggtctcagccctggcgtcgtccctgattgacaacatcccgttcactgctaccatgattcccgtgctcctgaacctgagccacgaccctgaggttggcctgcccgcaccgccgctcatgtatgccctggccttcggtgcttgcctgggaggtaacgggacactgattggcgcgtcggcaaacgtcgtgtgtgcagggattgcagaacagcatggatatgggttctccttcatggaatttttcaggctgggcttcccaatgatggttgtgtcctgcactgttgggatgtgttatctccttgtggctcatgtggtggtgggatggaattaatagacatccatctattgctcgaagactaaaggaaacttcatccatcacaacccattagtcataaaactaccctgaccccactgtttgaagaagaaaaggtgcttaccctggagatgctacagagacacagtggaatagaccttgacactaacactctaattcaagcgaatgttggaacaccatgacctcctctgtgtgtcctttctccccaaggacaaaatgtagaaagatgtgagataacttactcaagattcccctccagaaaaatacgtatgtttaaaaacccttcctgctatacataggaaaagacacacatccacctaaaattgactgtactgtttaactgtcaattctcctgaggctaaacacagtttgtttttcttgtaatcacttttcatgttaaaataatcagcattcaaattgtatgctttctgaatatagactttctgggaaaaggtttactgctcgtaaggaaacattttatgtattaaaataaactgttccttgataaaa

SEQ ID NO: 21021 - DNA, 3186 bp, Homo sapiens
cctgggtgggggacccgctgcgggagcgccgagctccctctgagttcttacttcgaaggctgtgctccgctcaccatccagagcggaggtgcggaccttaaactcactcctggagaaagatctgcaagtgcgcagagagaagactggcagtggagcatgcatctggagggcagagacggcaggcggtaccccggcgcgccggcggtggagctcctgcagacgtccgtgcccagcggactcgctgaacttgtggccggcaagcgcaggcttcctcggggagccggtggagctgacccctcgcactcctgccccaggggggctgccgggcagagctcttgggctcctgcaggccaggagtttgcttcattcctcacaaaagggaggtctcactcttctttgccccagatgtccagctccaggtctaaagattcctgctttacagaaaacactcctttgctgaggaattccttacaggagaaagggtcacggtgcatacctgtttaccatccagagttcatcactgctgaagagtcttgggaagacagctctgctgactgggagcgaagatacctgctaagcagggaggtgtctggtctgtctgcatctgcctcctccgagaagggagaccttctggacagcccgcacatccgactccgtctttccaagctgaggcgctgtgtgcagtggctgaaagtcatgggcctgtttgcctttgtggtgctgtgttctattttgttcagcctatatccggatcaaggaaagctctggcagctgttggccttatcaccgctggagaactactccgtgaaccttagcagccacgtggactccacgctgctgcaggtggacctggcaggggccctagtggccagtgggccgagtcgtcctgggagggaagagcacatcgtggtggagctgacccaggctgacgctttgggctccaggtggcggcggccacagcaggtcactcacaactggacggtgtatttaaatccgaggagaagcgagcactcagtgatgagcaggacctttgaggtactgaccagagagacggtgtccatcagcatccgggcctccctgcagcagacccaggctgtccctcttttgatggctcatcagtacctccgcggaagtgtagaaacccaggtgaccatcgcgacggccatcctcgcgggcgtctacgcgctgatcatatttgagatcgtgcacagaactctggcggccatgctgggttcccttgcagcactggcagcactggctgtgattggcgatagacccagcctgacccatgtggtggagtggattgattttgagacgctggccctgctgtttggcatgatgatcttagtagccatattttcagaaacgggatttttcgattattgtgctgtaaaggcataccggctctcccggggacgggtgtgggccatgatcatcatgctctgtctcatcgcggccgtcctctctgccttcttggacaacgtcaccaccatgctcctcttcacgcctgtgaccataaggttgtgtgaggtgctcaaccttgatccaagacaagtcctgattgcagaagtgatcttcacaaacattggaggagctgccactgccatcggggaccctccaaatgtcattattgtttccaaccaagagctgaggaagatgggcctggactttgccggattcactgcacacatgttcattgggatttgccttgttctcctggtctgctttccgctcctcagactcctttactggaacagaaagctttataacaaggaacccagtgagattgttgaactgaagcacgagattcacgtctggcgcctgactgctcagcgcatcagcccggccagccgcgaggagacagctgtgcgccgcctgctgctggggaaggtgctggcactggagcacctgctcgcccggaggctgcacaccttccacagacagatctcacaggaggacaaaaattgggagaccaatatccaagaactccaaaaaaagcataggatatctgacgggattctgctcgccaaatgcctgacagtgttgggatttgttatcttcatgtttttcctcaattcgtttgtccctggcattcatcttgatcttggatggattgctattctgggtgccatctggttgctaattttagctgatattcatgattttgagataattctacacagagtggaatgggcaacccttctgttttttgcagcgctctttgttctgatggaggcattggcacatctccacttaatagaatatgttggagaacaaactgctttgctaataaagatggtcccagaggagcagcgcctcatagccgccattgtcctggtggtgtgggtctcagccctggcgtcgtccctgattgacaacatcccgttcactgctaccatgattcccgtgctcctgaacctgagccacgaccctgaggttggcctgcccgcaccgccgctcatgtatgccctggccttcggtgcttgcctgggaggtaacgggacactgattggcgcgtcggcaaacgtcgtgtgtgcagggattgcagaacagcatggatatgggttctccttcatggaatttttcaggctgggcttcccaatgatggttgtgtcctgcactgttgggatgtgttatctccttgtggctcatgtggtggtgggatggaattaatagacatccatctattgctcgaagactaaaggaaacttcatccatcacaacccattagtcataaaactaccctgaccccactgtttgaagaagaaaaggtgcttaccctggagatgctacagagacacagtggaatagaccttgacactaacactctaattcaagcgaatgttggaacaccatgacctcctctgtgtgtcctttctccccaaggacaaaatgtagaaagatgtgagataacttactcaagattcccctccagaaaaatacgtatgtttaaaaacccttcctgctatacataggaaaagacacacatccacctaaaattgactgtactgtttaactgtcaattctcctgaggctaaacacagtttgtttttcttgtaatcacttttcatgttaaaataatcagcattcaaattgtatgctttctgaatatagactttctgggaaaaggtttactgctcgtaaggaaacattttatgtattaaaataaactgttccttgataaaa

SEQ ID NO: 21022 - DNA, 2117 bp, Homo sapiens
cttacttcgaaggctgtgctccgctcaccatccagagcggaggtgcggaccttaaactcactcctggagaaagatctgcaagtgcgcagagagaagactggcagtggagcatgcatctggagggcagagacggcaggcggtaccccggcgcgccggcggtggagctcctgcagacgtccgtgcccagcggactcgctgaacttgtggccggcaagcgcaggcttcctcggggagccggtggagctgacccctcgcactcctgccccaggggggctgccgggcagagctcttgggctcctgcaggccaggagtttgcttcattcctcacaaaagggaggtctcactcttctttgccccagatgtccagctccaggtctaaagattcctgctttacagaaaacactcctttgctgaggaattccttacaggagaaagggtcacggtgcatacctgtttaccatccagagttcatcactgctgaagagtcttgggaagacagctctgctgactgggagcgaagatacctgctaagcagggaggtgtctggtctgtctgcatctgcctcctccgagaagggagaccttctggacagcccgcacatccgactccgtctttccaagctgaggcgctgtgtgcagtggctgaaagtcatgggcctgtttgcctttgtggtgctgtgttctattttgttcagcctatatccggatcaaggaaagctctggcagctgttggccttatcaccgctggagaactactccgtgaaccttagcagccacgtggactccacgctgctgcaggtggacctggcaggggccctagtggccagtgggccgagtcgtcctgggagggaagagcacatcgtggtggagctgacccaggctgacgctttgggctccaggtggcggcggccacagcaggtcactcacaactggacggtgtatttaaatccgaggagaagcgagcactcagtgatgagcaggacctttgaggtactgaccagagagacggtgtccatcagcatccgggcctccctgcagcagacccaggctgtccctcttttgatggctcatcagtacctccgcggaagtgtagaaacccaggtgaccatcgcgacggccatcctcgcgggcgtctacgcgctgatcatatttgagatcgtgcacagaactctggcggccatgctgggttcccttgcagcactggcagcactggctgtgattggcgatagacccagcctgacccatgtggtggagtggattgattttgagacgctggccctgctgtttggcatgatgatcttagtagccatattttcagaaacgggatttttcgattattgtgctgtaaaggcataccggctctcccggggacgggtgtgggccatgatcatcatgctctgtctcatcgcggccgtcctctctgccttcttggacaacgtcaccaccatgctcctcttcacgcctgtgaccataaggttgtgtgaggtgctcaaccttgatccaagacaagtcctgattgcagaagtgatcttcacaaacattggaggagctgccactgccatcggggaccctccaaatgtcattattgtttccaaccaagagctgaggaagatgggcctggactttgccggattcactgcacacatgttcattgggatttgccttgttctcctggtctgctttccgctcctcagactcctttactggaacagaaagctttataacaaggaacccagtgagattgttgaactgaagcacgagattcacgtctggcgcctgactgctcagcgcatcagcccggccagccgcgaggagacagctgtgcgccgcctgctgctggggaaggtgctggcactggagcacctgctcgcccggaggctgcacaccttccacagacagatctcacaggaggacaaaaattgggagaccaatatccaagaactccaaaaaaagcataggatatctgacgggattctgctcgccaaatgcctgacagtgttgggatttgttatcttcatgtttttcctcaattcgtttgtccctggcattcatcttgatcttggtggcctgggcttggttcaagctggcaggtattatttatccacacctgagagctga

SEQ ID NO: 21023 - DNA, 996 bp, Homo sapiens
tccgctcaccatccagagcggaggtgcggaccttaaactcactcctggagaaagatctgcaagtgcgcaggtaaagtgcacgtgctccgcggtcgggaggaaggaggcgaggagccagactagcctgggaacaggcagggagggtttacacagccccggctgagtcgcggcttaggaagcaagagagaagactggcagtggagcatgcatctggagggcagagacggcaggcggtaccccggcgcgccggcggtggagctcctgcagacgtccgtgcccagcggactcgctgaacttgtggccggcaagcgcaggcttcctcggggagccggtggagctgacccctcgcactcctgccccaggggggctgccgggcagagctcttgggctcctgcaggccaggagtttgcttcattcctcacaaaagggaggtctcactcttctttgccccagatgtccagctccaggtctaaagattcctgctttacagaaaacactcctttgctgaggaattccttacaggagaaagggtcacggtgcatacctgtttaccatccagagttcatcactgctgaagagtcttgggaagacagctctgctgactgggagcgaagatacctgctaagcagggaggtgtctggtctgtctgcatctgcctcctccgagaagggagaccttctggacagcccgcacatccgactccgtctttccaagctgaggcgctgtgtgcagtggctgaaagtcatgggcctgtttgcctttgtggtgctgtgttctattttgttcagcctatatccggatcaaggaaagctctggcagctgttggccttatcaccgctggagaactactccgtgaaccttagcagccacgtggactccacgctgctgcaggtggacctggcaggggccctagtggccagtgggccgagtcgtcctgggagggaagagcacatcgtggtggagctgacccaggctgacgctttgggctccaggtgg

SEQ ID NO: 21024 - DNA, 750 bp, Homo sapiens
tgctccgctcaccatccagagcggaggtgcggaccttaaactcactcctggagaaagatctgcaagtgcgcagagagaagactggcagtggagcatgcatctggagggcagagacggcaggcggtaccccggcgcgccggcggtggagctcctgcagacgtccgtgcccagcggactcgctgaacttgtggccggcaagcgcaggcttcctcggggagccggtggagctgacccctcgcactcctgccccaggggggctgccgggcagagctcttgggctcctgcaggccaggagtttgcttcattcctcacaaaagggaggtctcactcttctttgccccagatgtccagctccaggtctaaagattcctgctttacagaaaacactcctttgctgaggaattccttacaggagaaagggtcacggtgcatacctgtttaccatccagagttcatcactgctgaagagtcttgggaagacagctctgctgactgggagcgaagatacctgctaagcagggaggtgtctggtctgtctgcatctgcctcctccgagaagggagaccttctggacagcccgcacatccgactccgtctttccaagctgaggcgctgtgtgcagtggctgaaagtcatgggcctgtttgcctttgtggtgctgtgttctgtcactcacaactggacggtgtatttaaatccgaggagaagcgagcactcagtgatgagcaggacctttgaggtactgaccag

SEQ ID NO: 21025 - DNA, 1936 bp, Homo sapiens
aaataagtaggcggctcggtgctaagggatgagtgagtcggagctcggcctctccccggcacgttctcagctgctcctggttcagacccagcgagggagccgcgagcgaggctcaccgtccccggcgtgcaggatccggggctgctgagcgctcgctcccgcgtgtccggcgcttggagtccccgcggcaggagaggagtcgggacactagagctccaggggcgcctgtgggctccagggcctccggcttccccagtccccttcagctaaagccccagagacgtgctcagccccaggacctctgcggaacaagatccggattgagaagccactgcaactaccgaaatgggcagcaaaaccttgccggcgccggtgcctatccacccttccctgcagctcaccaactactccttccttcaggcagtgaacggcctgcccacagtgccttcggaccatctgcccaacctgtatggtttcagcgcgttgcacgctgtgcacctgcatcagtggacgctgggctacccggccatgcacttgccgcgctcttctttctccaaagtgccgggcacggtgtccagcttggtggatgcgcgcttccagctgcccgcctttccctggttccctcatgtcattcaacccaagcccgagatcaccgctggaggcagcgttccagcgctcaagaccaagccgcgctttgattttgccaacctggccttggcagcaacgcaagaagatccggccaagctcggtcgcggggagggcccaggctcccctgcaggtgggctgggtgccctcctcgacgtgaccaagctgtctccagaaaagaagcccacaaggggacgtctgccttccaagaccaagaaggaattcgtctgcaagttctgtggccgccacttcaccaagtcctacaacctacttatccatgagcggacgcacaccgacgagcggccctacacctgtgacatctgccacaaagccttccggaggcaagaccacctgcgagaccacagatatattcactccaaagagaagcccttcaagtgtcaagagtgtgggaaaggattctgccagtccaggactctcgctgtccacaagacgctacactcacaggtgaaggagctcaaaacctccaagatcaaatgctaaatagaacctgtgggtcacaaggaccctaggcccagcggccctctcctccatagggaccagaagcctgactctggcgggcagcgggagaggcgctcgctcgggaccttccacctctccaacattgtcccctgggtccctggcgcacgcggcacttcagagccccgcccggggccgcgaccccgaccgtccctgctgctcccctaggacgcggctaaactcttggccaaaaggcggtactcacgtggcggaagggaaactgcattaaaaaaagaacgaaagctccgcggagccgcagcggcgcctctcccagaagtattactttttctattgttattttatacgttttcttttttatttttgtctttgaccatataagcttgtaactctgactgcggagagtgagtggagagaggagaggcaacgaagtccttagcactggcagctcccacctcctcctcccgcccctgcccccacccccggagcctgcaaaagtgtaatccctgtatctgcttcagcctcctgccctagggaccgcggggcagccccctcccagctcttgcagctcagctggcggccgtgggctccgggactaggagagcgggacggggacctcgggcctggggtctgcagggggcccggcctccgctgccgcgacactgcgagggagcagccagccaagagccgggcgttatattgcgattggcactttatgctgaccatcggtaacggacatttatcactggagttttttttttttttaactattaaataaacggttattttacaggca

SEQ ID NO: 21026 - DNA, 4175 bp, Homo sapiens
aagcagttaacttgctcacgctcaattagccccgaataaaccactttaatagactctgcacacttcattaatgcccagcataggactggccgcagacctgggattggcgctccaccgcgcgagggacgcgagtgcccgcactgcgcagggactcgggatcccgagcgcgaattgcgtctgctgtgcgtggtcgggtccccttattctttcccgcaggtcctgaggcccaagctgtttgaggaatgggtgcctagcctggggaagggttttccatcctgtgtttaaagatcgaaagtattcgccctggggttccgcggtctgggaaaccggagccggaggagccgggggctcactcatcctttctggctggagaggctagggtgagactgtgtttttctcttaaccgacctcctgaaaccggatcgtgctttcggcccattcttgatactagtgtaaagagccacgtttcgaatgaatttcgtcctggggaaagtcgttggcgggagcctggggagcactggcttccgaatgcttcagaaaacaaggaacgggctgggccgcggaagaaaataaatgtagtgttggggaaaacaagatcgggcagatagcccggaaaggttggctcccaggaaccattatagctgcaagcactcccccttcccggcaccccctacggagcccaagacggctccggtcttggctctaaggaagaaggcgaggaaaggcctagcgaggttggtggtttctcccacccaggcacggagcgggttcgggacagtgtgcaggccagagtcccacagccacggccgctggcttggccttggataggccaagcacccagaggagcagggggaggcctccgcggcgcccagcggggtccgggacccggagataaggatctgatttccagcgcctggaagggaagaagaggtgacagcaattcaaagagcgctcatccctcctaagtccaggccgacctttgaagttagacaggcttctcctccttccccttccccaacccaaatgggtctcagcttcctctctggcccaatttgaaatttacttctccttgtgtccgagctctgggatagtctcaatttgtcccgggcacgacccgagcttggcgcagtagagatgaccgttgctgaagccacggcgctgccagcggcaccagcgctctgcttcagaggccagatcacgcagataatatgcctcctcttgccctgaggctaaattcattgcaacggtttttatccgagtgctaatttaaactgcgcaggcaaatcacggccagctcgtggtgtttttacaccccattcccaggaaggcctctttccttaggtcccaccacacagccagtggcccccgtgccagcttccaggagaaaaggttttcctgggtcaacattgccctcatacctcctgggaaaaggcactgcacatccctggacagagccaggctttgaaagcctcgctgcagcgaaaggcagaggagtctatgcctgggccttgccctgggctgagggtcagctcaacctggggagggggcacgccaaactagggagcagagcagaggccagtgcatcccagggaaggggaattgctccatgttagaggaaaggacctaggaagaggagagtaatgaagggtaaaggaagaagtcaacagcaggggattgaagctaggcaagagagaagggagtcccacggaccctgctgtgacaatgacttcttaagtagccccaagctaagagccaggagttcagtgcttgggcttcccaaggctccctgacagtttagactttgctcaccctgttctttcctccactggacacatctaaattaggagtgtctgggaggtagagatgaaaagcattttgcagagctcagatgtctccacggaggctggagaccatggccaaggaggtctggagatgccaacccctggtcacttcagtgtggctttcctctggccttgctcaagctctccaaccttgcacttggaggtacatagaccacaggaatggaggcctggcctcagtgttcttgcccataggcatacccacctgcccagggctcacaacacacaagaacatgctgacaacccaaagactcagctccctttttctttgggggagtgagggcactaacacccccttgtttgtgactgcagttgtttgacagagtaaatgaatgtggatattagcaacctccttgaaagcaaagtggtccccgagggctaaggcaaggcagagagtcagtccacaagcagctgcagagagagtggagccaacaggtttcacttacactaaggcagggaagcagatttaaggtcaaagttgagggttttgaggagaaagatgacagggcttctggaagccaaatcgaaggtcagccagaagaccttaatgaatgggagccaggaggtgcatgcatttgtgcgcctgtgtatgtgtgttgtctgtgaggctcttcatgggtgcaatgtgatcccgtgtgtgtgtgtgtgtgtgtgtgtgtgtgtgtgtgagattcaggggttcctgcatttttttaaagccagtgttgtactataaaacattggttgtcccagtctttgcaccttgtcaattctgcctcagaatgtctgaatccacgtgtgcaattctgtgtttatctgcaaataaatgtgtaagtatgttccccagctcctgttatctttgcaggagattgtgattctgtgttgacccgggcttacctggatgtcaatttctacaggacaggcagtttccctttgcttgttcctttctcagtgtcttgcatacagtaggcccttccctctatcaagttgtgtggctctgccagacgccatttggagggagcccttagaccaaggagggttctgaaaagagggctcccctgcgtcttacattcccaccctctttgtgagggcagtgggttttgggaatggggtcttagactcttagctcctgcgctgggtgtgaggagagggtgtggctcggctggaattcaggaggaaggcgacccaccctgaacttctttattcctctccacgcccctgccttcttcttttctttgcagatccggattgagaagccactgcaactaccgaaatgggcagcaaaaccttgccggcgccggtgcctatccacccttccctgcagctcaccaactactccttccttcaggcagtgaacggcctgcccacagtgccttcggaccatctgcccaacctgtatggtttcagcgcgttgcacgctgtgcacctgcatcagtggacgctgggctacccggccatgcacttgccgcgctcttctttctccaaagtgccgggcacggtgtccagcttggtggatgcgcgcttccagctgcccgcctttccctggttccctcatgtcattcaacccaagcccgagatcaccgctggaggcagcgttccagcgctcaagaccaagccgcgctttgattttgccaacctggccttggcagcaacgcaagaagatccggccaagctcggtcgcggggagggcccaggctcccctgcaggtgggctgggtgccctcctcgacgtgaccaagctgtctccagaaaagaagcccacaaggggacgtctgccttccaagaccaagaaggaattcgtctgcaagttctgtggccgccacttcaccaagtcctacaacctacttatccatgagcggacgcacaccgacgagcggccctacacctgtgacatctgccacaaagccttccggaggcaagaccacctgcgagaccacagatatattcactccaaagagaagcccttcaagtgtcaagagtgtgggaaaggattctgccagtccaggactctcgctgtccacaagacgctacactcacaggtgaaggagctcaaaacctccaagatcaaatgctaaatagaacctgtgggtcacaaggaccctaggcccagcggccctctcctccatagggaccagaagcctgactctggcgggcagcgggagaggcgctcgctcgggaccttccacctctccaacattgtcccctgggtccctggcgcacgcggcacttcagagccccgcccggggccgcgaccccgaccgtccctgctgctcccctaggacgcggctaaactcttggccaaaaggcggtactcacgtggcggaagggaaactgcatt

SEQ ID NO: 21027 - DNA, 1838 bp, Homo sapiens
agcctggggagggacgcgggcggggacggagctcggcgtgcttgctgctggagggtgatggccctgcaaggctgtgggctccgacctcaccgggagtcgacagcgagaggttcgccgaagagcgaggttctgggcgagcgctgaacgccggccccaagcaccccgggtctttacacagtccgcgtccacagactctgacgaagacgtggatctgctctcgctttagctgctcgcggtcctccagatcatgtccgcgactcctgcgactccgcgcggaaaaaaaagtttgccaggcgtggactcaatgacctttccaagctgtgcgcctcgctgcctggaccgggtctgagcgcggctgcccaggttgacctttctgcgggagggctttctctacgtgctgttgtctcactgggtttttgtcggagccccacgccctccggcctctgattcctggaagaaagggttggtcccctcagcacccccagcatcccggaaaatggggagcaaggctctgccagcgcccatcccgctccacccgtcgctgcagctcaccaattactccttcctgcaggccgtgaacaccttcccggccacggtggaccacctgcagggcctgtacggtctcagcgcggtacagaccatgcacatgaaccactggacgctggggtatcccaatgtgcacgagatcacccgctccaccatcacggagatggcggcggcgcagggcctcgtggacgcgcgcttccccttcccggccctgccttttaccacccacctattccaccccaagcagggggccattgcccacgtcctcccagccctgcacaaggaccggccccgttttgactttgccaatttggcggtggctgccacgcaagaggatccgcctaagatgggagacctgagcaagctgagcccaggactgggtagccccatctcgggcctcagtaaattgactccggacagaaagccctctcgaggaaggttgccctccaaaacgaaaaaagagtttatctgcaagttttgcggcagacactttaccaaatcctacaatttgctcatccatgagaggacccacacggacgagaggccgtacacgtgtgacatctgccacaaggccttccggaggcaagatcacctgcgggatcacagatacatccattccaaagaaaaacccttcaaatgtcaggagtgtgggaaaggattttgtcagtctagaactctagcagttcacaaaactttacacatgcaggaatctccacacaaatgtcccacatgtggaagaacctttaatcagagaagtaatctgaaaactcaccttctcacccatacagacatcaagccctacagctgcgagcagtgcggcaaagtgttcaggcgaaactgtgatctgcggcggcacagcctgactcacaccccgcggcaggacttctagagaagcccaggatctgtcccgtgccgccgctgctcccctccccagacacctctccacgtctcctacccagggggtcgcatccctagcccttcactgaccccagctcttcccttgctgcagccgcacctgcagctccagggagttaactcttcttctgggggactgagaactgtagaaagccacacactactacatcccttcacaaagagtatatgctagtttcttgtagatattcacagctcattttagagctctgtacataatgttgtgggtctttgttttgttgttttgtttgctttgggatcttgttggatgcacttagatatggaaaatggaagccaaattttatctttaaagactgtattttcaaaataaaactttttcttgtttgtttcaaaactcc

SEQ ID NO: 21028 - DNA, 1736 bp, Homo sapiens
cgggcggggacggagctcggcgtgcttgctgctggagggtgatggccctgcaaggctgtgggctccgacctcaccgggagtcgacagcgagaggttcgccgaagagcgaggttctgggcgagcgctgaacgccggccccaagcaccccgggtctttacacagtccgcgtccacagactctgacgaagacgtggatctgctctcgctttagctgctcgcggtcctccagatcatgtccgcgactcctgcgactccgcgcggaaaaaaaagtttgccaggcgtggactcaatgacctttccaagctgtgcgcctcgctgcctggaccgggtctgagcgcggctgcccaggttgacctttctgcgggagggctttctctacgtgctgttgtctcactgggtttttgtcggagccccacgccctccggcctctgattcctggaagaaagggttggtcccctcagcacccccagcatcccggaaaatggggagcaaggctctgccagcgcccatcccgctccacccgtcgctgcagctcaccaattactccttcctgcaggccgtgaacaccttcccggccacggtggaccacctgcagggcctgtacggtctcagcgcggtacagaccatgcacatgaaccactggacgctggggtatcccaatgtgcacgagatcacccgctccaccatcacggagatggcggcggcgcagggcctcgtggacgcgcgcttccccttcccggccctgccttttaccacccacctattccaccccaagcagggggccattgcccacgtcctcccagccctgcacaaggaccggccccgttttgactttgccaatttggcggtggctgccacgcaagaggatccgcctaagatgggagacctgagcaagctgagcccaggactgggtagccccatctcgggcctcagtaaattgactccggacagaaagccctctcgaggaaggttgccctccaaaacgaaaaaagagtttatctgcaagttttgcggcagacactttaccaaatcctacaatttgctcatccatgagaggacccacacggacgagaggccgtacacgtgtgacatctgccacaaggccttccggaggcaagatcacctgcgggatcacagatacatccattccaaagaaaaacccttcaaatgtcaggagtgtgggaaaggattttgtcagtctagaactctagcagttcacaaaactttacacatgcagacatcaagccctacagctgcgagcagtgcggcaaagtgttcaggcgaaactgtgatctgcggcggcacagcctgactcacaccccgcggcaggacttctagagaagcccaggatctgtcccgtgccgccgctgctcccctccccagacacctctccacgtctcctacccagggggtcgcatccctagcccttcactgaccccagctcttcccttgctgcagccgcacctgcagctccagggagttaactcttcttctgggggactgagaactgtagaaagccacacactactacatcccttcacaaagagtatatgctagtttcttgtagatattcacagctcattttagagctctgtacataatgttgtgggtctttgttttgttgttttgtttgctttgggatcttgttggatgcacttagatatggaaaatggaagccaaattttatctttaaagactgtattttcaaaataaaactttttcttgtttgtttcaaaa

SEQ ID NO: 21029 - DNA, 1528 bp, Homo sapiens
tcgctttagctgctcgcggtcctccagatcatgtccgcgactcctgcgactccgcgcggaaaaaaaagtttgccaggcgtggactcaatgacctttccaagctgtgcgcctcgctgcctggaccgggtctgagcgcggctgcccaggttgacctttctgcgggagatggggctgagggcagaggaaggaaaaagaaaacctccgaggtcagtgcggggcgaggtgagcccctcccagggccctctggcccaggaggatgaagcgcgccggcttcgctcttgcacgccggcttgccatccgggtaagcgcgggaaaggcggccacagggcgcggcggcagcgcagcgcgtgggatctcacgacccatccgttaacccaccgttcccaggagctccgaggcgcagcggcgacagagggctttctctacgtgctgttgtctcactgggtttttgtcggagccccacgccctccggcctctgattcctggaagaaagggttggtcccctcagcacccccagcatcccggaaaatggggagcaaggctctgccagcgcccatcccgctccacccgtcgctgcagctcaccaattactccttcctgcaggccgtgaacaccttcccggccacggtggaccacctgcagggcctgtacggtctcagcgcggtacagaccatgcacatgaaccactggacgctggggtatcccaatgtgcacgagatcacccgctccaccatcacggagatggcggcggcgcagggcctcgtggacgcgcgcttccccttcccggccctgccttttaccacccacctattccaccccaagcagggggccattgcccacgtcctcccagccctgcacaaggaccggccccgttttgactttgccaatttggcggtggctgccacgcaagaggatccgcctaagatgggagacctgagcaagctgagcccaggactgggtagccccatctcgggcctcagtaaattgactccggacagaaagccctctcgaggaaggttgccctccaaaacgaaaaaagagtttatctgcaagttttgcggcagacactttaccaaatcctacaatttgctcatccatgagaggacccacacggacgagaggccgtacacgtgtgacatctgccacaaggccttccggaggcaagatcacctgcgggatcacagatacatccattccaaagaaaaacccttcaaatgtcaggagtgtgggaaaggattttgtcagtctagaactctagcagttcacaaaactttacacatgcaggaatctccacacaaatgtcccacatgtggaagaacctttaatcagagaagtaatctgaaaactcaccttctcacccatacagacatcaagccctacagctgcgagcagtgcggcaaagtgttcaggcgaaactgtgatctgcggcggcacagcctgactcacaccccgcggcaggacttctagagaagcccaggatctgtcccgtgccgccgctgctcccctccccagacacctctccacgtct

SEQ ID NO: 21030 - DNA, 1048 bp, Homo sapiens
caggagctccgaggcgcagcggcgacagaggttcgccccggcctgctagcattggcattgcggttgactgagcttcgcctaacaggcttggggagggtgggctgggctgggctgggctgggctgggtgctgcccggctgtccgcctttcgttttcctgggaccgaggagtcttccgctccgtatctgcctagagtctgaatccgactttctttcctttgggcacgcgctcgccagtggagcacttcttgttctggccccgggctgatctgcacgcggacttgagcaggtgccaagggctttctctacgtgctgttgtctcactgggtttttgtcggagccccacgccctccggcctctgattcctggaagaaagggttggtcccctcagcacccccagcatcccggaaaatggggagcaaggctctgccagcgcccatcccgctccacccgtcgctgcagctcaccaattactccttcctgcaggccgtgaacaccttcccggccacggtggaccacctgcagggcctgtacggtctcagcgcggtacagaccatgcacatgaaccactggacgctggggtatcccaatgtgcacgagatcacccgctccaccatcacggagatggcggcggcgcagggcctcgtggacgcgcgcttccccttcccggccctgccttttaccacccacctattccaccccaagcagggggccattgcccacgtcctcccagccctgcacaaggaccggccccgttttgactttgccaatttggcggtggctgccacgcaagaggatccgcctaagatgggagacctgagcaagctgagcccaggactgggtagccccatctcgggcctcagtaaattgactccggacagaaagccctctcgaggaaggttgccctccaaaacgaaaaaagagtttatctgcaagttttgcggcagacactttaccaaatcctacaatttgctcatccatgagaggacccacacggacgagaggccgtacacgtgtgacatctgccacaaggccttccggaggcaagat

SEQ ID NO: 21031 - DNA, 1528 bp, Homo sapiens; identical to SEQ ID NO: 21029

SEQ ID NO: 21032 - DNA, 741 bp, Homo sapiens
cgcccagtgacctgccgaggtcggcagcacagagctctggagatgaagaccctgttcctgggtgtcacgctcggcctggccgctgccctgtccttcaccctggaggaggaggatatcacagggacctggtacgtgaaggccatggtggtcgataaggactttccggaggacaggaggcccaggaaggtgtccccagtgaaggtgacagccctgggcggtgggaacttggaagccacgttcaccttcatgagggaggatcggtgcatccagaagaaaatcctgatgcggaagacggaggagcctggcaaattcagcgcctatgggggcaggaagctcatatacctgcaggagctgcccgggacggacgactacgtcttttactgcaaagaccagcgccgtgggggcctgcgctacatgggaaagcttgtggcatctgctccctgcagggccgtgccgctgtccccaccttggctcacctggccacctcacctgcaggtaggaatcctaataccaacctggaggccctggaagaatttaagaaattggtgcagcacaagggactctcggaggaggacattttcatgcccctgcagacgggaagctgcgttctcgaacactaggcagcccccgggtctgcacctccagagcccaccctaccaccagacacagagcccggaccacctggacctaccctccagccatgacccttccctgctcccacccacctgactccaaataaag

SEQ ID NO: 21033 - DNA, 607 bp, Homo sapiens
cgcccagtgacctgccgaggtcggcagcacagagctctggagatgaagaccctgttcctgggtgtcacgctcggcctggccgctgccctgtccttcaccctggaggaggaggatgagggaggatcggtgcatccagaagaaaatcctgatgcggaagacggaggagcctggcaaattcagcgcctatgggggcaggaagctcatatacctgcaggagctgcccgggacggacgactacgtcttttactgcaaagaccagcgccgtgggggcctgcgctacatgggaaagcttgtggcatctgctccctgcagggccgtgccgctgtccccaccttggctcacctggccacctcacctgcaggtaggaatcctaataccaacctggaggccctggaagaatttaagaaattggtgcagcacaagggactctcggaggaggacattttcatgcccctgcagacgggaagctgcgttctcgaacactaggcagcccccgggtctgcacctccagagcccaccctaccaccagacacagagcccggaccacctggacctaccctccagccatgacccttccctgctcccacccacctgactccaaataaag

SEQ ID NO: 21034 - DNA, 689 bp, Homo sapiens
cgcccagtgacctgccgaggtcggcagcacagagctctggagatgaagaccctgttcctgggtgtcacgctcggcctggccgctgccctgtccttcaccctggaggaggaggatatcacagggacctggtacgtgaaggccatggtggtcgataaggactttccggaggacaggaggcccaggaaggtgtccccagtgaaggtgacagccctgggcggtgggaacttggaagccacgttcaccttcatgagggaggatcggtgcatccagaagaaaatcctgatgcggaagacggaggagcctggcaaattcagcgcctatgggggcaggaagctcatatacctgcaggagctgcccgggacggacgactacgtcttttactgcaaagaccagcgccgtgggggcctgcgctacatgggaaagcttgtgggtaggaatcctaataccaacctggaggccctggaagaatttaagaaattggtgcagcacaagggactctcggaggaggacattttcatgcccctgcagacgggaagctgcgttctcgaacactaggcagcccccgggtctgcacctccagagcccaccctaccaccagacacagagcccggaccacctggacctaccctccagccatgacccttccctgctcccacccacctgactccaaataaagagcttctccccca

SEQ ID NO: 21035 - DNA, 914 bp, Homo sapiens
gaggtcggcagcacagagctctggagatgaagaccctgttcctgggtgtcacgctcggcctggccgctgccctgtccttcaccctggaggaggaggatatcacagggacctggtacgtgaaggccatggtggtcgataaggactttccggaggacaggaggcccaggaaggtgtccccagtgaaggtgacagccctgggcggtgggaacttggaagccacgttcaccttcatgagggaggatcggtgcatccagaagaaaatcctgatgcggaagacggaggagcctggcaaattcagcgcctatgggggcaggaagctcatatacctgcaggagctgcccgggacggacgactacgtcttttactgcaaagaccagcgccgtgggggcctgcgctacatgggaaagcttgtgggtaggaatcctaataccaacctggaggccctggaagaatttaagaaattggtgcagcacaagggactctcggaggaggacattttcatgcccctgcagacgggaagctgcgttctcgaacactaggcgaggcctccctccggctccctcaggtgtcagctcggcccatcgccccctgcacctgtccccactcggtctactcccccccacccactcaccaaggatgctcagaggcctgcccagtcattggaggagctgaggctgctctggagccccgaggctgcccagcagtggccgatgtggaagctgcagagcctggggagggagctctgggcctggcctctgccctaccctgcagcctccctgacctctgctcctcttcccagcacagcagcccccgggtctgcacctccagagcccaccctaccaccagacacagagcccggaccacctggacctaccctccagccatgacccttccctgctcccacccacctgact

SEQ ID NO: 21036 - DNA, 556 bp, Homo sapiens
gacgcccagtgacctgccgaggtcggcagcacagagctctggagatgaagaccctgttcctgggtgtcacgctcggcctggccgctgccctgtccttcaccctggaggaggaggatgatgggccatgggtgcatccagaagaaaatcctgatgcggaagacggaggagcctggcaaatacagcgcctatgggggcaggaagctcatgtacctgcaggagctgcccaggagggaccactacatcttttactgcaaagaccagcaccatgggggcctgctccacatgggaaagcttgtgggtaggaattctgataccaaccgggaggccctggaagaatttaagaaattggtgcagcgcaagggactctcggaggaggacattttcacgcccctgcagacgggaagctgcgttcccgaacactaggcagcccccgggtctgcacctccagagcccaccctaccaccagacacagagcctggaccacctggacctaccctccagccatgacccttccctgctcccacccacctgactccaaataaagtccttctccccc

SEQ ID NO: 21037 - DNA, 691 bp, Homo sapiens
cgcccagtgacctgccgaggtcggcagcacagagctctggagatgaagaccctgttcctgggtgtcacgctcggcctggccgctgccctgtccttcaccctggaggaggaggatatcacagggacctggtacgtgaaggccatggtggtcgataaggactttccggaggacaggaggcccaggaaggtgtccccagtgaaggtgacagccctgggcggtgggaagttggaagccacgttcaccttcatgagggaggataggtgcatccagaagaaaatcctgatgcggaagacggaggagcctggcaaatacagcgcctatgggggcaggaagctcatgtacctgcaggagctgcccaggagggaccactacatcttttactgcaaagaccagcaccatgggggcctgctccacatgggaaagcttgtgggtaggaattctgataccaaccgggaggccctggaagaatttaagaaattggtgcagcgcaagggactctcggaggaggacattttcacgcccctgcagacgggaagctgcgttcccgaacactaggcagcccccgggtctgcacctccagagcccaccctaccaccagacacagagcctggaccacctggacctaccctccagccatgacccttccctgctcccacccacctgactccaaataaagtccttctcccccagc

SEQ ID NO: 21038 - DNA, 14000 bp, Homo sapiens
acctgctccttcctgggcgccccgctacggctcgcggagcagaggagccgcgccgccgagagagagaggagccaccggcgcggcgccttgcctccctgccgccgtcctcgccgcttccccggcggtagcagcctgcagccacgatggaaaaactgagaatcagagagggctagtgatctctcagacacttggtcggtagaaaagatcccgcaccatcctccaggatccaatggccttggagagagggctgcagggcccacggacattgctgactcttcagaacgtgctgacatggagccaggtagactgaaattaccatgtgtccaaattaaaattgcatacttcaaggattatttgaaggactattcttagacccttttaagaagatttaaagaaaaaccactcggccctgagtgcggcgaggaccctgtttgtggatgtggaggagcgcgggccggaggccatggacgtgaaggagaggaagccttaccgctcgctgacccggcgccgcgacgccgagcgccgctacaccagctcgtccgcggacagcgaggagggcaaagccccgcagaaatcgtacagctccagcgagaccctgaaggcctacgaccaggacgcccgcctagcctatggcagccgcgtcaaggacattgtgccgcaggaggccgaggaattctgccgcacaggtgccaacttcaccctgcgggagctggggctggaagaagtaacgccccctcacgggaccctgtaccggacagacattggcctcccccactgcggctactccatgggggctggctctgatgccgacatggaggctgacacggtgctgtcccctgagcaccccgtgcgtctgtggggccggagcacacggtcagggcgcagctcctgcctgtccagccgggccaattccaatctcacactcaccgacaccgagcatgaaaacactgagactgatcatccgggcggcctgcagaaccacgcgcggctccggacgccgccgccgccgctctcgcacgcccacacccccaaccagcaccacgcggcctccattaactccctgaaccggggcaacttcacgccgaggagcaaccccagcccggcccccacggaccactcgctctccggagagccccctgccggcggcgcccaggagcctgcccacgcccaggagaactggctgctcaacagcaacatccccctggagaccagaaacctaggcaagcagccattcctagggacattgcaggacaacctcattgagatggacattctcggcgcctcccgccatgatggggcttacagtgacgggcacttcctcttcaagcctggaggcacctccccgctcttctgcaccacatcaccagggtacccactgacgtccagcacagtgtactctcctccgccccgacccctgccccgcagcaccttcgcccggccggcctttaacctcaagaagccctccaagtactgtaactggaagtgcgcagccctgagcgccatcgtcatctcagccactctggtcatcctgctggcatactttgtggccatgcacctgtttggcctaaactggcacctgcagccgatggaggggcagatgtatgagatcacggaggacacagccagcagttggcctgtgccaaccgacgtctccctatacccctcagggggcactggcttagagacccctgacaggaaaggcaaaggaaccacagaaggaaagcccagtagtttctttccagaggacagtttcatagattctggagaaattgatgtgggaaggcgagcttcccagaagattcctcctggcactttctggagatctcaagtgttcatagaccatcctgtgcatctgaaattcaatgtgtctctgggaaaggcagccctggttggcatttatggcagaaaaggcctccctccttcacatacacagtttgactttgtggagctgctggatggcaggaggctcctaacccaggaggcgcggagcctagaggggaccccgcgccagtctcggggaactgtgcccccctccagccatgagacaggcttcatccagtatttggattcaggaatctggcacttggctttttacaatgacggaaaggagtcagaagtggtttcctttctcaccactgccattgagtcggtggataactgccccagcaactgctatggcaatggtgactgcatctctgggacctgccactgcttcctgggtttcctgggccccgactgtggcagagcctcctgccccgtgctctgtagcggaaatggccaatacatgaaaggcagatgcttgtgccacagtggctggaaaggcgctgagtgcgatgtgcccaccaaccagtgtatcgatgtggcctgcagcaaccatggcacctgcatcacgggcacctgcatctgcaaccctggctacaagggcgagagctgtgaggaagtggactgcatggaccccacatgttcaggccggggtgtctgcgtgagaggcgaatgccactgctctgtgggatggggaggcaccaactgcgagacccccagggccacatgcttagaccagtgttcaggccacggaaccttcctcccggacaccgggctttgcagctgtgacccaagctggactggacacgactgttctatcgagatctgtgctgccgactgtggtggccatggcgtgtgcgtagggggcacctgccgctgcgaggatggctggatgggggcagcctgcgaccagcgggcctgccacccgcgctgtgccgagcatgggacctgccgcgacggcaagtgcgagtgcagccctggctggaatggcgaacactgcaccatcgctcactatctggatagggtagttaaagagggttgccctgggttgtgcaatggcaacggcagatgtaccttagacctgaatggttggcactgcgtctgccagctgggctggagaggagctggctgtgacacttccatggagactgcctgcggtgacagcaaagacaatgatggagatggcctggtggactgcatggaccctgactgctgcctccagcccctgtgccatatcaacccgctgtgccttggctcccctaaccctctggacatcatccaggagacacaggtccctgtgtcacagcagaacctacactccttctatgaccgcatcaagttcctcgtgggcagggacagcacgcacataatccccggggagaacccctttgatggagggcatgcttgtgttattcgtggccaagtgatgacatcagatggaacccccctggttggtgtgaacatcagttttgtcaataaccctctctttggatatacaatcagcaggcaagatggcagctttgacttggtgacaaatggcggcatctccatcatcctgcggttcgagcgggcacctttcatcacacaggagcacaccctgtggctgccatgggatcgcttctttgtcatggaaaccatcatcatgagacatgaggagaatgagattcccagctgtgacctgagcaattttgcccgccccaacccagtcgtctctccatccccactgacgtccttcgccagctcctgtgcagagaaaggccccattgtgccggaaattcaggctttgcaggaggaaatctctatctctggctgcaagatgaggctgagctacctgagcagccggacccctggctacaaatctgtcctgaggatcagcctcacccacccgaccatccccttcaacctcatgaaggtgcacctcatggtagcggtggagggccgcctcttcaggaagtggttcgctgcagccccagacctgtcctattatttcatttgggacaagacagacgtctacaaccagaaggtgtttgggctttcagaagcctttgtttccgtgggttatgaatatgaatcctgcccagatctaatcctgtgggaaaaaagaacaacagtgctgcagggctatgaaattgacgcgtccaagcttggaggatggagcctagacaaacatcatgccctcaacattcaaagtggcatcctgcacaaagggaatggggagaaccagtttgtgtctcagcagcctcctgtcattgggagcatcatgggcaatgggcgccggagaagcatctcctgccccagctgcaacggccttgctgacggcaacaagctcctggccccagtggccctcacctgtggctctgacgggagcctctatgtgggtgatttcaactacattagaaggatcttcccctctggaaatgtcaccaacatcctagagctgagaaataaagatttcagacatagtcacagtccagcacacaaatactacctggccacagaccccatgagtggggccgtcttcctttctgacagcaacagccggcgggtctttaaaatcaagtccactgtggtggtgaaggaccttgtcaagaactctgaggtggttgcggggacaggtgaccagtgcctcccctttgatgacactcgctgcggggatggtgggaaggccacagaagccacactcaccaatcccaggggcattacagtggacaagtttgggctgatctacttcgtggatggcaccatgatcagacgcatcgatcagaatgggatcatctccaccctgctcggctctaatgatctcacatcagcccggccactcagctgtgattctgtcatggatatttcccaggttcacctggagtggcccacagacttagccatcaacccaatggacaactcactttatgtcctcgacaacaatgtggtcctgcaaatctctgaaaaccaccaggtgcgcattgtcgccgggaggcccatgcactgccaggtccctggcattgaccacttcctgctaagcaaggtggccatccacgcaaccctggagtcagccaccgctttggctgtttcacacaatggggtcctgtatattgctgagactgatgagaaaaagatcaaccgcatcaggcaggtcaccactagtggagagatctcactcgttgctggggcccccagtggctgtgactgtaaaaatgatgccaactgtgattgtttttctggagacgatggttatgccaaggatgcaaagttaaataccccatcttccttggctgtgtgtgctgatggggagctctacgtggccgaccttgggaacatccgaattcggtttatccggaagaacaagcctttcctcaacacccagaacatgtatgagctgtcttcaccaattgaccaggagctctatctgtttgataccaccggcaagcacctgtacacccaaagcctgcccacaggagactacctgtacaacttcacctacactggggacggcgacatcacactcatcacagacaacaatggcaacatggtaaatgtccgccgagactctactgggatgcccctctggctggtggtcccagatggccaggtgtactgggtgaccatgggcaccaacagtgcactcaagagtgtgaccacacaaggacacgagttggccatgatgacataccatggcaattccggccttctggcaaccaaaagcaatgaaaacggatggacaacattttatgagtacgacagctttggccgcctgacaaatgtgaccttccctactggccaggtgagcagtttccgaagtgatacagacagttcagtgcatgtccaggtagagacctccagcaaggatgatgtcaccataaccaccaacctgtctgcctcaggcgccttctacacactgctgcaagaccaagtccggaacagctactacatcggggccgatggctccttgcggctgctgctggccaacggcatggaggtggcgctgcagactgagccccacttgctggctggcaccgtcaaccccaccgtgggcaagaggaatgtcacgctgcccatcgacaacggcctcaacctggtggagtggcgccagcgcaaagagcaggctcggggccaggtcactgtctttgggcgccggctgcgggttcacaaccgaaatctcctatctctggactttgatcgcgtaacacgcacagagaagatctatgatgaccaccgcaagttcacccttcggattctgtacgaccaggcggggcggcccagcctctggtcacccagcagcaggctgaatggtgtcaacgtgacatactcccctgggggttacattgctggcatccagaggggcatcatgtctgaaagaatggaatacgaccaggcgggccgcatcacatccaggatcttcgctgatgggaagacatggagctacacatacttagagaagtccatggtgctgctactacacagccagaggcagtatatctttgagttcgacaagaatgaccgcctctcttctgtgacgatgcccaacgtggcgcggcagacactagagaccatccgctcagtgggctactacagaaacatctatcagccccctgagggcaatgcctcagtcatacaggacttcactgaggatgggcacctccttcacaccttctacctgggcactggccgcagggtgatatacaagtatggcaaactgtcaaagctggcagagacgctctatgacaccaccaaggtcagtttcacctatgacgagacggcaggcatgctgaagaccatcaacctacagaatgagggcttcacctgcaccatccgctaccgtcagattgggcccctgattgaccgacagatcttccgcttcactgaggaaggcatggtcaacgcccgttttgactacaactatgacaacagcttccgggtgaccagcatgcaggctgtgatcaacgagaccccactgcccattgatctctatcgctatgatgatgtgtcaggcaagacagagcagtttgggaagtttggtgtcatttactatgacattaaccagatcatcaccacagctgtcatgacccacaccaagcattttgatgcatatggcaggatgaaggaagtgcagtatgagatcttccgctcgctcatgtactggatgaccgtccagtatgataacatggggcgagtagtgaagaaggagctgaaggtaggaccctacgccaataccactcgctactcctatgagtatgatgctgacggccagctgcagacagtctccatcaatgacaagccactctggcgctacagctacgacctcaatgggaacctgcacttactgagccctgggaacagtgcacggctcacaccactacggtatgacatccgcgaccgcatcactcggctgggtgacgtgcaatacaagatggatgaggatggcttcctgaggcagcggggcggtgatatctttgagtacaactcagctggcctgctcatcaaggcctacaaccgggctggcagctggagtgtcaggtaccgctacgatggcctggggcggcgcgtgtccagcaagagcagccacagccaccacctgcagttcttctatgcagacctgaccaaccccaccaaggtcacccacctgtacaaccactccagctctgagatcacctccctctactacgacttgcaaggacacctctttgccatggagctgagcagtggtgatgagttttacatagcttgtgacaacatcgggacccctcttgctgtctttagtggaacaggtttgatgatcaagcaaatcctgtacacagcctatggggagatctacatggataccaaccccaactttcagatcatcataggctaccatggtggcctctatgatccactcaccaagcttgtccacatgggccggcgagattatgatgtgctggccggacgctggactagcccagaccacgagctgtggaagcaccttagtagcagcaacgtcatgccttttaatctctatatgttcaaaaacaacaaccccatcagcaactcccaggacatcaagtgcttcatgacagatgttaacagctggctgctcacctttggattccagctacacaacgtgatccctggttatcccaaaccagacatggatgccatggaaccctcctacgagctcatccacacacagatgaaaacgcaggagtgggacaacagcaagtctatcctcggggtacagtgtgaagtacagaagcagctcaaggcctttgtcaccttagaacggtttgaccagctctatggctccacaatcaccagctgccagcaggctccaaagaccaagaagtttgcatccagcggctcagtctttggcaagggggtcaagtttgccttgaaggatggccgagtgaccacagacatcatcagtgtggccaatgaggatgggcgaagggttgctgccatcttgaaccatgcccactacctagagaacctgcacttcaccattgatggggtggatacccattactttgtgaaaccaggaccttcagaaggtgacctggccatcctgggcctcagtggggggcggcgaaccctggagaatggggtcaacgtcactgtgtcccagatcaacacagtacttaatggcaggactagacgctacacagacatccagctccagtacggggcactgtgcttgaacacacgctacgggacaacgttggatgaggagaaggcacgggtcctggagctggcccggcagagagccgtgcgccaagcgtgggcccgcgagcagcagagactgcgggaaggggaggaaggcctgcgggcctggacagagggggagaagcagcaggtgctgagcacagggcgggtgcaaggctacgacggctttttcgtgatctctgtcgagcagtacccagaactgtcagacagcgccaacaacatccacttcatgagacagagcgagatgggccggaggtgacagagaggaccaaggacttcttgccaaagacagctactcttttgtggccgcatacctgactgtgttgtacttttaaaaaaatgattttttaacaagtgcagaaacaaaaagatactggttgcattgtaactcatgcaacatccttttttttagaaaagaaaaacacagatttggccttcgcacattttttgcaaagaacagaaggtatttttttctgtagtgtgatcacaatgaaaactttattgtcttttgttccctttttccttgaggatttttcccttgtcgtttggggtatgtatctcctctctgagatgcatctcctggggtgtgtcctcgtctgtccctaggtacccagtgtgatgtgggacatgaatgtctgtgctaacttgtctcatgtgcaaccctttcttcttcgactggggtcgggcaggagtaaagggagtgatgggccagtacaacaccccttccaagggggcctgggaggagggtctgtaggacctgaggctccttggcagggctcctgcagaagagtggtggatttcttctcaccttgttctctgcctccagaggatcatagatggcttcatcttgctccagggaatttcatggtgttgttcagcaccttttttaagctgccccaaactcctgttcaagctttctattttgatgctgaatgaaaccccctaccacttttgcaaatcctgtgtagttgtcggtgccacccccatgctgggatagagaaagtgtctcccaggtcctttcccccagaccagtgacataacatcctgggctcagagtcccatcctcccgggagggaaagcacccaggatgcctgtgattggttggtcctccatgatgttcctgttcatctcctcctttctcccaaagccagatgtgagaacgagcactgcacagcaagccttcaatgtgggcaccatgtccacagaacagaaggccacccatggcaaaggcatggcagtggtggcgagggcaccagcctgccttccgaggcaaagccctctctctatgactttgagtatcttccctccaccactcagccgccaccactgagacgtaggaatgtggagggaggtgcttggtggcctttgattctggaaaaatgcttaacaaaaaaagccagccaaagagaggaaggcataagctaagcatccttctaaccagttcccaaagtcccatctgcctccatgtaccagctgatcgcagagctggactggggcaggctgggcttccaggaaattcctgaagttctgaaacagcttcccctctagagaagcccacccaatgtgttttttagtgacaggaagaaaggagggaagagctgatgtggtgtggcctgcccatatcatacaaccccaccaggagcagggcagttcccaaggtgggtgcccgtagatctgggaggccaggctggcatgattcctgtgaagaactgtgcctgtgtcgtcagggagaggcctgagccctctcagaagcagggacagcccacacctgaagagcacgcccaagctgaggcagcagccagcaggctgggggagcagtgagggcagggggagtcacagccagagctgggagccccttgttcaaggattccattcctggttcatccgcctaattaccattgtcattaccactcacaggaggctctgggagatgggaggggaagccaaatgcttccttttaagctgggcttcttagaaaatggaacttttatgggttacatttacattaagtgtggaaaatgaattctgagtctgagctattccccgtggaaaccttgttggactgataagctcatggcacctctatagccttactcacatagtcttcagaatattacacaagttaatgaaactgagaaggtctgactgcatgaggatcggagcagcatgtagtctgggttctgcctggcagagggaggcaaccaaaacttcttggggagaggagatttcgccttaacgtcatcccactgggattagaggatgtgtttcgctaagtgctcttcctgtttccaaaaaaaaagccaccctgctgcagcagtgcgctttggcctgcttgtccactggttgcccattgcccctggatccagagctctactgagtcagatacagtgctctgcaggcctgctgtgggaggcatgagctggagatgggggctcccatctggcaggatcattcttggatgagatggaaaacagtttggcctgaagaacacaagttttgtcctccagaagggacttacgcctctcaaaatgtactcttcataccaagggcccttgggcaaagtgctcctgcccagttgatcagtcccatcctggctgcctgacatcagtgaagacctgctggggatgtctgctcagaggtcaggaacggcatgcggtccacaggaaccagctccctacgcttcccccacgccctgtccctcctccacagccccctccccaaaggaatagggtggacttttagggatcaaaaacagaattattgggtgtttcatttatttttttctttctttcttttttttttcatagagatggggtctcactatgttgcccaggctgttctcaaactcctggcctcaggcgatccaccttggcctcctgaagtgctggggttacaggtgtgagccactgcgcctggactgagtgtttgtttctttaaaggatcttatatttttcctgtgctacataccaccacagcagcccagcttctgtggggagagaagttgaaggatcccgaagctttagaaaaaggatctcagctgtggcacaggcagtgttatgcgcctcactgccacattggtgctgttgtattgaaggtggtgcttctggccttggcccttttgagttggtttccatttgggctgcaggtgactcagtgactccctcctcaagctgtcctcctgctaagaccagcagtcacaaacccatggcaagggtgagtgtgaaggcctaaccctgtgcctatgtaataggctccaagcatcgactcccatcctgagaggaccggcccttttgacactcaccaaccaaatctgttcattcgatagagtgaccaggcctccctcacctgcccaggtgtatgatcctacagttcctgccttctctcctaccccgcacagctgccaactggtcctacatcctcagcccctctgccaccaccttaaataggactttactgattccccaactttgtttttttgtaggatgagatttcctttttatcccacccccccacaccccaaacagacattgctggagggcagactggaggaaggggaaggcatgcaggtaaattactgccttgtcagcctctgaccctcatctctcagaattgttggctgagaattaacccaaggaccacaccagtgcctgatttctacttagggagagaggattggaaacgatccctaagaaactgactgagggtgagaatggccaggaggtgtgtgtccaaataaccaggagggggcacagaagatgatggcaaggcagactgggcagtgttttgtagacacagaacaaagaatcagaatttgaaaaaagaagaaaaacaaatcttcgcagctgcaactttaaagtatcacctttatagatggcagggatttccattatgcaaatggaatctaagatttcaatgtgaaatcttagaatgcagttttaccacttgcagtcttgtatttgtggtggccatgtggtgagggcggtgatgctgagctttctgcccaggaggaatgagctttcaagctctcagcagggtgtcaggcttggggatttgagcatccactgctcaaagtccaggctattctccagtcctcacggcagccactaagcccaggagccagacctggcccggggacacatctcctgagggatcccagaaagaacccagtctttcctttcccttggggtccttgttagaatgaaaacctctctatttaaggcacatcattcccagctaggtttatacacttgtctatattttactggaggaaagggaattaaaaaagaactctgcagttcaaggccctttcatttaaccttccaaaaacagcaaactcattttaaagactcattgctgaggtgatagagagaaaccttatcctctccaaccttcacattcacaaaaaccatccttgtgtacttgactgccctagacagtggtgactcttaggtttcattacgaatgtggaatatcagagtgtgggaaggcccaggcgagggccaatgttgtgtttcttaccccctctggaatgccaaaggcaaggtactaggtgacctcctggtccccaagaaaatgtgatttattctgagggcgaacagccaagggaggactagtctggagcacgctcggccgtcctggcaggagctgagcctcaggtgtctggcggtgccccagcagccctggattcacccaacaccagaatcccacttttctaaatccacctgttgttctgagcacctctgaacccgcagcttcggcaaaaggagtctgtaccaagctgcttctggatgaccaacactggagactctggccttaccatgtggaaatcattttcctgaagtctggaactaattttgagaagtttttttctcaacacttttgtgtttctaacactgtatcttgactgtgtaaataccaacaaggctgtaaataaatgcagatgtagataccttctagaaaaaaaaaagcataaaaacaaaaccagaagtgatcccgtgtagccttcgttgacaaataaagactattttgtgtttacaggtgtctggtggcctttgcttggagataaaggcttcctcttgcctgtcccagcccccgagccatcctgggtttgcacttccctgctggctgctatcaggatgacctgggagaggactcagtcctaggccccagggtccctctaaatccctccaggctgcagctctgtcaagagggatgtccagagggtctctaagaccctgaagcttgactttgcaattgcatgacaggaataaatatcacagctcctctgacatcactagtgcagcgtggctccccatcccactgctgccctcgttcagggacaggctgaaggggccaacgaacccaaccctcccagaggagggagccttgctccaccactgggcacacagagtcatccaccatgccactgccttccacaagggatgtgagccgttgcactttaaaaataaatgactgtatattcatca

SEQ ID NO: 21039 - DNA, 170 bp, Homo sapiens
aaaagatcccgcaccatcctccaggatccaatggccttggagagagggctgcagggcccacggacattgctgactcttcagaacgtgctgacatggagccagaccactcggccctgagtgcggcgaggaccctgtttgtggatgtggaggagcgcgggccggaggccatg

SEQ ID NO: 21040 - DNA, 2591 bp, Homo sapiens
gggacgcgataaatatgcagagcggaggcttcgcgcagcagagcccgcgcgccgcccgctccgggtgctgaatccaggcgtggggacacgagccaggcgccgccgccggagccagcggagccggggccagagccggagcgcgtccgcgtccacgcagccgccggccggccagcacccagggccctgcatgccaggtcgttggaggtggcagcgagacatgcacccggcccggaagctcctcagcctcctcttcctcatcctgatgggcactgaactcactcaagtgctgcccaccaaccctgaggagagctggcaggtgtacagctctgcccaggacagcgagggcaggtgtatctgcacagtggtcgctccacagcagaccatgtgttcacgggatgcccgcacaaaacagctgaggcagctactggagaaggtgcagaacatgtctcaatccatagaggtcttggacaggcggacccagagagacttgcagtacgtggagaagatggagaaccaaatgaaaggactggagtccaagttcaaacaggtggaggagagtcataagcaacacctggccaggcagtttaaggcgataaaagcgaaaatggatgaacttaggcctttgatacctgtgttggaagagtacaaggccgatgccaaattggtattgcagtttaaagaggaggtccagaatctgacgtcagtgcttaacgagctgcaagaggaaattggcgcctatgactacgatgaacttcagagcagagtgtccaatcttgaagaaaggctccgtgcatgcatgcaaaaactagcttgcgggaagttgacgggcatcagtgaccccgtgactgtcaagacctccggctcgaggttcggatcctggatgacagaccctctcgcccctgaaggcgataaccgggtgtggtacatggacggctatcacaacaaccgcttcgtacgtgagtacaagtccatggttgacttcatgaacacggacaatttcacctcccaccgtctcccccacccctggtcgggcacggggcaggtggtctacaacggttctatctacttcaacaagttccagagccacatcatcatcaggtttgacctgaagacagagaccatcctcaagacccgcagcctggactatgccggttacaacaacatgtaccactacgcctggggtggccactcggacatcgacctcatggtggacgagagcgggctgtgggccgtgtacgccaccaaccagaacgctggcaacatcgtggtcagtaggctggaccccgtgtccctgcagaccctgcagacctggaacacgagctaccccaagcgcagcgccggggaggccttcatcatctgcggcacgctgtacgtcaccaacggctactcagggggtaccaaggtccactatgcataccagaccaatgcctccacctatgaatacatcgacatcccattccagaacaaatactcccacatctccatgctggactacaaccccaaggaccgggccctgtatgcctggaacaacggccaccagatcctctacaacgtgaccctcttccacgtcatccgctccgacgagttgtagctccctcctcctggaagccaagggcccacgtcctcaccacaaagggactcctgtgaaactgctgccaaaaagataccaataacactaacaataccgatcttgaaaaatcatcagcagtgcggattctgacatcgagggatggcattacctccgtgtttctccctttcgagccggcgggccacagacgtcggaagaaactcccgtatttgcagctggaactgcagcccacggcgccccggttttcctccccgccctgtccctctctggtcaaacaacatactaaagaggcgaggcaatgactgttggccagttctcaccggggaaaaacccactgttaggatggcatgaacatttccttagatcgtggtcagctccgaggaatgtggcgtccaggctctttgagagccatgggctgcacccggccgtaggctagtgtaactcgcatcccattgcagtgccgtttcttgactgtgttgctgtctcttagattaaccgtgctgaggctccacatagctcctggacctgtgtctagtacatactgaagcgatggtcagagtgtgtagagtgaagttgctgtgcccacattgtttgaactcgcgtaccccgtagatacattgtgcaacgttcttctgttattcccttgaggtggtaacttcgtatgttcagtttatgcgatgattgttgtaaatgcaatgccgtagtttggattaataagtggatggtttttgtttctaaaaagaaaaaaaaaatcagtgttcacccttatagagacatagtcaagttcatgttgataataatcaaaggaattactctcttcttgttaaattagctaaatcatgtaaccgcagataggaagggctcgcctggggaaactctggtttccgatgggacaggaaagtcatacgggcaacagtatgcggaaagtacgttttttaagtaaaaaacaaaggcaaactttgtactatccagttatctaaggaacaataaaaacattaggaga

SEQ ID NO: 21041 - DNA, 1014 bp, Homo sapiens
gcgcgggggagccattaggaggcgaggagagaggagggcgcagctcccgcccagcccagccctgcccagccctgcccggaggcagacgcgccggaaccgggacgcgataaatatgcagagcggaggcttcgcgcagcagagcccgcgcgccgcccgctccgggtgctgaatccaggcgtggggacacgagccaggcgccgccgccggagccagcggagccggggccagagccggagcgcgtccgcgtccacgcagccgccggccggccagcacccagggccctgcatgccaggtcgttggaggtggcagcgagacatgcacccggcccggaagctcctcagcctcctcttcctcatcctgatgggcactgaactcactcaagtgctgcccaccaaccctgaggagagctggcaggtgtacagctctgcccaggacagcgagggcaggtgtatctgcacagtggtcgctccacagcagaccatgtgttcacgggatgcccgcacaaaacagctgaggcagctactggagaaggtgcagaacatgtctcaatccatagaggtcttggacaggcggacccagagagacttgcagtacgtggagaagatggagaaccaaatgaaaggactggagtccaagttcaaacaggtggaggagagtcataagcaacacctggccaggcagtttaagggctaacttaaaagagttttttcaatgctgcagtgactgaagaagcagtccactcccatgtaaccatgaaagagagccagagagctttttgcaccatgcatttttactattattttccaatacttagcaccatttcactaaggaaccttgaatacaaccaggatcctcctttgcatgcgactgtagctgcatttcatgaatagtttgaacccttgtcaatgcattttttgaaaaagaaagaaaaaaaaaacttcgtgtatgtgactcaaagcatgtaaccttaagatgttgcattctaaactgacaataaagacctttcccaaatat

SEQ ID NO: 21042 - DNA, 2444 bp, Homo sapiens
ggcgggcggcgcgaggcgcagggcgcggcgggcagaggccacctggccaccttccctggcgcccggggaaggcgcggcgatggccggggcgcgcggggcggcggcggcggcgggcgggcggcggcgggccgagggggcgcggggacacagccaggcgcccctgcccgccgcggtgcccgccgcctgaaggccgcctgggcgcgggagccggtgccagctcggagcgggcgctggaggcagctcgaggcgcgatgtcggtgccgctgctcaagatcggggtcgtgctgagcaccatggccatgatcactaactggatgtcccagacgctgccctcgctggtgggcctcaacaccaccaagctctcggcggccggcggcgggacgctggaccgcagcaccggcgtgctgcccaccaaccctgaggagagctggcaggtgtacagctctgcccaggacagcgagggcaggtgtatctgcacagtggtcgctccacagcagaccatgtgttcacgggatgcccgcacaaaacagctgaggcagctactggagaaggtgcagaacatgtctcaatccatagaggtcttggacaggcggacccagagagacttgcagtacgtggagaagatggagaaccaaatgaaaggactggagtccaagttcaaacaggtggaggagagtcataagcaacacctggccaggcagtttaaggcgataaaagcgaaaatggatgaacttaggcctttgatacctgtgttggaagagtacaaggccgatgccaaattggtattgcagtttaaagaggaggtccagaatctgacgtcagtgcttaacgagctgcaagaggaaattggcgcctatgactacgatgaacttcagagcagagtgtccaatcttgaagaaaggctccgtgcatgcatgcaaaaactagcttgcgggaagttgacgggcatcagtgaccccgtgactgtcaagacctccggctcgaggttcggatcctggatgacagaccctctcgcccctgaaggcgataaccgggtgtggtacatggacggctatcacaacaaccgcttcgtacgtgagtacaagtccatggttgacttcatgaacacggacaatttcacctcccaccgtctcccccacccctggtcgggcacggggcaggtggtctacaacggttctatctacttcaacaagttccagagccacatcatcatcaggtttgacctgaagacagagaccatcctcaagacccgcagcctggactatgccggttacaacaacatgtaccactacgcctggggtggccactcggacatcgacctcatggtggacgagagcgggctgtgggccgtgtacgccaccaaccagaacgctggcaacatcgtggtcagtaggctggaccccgtgtccctgcagaccctgcagacctggaacacgagctaccccaagcgcagcgccggggaggccttcatcatctgcggcacgctgtacgtcaccaacggctactcagggggtaccaaggtccactatgcataccagaccaatgcctccacctatgaatacatcgacatcccattccagaacaaatactcccacatctccatgctggactacaaccccaaggaccgggccctgtatgcctggaacaacggccaccagatcctctacaacgtgaccctcttccacgtcatccgctccgacgagttgtagctccctcctcctggaagccaagggcccacgtcctcaccacaaagggactcctgtgaaactgctgccaaaaagataccaataacactaacaataccgatcttgaaaaatcatcagcagtgcggattctgacatcgagggatggcattacctccgtgtttctccctttcgagccggcgggccacagacgtcggaagaaactcccgtatttgcagctggaactgcagcccacggcgccccggttttcctccccgccctgtccctctctggtcaaacaacatactaaagaggcgaggcaatgactgttggccagttctcaccggggaaaaacccactgttaggatggcatgaacatttccttagatcgtggtcagctccgaggaatgtggcgtccaggctctttgagagccatgggctgcacccggccgtaggctagtgtaactcgcatcccattgcagtgccgtttcttgactgtgttgctgtctcttagattaaccgtgctgaggctccacatagctcctggacctgtgtctagtacatactgaagcgatggtcagagtgtgtagagtgaagttgctgtgcccacattgtttgaactcgcgtaccccgtagatacattgtgcaacgttcttctgttattcccttgaggtggtaacttcgtatgttcagtttatgcgatgattgttgtaaatgcaatgccgtagtttggattaataagtggatggtttttgtttctaa

SEQ ID NO: 21043 - DNA, 2492 bp, Homo sapiens
gaatcaccgcggaaaagggctccagtaggcaggacggcgccgtctctctgccggcaacctttgccccaaagcggaccctctgcggggatcggagagggatgccccggcgtgaggatgggagaagccccgggacgggagggccgcgggccgtgcccccagctggagtccccgcgccgccgccgggtgctgcccaccaaccctgaggagagctggcaggtgtacagctctgcccaggacagcgagggcaggtgtatctgcacagtggtcgctccacagcagaccatgtgttcacgggatgcccgcacaaaacagctgaggcagctactggagaaggtgcagaacatgtctcaatccatagaggtcttggacaggcggacccagagagacttgcagtacgtggagaagatggagaaccaaatgaaaggactggagtccaagttcaaacaggtggaggagagtcataagcaacacctggccaggcagtttaaggcgataaaagcgaaaatggatgaacttaggcctttgatacctgtgttggaagagtacaaggccgatgccaaattggtattgcagtttaaagaggaggtccagaatctgacgtcagtgcttaacgagctgcaagaggaaattggcgcctatgactacgatgaacttcagagcagagtgtccaatcttgaagaaaggctccgtgcatgcatgcaaaaactagcttgcgggaagttgacgggcatcagtgaccccgtgactgtcaagacctccggctcgaggttcggatcctggatgacagaccctctcgcccctgaaggcgataaccgggtgtggtacatggacggctatcacaacaaccgcttcgtacgtgagtacaagtccatggttgacttcatgaacacggacaatttcacctcccaccgtctcccccacccctggtcgggcacggggcaggtggtctacaacggttctatctacttcaacaagttccagagccacatcatcatcaggtttgacctgaagacagagaccatcctcaagacccgcagcctggactatgccggttacaacaacatgtaccactacgcctggggtggccactcggacatcgacctcatggtggacgagagcgggctgtgggccgtgtacgccaccaaccagaacgctggcaacatcgtggtcagtaggctggaccccgtgtccctgcagaccctgcagacctggaacacgagctaccccaagcgcagcgccggggaggccttcatcatctgcggcacgctgtacgtcaccaacggctactcagggggtaccaaggtccactatgcataccagaccaatgcctccacctatgaatacatcgacatcccattccagaacaaatactcccacatctccatgctggactacaaccccaaggaccgggccctgtatgcctggaacaacggccaccagatcctctacaacgtgaccctcttccacgtcatccgctccgacgagttgtagctccctcctcctggaagccaagggcccacgtcctcaccacaaagggactcctgtgaaactgctgccaaaaagataccaataacactaacaataccgatcttgaaaaatcatcagcagtgcggattctgacatcgagggatggcattacctccgtgtttctccctttcgagccggcgggccacagacgtcggaagaaactcccgtatttgcagctggaactgcagcccacggcgccccggttttcctccccgccctgtccctctctggtcaaacaacatactaaagaggcgaggcaatgactgttggccagttctcaccggggaaaaacccactgttaggatggcatgaacatttccttagatcgtggtcagctccgaggaatgtggcgtccaggctctttgagagccatgggctgcacccggccgtaggctagtgtaactcgcatcccattgcagtgccgtttcttgactgtgttgctgtctcttagattaaccgtgctgaggctccacatagctcctggacctgtgtctagtacatactgaagcgatggtcagagtgtgtagagtgaagttgctgtgcccacattgtttgaactcgcgtaccccgtagatacattgtgcaacgttcttctgttattcccttgaggtggtaacttcgtatgttcagtttatgcgatgattgttgtaaatgcaatgccgtagtttggattaataagtggatggtttttgtttctaaaaagaaaaaaaaaatcagtgttcacccttatagagacatagtcaagttcatgttgataataatcaaaggaattactctcttcttgttaaattagctaaatcatgtaaccgcagataggaagggctcgcctggggaaactctggtttccgatgggacaggaaagtcatacgggcaacagtatgcggaaagtacgttttttaagtaaaaaacaaaggcaaactttgtactatccagttatctaaggaacaataaaaacattaggagat

SEQ ID NO: 21044 - DNA, 1057 bp, Homo sapiens
ggacggcgcttcccggtggcggcggaggagcccggagggacgcagccgggcaaggcagggcgcagggcgggcggcgcgaggcgcagggcgcggcgggcagaggccacctggccaccttccctggcgcccggggaaggcgcggcgatggccggggcgcgcggggcggcggcggcggcgggcgggcggcggcgggccgagggggcgcggggacacagccaggcgcccctgcccgccgcggtgcccgccgcctgaaggccgcctgggcgcgggagccggtgccagctcggagcgggcgctggaggcagctcgaggcgcgatgtcggtgccgctgctcaagatcggggtcgtgctgagcaccatggccatgatcactaactggatgtcccagacgctgccctcgctggtgggcctcaacaccaccaagctctcggcggccggcggcgggacgctggaccgcagcaccggcgtgctgcccaccaaccctgaggagagctggcaggtgtacagctctgcccaggacagcgagggcaggtgtatctgcacagtggtcgctccacagcagaccatgtgttcacgggatgcccgcacaaaacagctgaggcagctactggagaaggtgcagaacatgtctcaatccatagaggtcttggacaggcggacccagagagacttgcagtacgtggagaagatggagaaccaaatgaaaggactggagtccaagttcaaacaggtggaggagagtcataagcaacacctggccaggcagtttaagggctaacttaaaagagttttttcaatgctgcagtgactgaagaagcagtccactcccatgtaaccatgaaagagagccagagagctttttgcaccatgcatttttactattattttccaatacttagcaccatttcactaaggaaccttgaatacaaccaggatcctcctttgcatgcgactgtagctgcatttcatgaatagtttgaacccttgtcaatgcattttttgaaaaagaaagaaaaaaaaaacttcgtgtatgtgactcaaagcatgtaaccttaag

SEQ ID NO: 21045 - DNA, 2897 bp, Homo sapiens
atggggaaatcaccactgggcactataagaagcccctgggctctctgcagagccagcggctccagctaagaggacaagatgaggcccggcctctcatttctcctagcccttctgttcttccttggccaagctgcaggggatttgggggatgtgggacctccaattcccagccccggcttcagctctttcccaggtgttgactccagctccagcttcagctccagctccaggtcgggctccagctccagccgcagcttaggcagcggaggttctgtgtcccagttgttttccaatttcaccggctccgtggatgaccgtgggacctgccagtgctctgtttccctgccagacaccacctttcccgtggacagagtggaacgcttggaattcacagctcatgttctttctcagaagtttgagaaagaactttccaaagtgagggaatatgtccaattaattagtgtgtatgaaaagaaactgttaaacctaactgtccgaattgacatcatggagaaggataccatttcttacactgaactggacttcgagctgatcaaggtagaagtgaaggagatggaaaaactggtcatacagctgaaggagagttttggtggaagctcagaaattgttgaccagctggaggtggagataagaaatatgactctcttggtagagaagcttgagacactagacaaaaacaatgtccttgccattcgccgagaaatcgtggctctgaagaccaagctgaaagagtgtgaggcctctaaagatcaaaacacccctgtcgtccaccctcctcccactccagggagctgtggtcatggtggtgtggtgaacatcagcaaaccgtctgtggttcagctcaactggagagggttttcttatctatatggtgcttggggtagggattactctccccagcatccaaacaaaggactgtattgggtggcgccattgaatacagatgggagactgttggagtattatagactgtacaacacactggatgatttgctattgtatataaatgctcgagagttgcggatcacctatggccaaggtagtggtacagcagtttacaacaacaacatgtacgtcaacatgtacaacaccgggaatattgccagagttaacctgaccaccaacacgattgctgtgactcaaactctccctaatgctgcctataataaccgcttttcatatgctaatgttgcttggcaagatattgactttgctgtggatgagaatggattgtgggttatttattcaactgaagccagcactggtaacatggtgattagtaaactcaatgacaccacacttcaggtgctaaacacttggtataccaagcagtataaaccatctgcttctaacgccttcatggtatgtggggttctgtatgccacccgtactatgaacaccagaacagaagagattttttactattatgacacaaacacagggaaagagggcaaactagacattgtaatgcataagatgcaggaaaaagtgcagagcattaactataacccttttgaccagaaactttatgtctataacgatggttaccttctgaattatgatctttctgtcttgcagaagccccagtaagctgtttaggagttagggtgaaagagaaaatgtttgttgaaaaaatagtcttctccacttacttagatatctgcaggggtgtctaaaagtgtgttcattttgcagcaatgtttaggtgcatagttctaccacactagagatctaggacatttgtcttgatttggtgagttctcttgggaatcatctgcctcttcaggcgcattttgcaataaagtctgtctagggtgggattgtcagaggtctaggggcactgtgggcctagtgaagcctactgtgaggaggcttcactagaagccttaaattaggaattaaggaacttaaaactcagtatggcgtctagggattctttgtacaggaaatattgcccaatgactagtcctcatccatgtagcaccactaattcttccatgcctggaagaaacctggggacttagttaggtagattaatatctggagctcctcgagggaccaaatctccaacttttttttcccctcactagcacctggaatgatgctttgtatgtggcagataagtaaatttggcatgcttatatattctacatctgtaaagtgctgagttttatggagagaggcctttttatgcattaaattgtacatggcaaataaatcccagaaggatctgtagatgaggcacctgctttttcttttctctcattgtccaccttactaaaagtcagtagaatcttctacctcataacttccttccaaaggcagctcagaagattagaaccagacttactaaccaattccaccccccaccaacccccttctactgcctactttaaaaaaattaatagttttctatggaactgatctaagattagaaaaattaattttctttaatttcattatgaacttttatttacatgactctaagactataagaaaatctgatggcagtgacaaagtgctagcatttattgttatctaataaagaccttggagcatatgtgcaacttatgagtgtatcagttgttgcatgtaatttttgcctttgtttaagcctggaacttgtaagaaaatgaaaatttaatttttttttctaggacgagctatagaaaagctattgagagtatctagttaatcagtgcagtagttggaaaccttgctggtgtatgtgatgtgcttctgtgcttttgaatgactttatcatctagtctttgtctatttttcctttgatgttcaagtcctagtctataggattggcagtttaaatgctttactcccccttttaaaataaatgattaaaatgtgctttgaaaaaa

SEQ ID NO: 21046 - DNA, 492 bp, Homo sapiens
atggcggaggacaggccgcagcagccgcagctggacatgccgctggtcctggaccagggcctgaccaggcagatgcggctacgcgtggagagcctgaagcagcgcggggagaagcgccaggatggggagaagctgctgcagccagcggagtctgtgtaccgcctcaacttcacccagcagcagcggctacagttcgagcgctggaatgtcgtgctggacaagccgggcaaggtcaccatcacaggcacctcgcagaactggacgcctgacctcaccaacctcatgacacgccagctgctggaccccactgccatcttctggcgcaaggaggactcggatgccatagattggaatgaggccgacgccctggagtttggggagcgcctgtcggacctggccaagatccgcaaggtcatgtacttcctcgtcacctttggcgagggtgtggagcccgccaacctcaaggcctccgtggtttttaaccagctctga

SEQ ID NO: 21047 - DNA, 939 bp, Homo sapiens
atggatggaggcaaccagagtgaaggttcagagttccttctcctggggatgtcagagagtcctgagcagcagcggatcctgttttggatgttcctgtccatgtacctggtcacggtggtgggaaatgtgctcatcatcctggccatcagctctgattcccgcctgcacacccccgtgtacttcttcctggccaacctctccttcactgacctcttctttgtcaccaacacaatccccaagatgctggtgaacctccagtcccataacaaagccatctcctatgcagggtgtctgacacagctctacttcctggtctccttggtggccctggacaacctcatcctggctgtgatggcatatgaccgctatgtggccatctgctgccccctccactacaccacagccatgagccctaagctctgtatcttactcctttccttgtgttgggtcctatccgtcctctatggcctcatacacaccctcctcatgaccagagtgaccttctgtgggtcacgaaaaatccactacatcttctgtgagatgtatgtattgctgaggatggcatgttccaacattcagattaatcacacagtgctgattgccacaggctgcttcatcttcctcattccctttggattcgtgatcatttcctatgtgctgattatcagagccatcctcagaataccctcagtctctaagaaatacaaagccttctccacctgtgcctcccatttgggtgcagtctccctcttctatgggacactttgtatggtatacctaaagcccctccatacctactctgtgaaggactcagtagccacagtgatgtatgctgtggtgacacccatgatgaatcccttcatctacagcctgaggaacaaggacatgcatggggctctgggaagactcctagataaacactttaagaggctgacatga

SEQ ID NO: 21048 - DNA, 942 bp, Homo sapiens
atgagcgggacaaaccagtcgagtgtctccgagttcctcctcctgggactctccaggcagccccagcagcagcatctcctctttgtgttcttcctcagcatgtacctggccactgtcctggggaacctgctcatcatcctgtccgtaagcatagactcctgcctgcacacccccatgtacttcttcctcagcaacctgtcttttgtggacatctgcttctccttcaccaccgtccccaagatgctggccaatcacatactcgagactcagaccatctccttctgtggctgtctcacacagatgtatttcgttttcatgttcgtggacatggacaatttcctcctagctgtgatggcctatgaccactttgtcgccgtgtgccaccccttacattacacagcaaagatgacccatcagctctgtgccctgctggttgctggattatgggtggttgccaacctgaatgtccttctgcacaccctgctgatggctccactctcattctgtgcagacaatgccatcactcacttcttctgcgatgtgactcccctactgaaactctcctgctcagacacacacctcaatgaggtcataatccttagtgagggtgccctggtcatgatcaccccatttctttgcatcctggcttcttatatgcacatcacctgcactgtcctgaaggtcccatccacaaagggaaggtggaaagccttctccacctgtggttctcacctggctgtggttctcctcttctacagcaccatcattgctgtgtattttaaccctctgtcctcccactcagctgagaaagacactatggctactgtgttgtatacagtagtgactcccatgctaaaccctttcatctacagcctgaggaacaggtacttgaaaggggctctgaaaaaagtagttggcagggtggtgttttctgtctgatga

SEQ ID NO: 21049 - DNA, 1046 bp, Homo sapiens
gccattcaatcacccaagcaggatgaatcacagcgttgtaactgagttcattattctgggcctcaccaaaaagcctgaactccagggaattatcttcctcttttttctcattgtctatcttgtggcttttctcggcaacatgctcatcatcattgccaaaatctataacaacaccttgcatacgcccatgtatgttttccttctgacactggctgttgtggacatcatctgcacaacaagcatcataccgaagatgctggggaccatgctaacatcagaaaataccatttcatatgcaggctgcatgtcccagctcttcttgttcacatggtctctgggagctgagatggttctcttcaccaccatggcctatgaccgctatgtggccatttgtttccctcttcattacagtactattatgaaccaccatatgtgtgtagccttgctcagcatggtcatggctattgcagtcaccaattcctgggtgcacacagctcttatcatgaggttgactttctgtgggccaaacaccattgaccacttcttctgtgagatacccccattgctggctttgtcctgtagccctgtaagaatcaatgaggtgatggtgtatgttgctgatattaccctggccataggggactttattcttacctgcatctcctatggttttatcattgttgctattctccgtatccgcacagtagaaggcaagaggaaggccttctcaacatgctcatctcatctcacagtggtgaccctttactattctcctgtaatctacacctatatccgccctgcttccagctatacatttgaaagagacaaggtggtagctgcactctatactcttgtgactcccacattaaacccgatggtgtacagcttccagaatagggagatgcaggcaggaattaggaaggtgtttgcatttctgaaacactagtagtttcaacatgcaacatcacttctgtactccagaaccatcttctagagcatctcagattttactggtttttcatacttacctccactccaattttccc

SEQ ID NO: 21050 - DNA, 930 bp, Homo sapiens
atggagaataggaataacatgacagagtttgttttgctggggcttacagagaatccaaagatgcagaaaatcatatttgttgtgttttttgtcatctatatcatcactgtggtgggatatgtgctcattgtggtcaccatcactgccagcccatcactggggtcccccatgtacctttccctggcctatctctcctttattgatgcctgctattcctctgtcaatacccctaacctgatcacacattcactctatggaaagaaggccatcctattcaatggatgcatgactcaagtctttggagaacatttcttcggaggtgcagagggcatcctacttactgtgatggcctatgaccactatgtggccatctgcaagcccttgcactatatgactatcatgaaccagtgtgtgtgtgccctgctaatgggagtggtgtggatgggaggctttcttcatgcaaccatacagatcctcttcatcttccaattacctttctgtggtcctaatgtcatagatcactttatgtgtgatctgaaccctttgctcaacctcgcctgcactgacacccatatgctggaactcttcattgctgccaacagtggattcatctgcttgttaaactttgccctcctgctggtctcctatgtggtcatcttgtgctccctaaggactcatagcttggaggcaaggcacaaagccctctccacctgtgtctcccacatcacggttgtcatcttattctttgtgccctgcatatttgtgtacatgagacctgcagctactttacctattgataaagcagttgctatattctacactatgataactcctatgttaaaccccttaatctataccttgaagaatgcccagatgaaaaatgccatcaggaaattgtgtagtagaaaggacatttcaggtgacaaataa

SEQ ID NO: 21051 - DNA, 1113 bp, Homo sapiens
caacacctcttccccaatttcaactcacaattccattgcaaatgttcctttacctttgcttcatttttcagaggacatgcagtgaggagatggaagaggaaaatgcaacattgctgacagagtttgttctcacaggatttttacatcaacctgactgtaaaataccgctcttcctggcattcttggtaatatatctcatcaccatcatggggaatcttggtctaattgttctcatctggaaagaccctcaccttcatatcccaatgtacttattccttgggagtttagcctttgtggatgcttcgttatcatccacagtgactccgaagatgctgatcaacttcttagctaagagtaagatgatatctctctctgaatgcatggtacaatttttttcccttgtaaccactgtaaccacagaatgttttctcttggcaacaatggcatatgatcgctatgtagccatttgcaaagctttactttatccagtcattatgaccaatgaactatgcattcagctattagtcttgtcatttataggtggccttcttcatgctttaatccatgaagctttttcattcagattaaccttctgtaattccaacataatacaacacttttactgtgacattatcccattgttaaagatttcctgtactgattcctctattaactttctaatggtttttattttcgcaggttctgttcaagtttttaccattggaactattcttatatcttatacaattatcctctttacaatcttagaaaagaagtctatcaaagggatacgaaaagctgtctccacctgtggggctcatctcttatctgtatctttatactatggccccctcaccttcaaatatctgggctctgcatctccgcaagcagatgaccaagatatgatggagtctctattttacactgtcatagttcctttattaaatcccatgatctacagcctgagaaacaagcaagtaatagcttcattcacaaaaatgttcaaaagcaatgtttagatctcatacaatctctcttctctatttactaaaattgtcccaagattgtgcaagttagaggtgtctatgtcttgccagcattcaaagatgatgc

SEQ ID NO: 21052 - DNA, 1066 bp, Homo sapiens
ccaaatttccatgttgccagtgtgttgataattgactgttgcttttttctctcttgtggcagttattttatccccatggaaacaggaaatcaaacacatgcccaagaatttctcctcctgggattttcagcaacgtcagagattcagttcattctctttgggctgttcctctccatgtacctagtcactttcaccgggaacctgctcatcatcctggccatatgctcagactcccacctccacacccccatgtacttcttcctctccaacctgtcttttgctgacctctgttttacctccacgactgtcccaaagatgttactgaatatactgacacagaacaaattcataacatatgcaggctgtctcagtcagattttttttttcacttcatttggatgcctggacaatttactcttgaccgtgatggcctatgaccgcttcgtggccgtctgtcaccccctgcactatacggtcatcatgaacccccagctctgtggactgctggttctggggtcctggtgcatcagtgtcatgggttccctgctcgagaccttgactgttttgaggctgtccttctgcaccgaaatggaaattccacactttttttgtgatctacttgaagtcctgaagctcgcctgttctgacaccttcattaataacgtggtgatatactttgcaactggcgtcctgggtgtgatttccttcactggaatatttttctcttactataaaattgttttctctatactgaggatttcctcagctgggagaaagcacaaagcgttttccacctgtggttcccacctctcagtggtcaccttgttctatggcacgggctttggggtctatctcagttctgcagccacaccatcttctaggacaagtctggtggcctcagtgatgtacaccatggtcacccccatgctgaaccccttcatctacagcctgaggaacacggacatgaagagggccctggggagactcctcagtagggcaacattttttaatggtgacatcactgcaggactttcataagtagcaaggcttggaccattgggaggca

SEQ ID NO: 21053 - DNA, 960 bp, Homo sapiens
atggaaagaggaaaccaaacagaagttggaaactttctcctcctgggattcgcagaggactctgacatgcagcttctcctccatgggctgttcctctccatgtacctggttaccatcatcggaaacctgctcatcatcctgaccatcagttcagactcccacctccacacccccatgtacttcttcctctccaacctgtcctttgctgacatctgtttcacatccacgactgtcccaaagatgctggtgaatatccaaacacaaagcaaaatgatcacttttgcaggctgcctcactcagatattttttttcattgcatttggatgcctggacaatttgctcctgaccatgacggcctatgaccgcttcgtggccatctgttaccccctgcactacacggtcatcatgaacccccggctctgtggactgctggttctggggtcctggtgcatcagtgtcatgggttccttgcttgagaccttgaccattttgaggctgtccttctgcacaaatatggaaattccgcactttttttgtgatccttccgaagtcctgaagctggcctgttctgacaccttcatcaataacatcgtgatgtattttgtgaccattgtcctgggtgtttttcctctctgtggaatcctattctcttattctcagattttctcctccgtcctaagagtatctgccagaggccagcacaaagccttttccacctgtggttcccacctctcagtggtcagcttgttctatggcactggccttggggtctatctcagttctgcagttacaccaccttctaggacaagtctggcagcctcggtgatgtacaccatggtcacccccatgctgaaccccttcatctacagcctgaggaacaaggacatgaaggggtcactggggagactcctcctcagggcaacgtctctcaaagaggggaccattgctaagctctcatga

SEQ ID NO: 21054 - DNA, 1017 bp, Homo sapiens
cctccttccccagcagacacaacagctacatggaagcagaaaaccttacagaattatcaaaatttctcctcctgggactctcagatgatcctgaactgcagcccgtcctctttgggctgttcctgtccatgtacctggtcacggtgctggggaacctgctcatcattctggccgtcagctctgactcccacctccacacccccatgtacttcttcctctccaacctgtcctttgttgacatctgtttcatctccaccacagtccccaagatgctagtgagcatccaggcacggagcaaagacatctcctacatggggtgcctcactcaggtgtattttttaatgatgtttgctggaatggatactttcctactggccgtgatggcctatgaccggtttgtggccatctgccacccactgcactacacggtcatcatgaacccctgcctctgtggcctcctggttctggcatcttggttcatcattttctggttctccctggttcatattctactgatgaagaggttgaccttctccacaggcactgagattccgcatttcttctgtgaaccggctcaggtcctcaaggtggcctgctctaacaccctcctcaataacattgtcttgtatgtggccacggcactgctgggtgtgtttcctgtagctgggatcctcttctcctactctcagattgtctcctccttaatgggaatgtcctccaccaagggcaagtacaaagccttttccacctgtggatctcacctctgtgtggtctccttgttctatggaacaggacttggggtctatctgagttctgctgtgacccattcttcccagagcagctccaccgcctcagtgatgtacgccatggtcacccccatgctgaaccccttcatctacagcctgaggaacaaggatgtgaagggggccctggaaagactcctcagcagggccgactcttgtccatgacaaatcagggcctcagaactaagaggacacactgcgtacccctaaggca

SEQ ID NO: 21055 - DNA, 3262 bp, Homo sapiens
ggatgcttattatagatcgacgcgacaccagcgcccggtgccaggttctcccctgaggcttttcggagcgagctcctcaaatcgcatccagagtaagtgtccccgccccacagcagccgcagcctagatcccagggacagactctcctcaactcggctgtgacccagaatgctccgatacagggggtctggatccctactctgcgggccatttctccagagcgactttgctcttctgtcctccccacactcaccgctgcatctccctcaccaaaagcgagaagtcggagcgacaacagctctttctgcccaagccccagtcagctggtgagctccccgtggtctccagatgcagcacatggactctgggccccgcgccggctctgggtgcatgtgcgtgtgcgtgtgtttgctgcgtggtgtcgatggagataaggtggatccgtttgaggaaccaaatcattagttctctatctagatctccattctccccaaagaaaggccctcacttcccactcgtttattccagcccgggggctcagttttcccacacctaactgaaagcccgaagcctctagaatgccacccgcaccccgagggtcaccaacgctccctgaaataacctgttgcatgagagcagaggggagatagagagagcttaattataggtacccgcgtgcagctaaaaggagggccagagatagtagcgagggggacgaggagccacgggccacctgtgccgggaccccgcgctgtggtactgcggtgcaggcgggagcagcttttctgtctctcactgactcactctctctctctctccctctctctctctctcattctctctcttttctcctcctctcctggaagttttcgggtccgagggaaggaggaccctgcgaaagctgcgacgactatcttcccctggggccatggactcggacgccagcctggtgtccagccgcccgtcgtcgccagagcccgatgacctttttctgccggcccggagtaagggcagcagcggcagcgccttcactgggggcaccgtgtcctcgtccaccccgagtgactgcccgccggagctgagcgccgagctgcgcggcgctatgggctctgcgggcgcgcatcctggggacaagctaggaggcagtggcttcaagtcatcctcgtccagcacctcgtcgtctacgtcgtcggcggctgcgtcgtccaccaagaaggacaagaagcaaatgacagagccggagctgcagcagctgcgtctcaagatcaacagccgcgagcgcaagcgcatgcacgacctcaacatcgccatggatggcctccgcgaggtcatgccgtacgcacacggcccttcggtgcgcaagctttccaagatcgccacgctgctgctggcgcgcaactacatcctcatgctcaccaactcgctggaggagatgaagcgactggtgagcgagatctacgggggccaccacgctggcttccacccgtcggcctgcggcggcctggcgcactccgcgcccctgcccgccgccaccgcgcacccggcagcagcagcgcacgccgcacatcaccccgcggtgcaccaccccatcctgccgcccgccgccgcagcggctgctgccgccgctgcagccgcggctgtgtccagcgcctctctgcccggatccgggctgccgtcggtcggctccatccgtccaccgcacggcctactcaagtctccgtctgctgccgcggccgccccgctggggggcgggggcggcggcagtggggcgagcgggggcttccagcactggggcggcatgccctgcccctgcagcatgtgccaggtgccgccgccgcaccaccacgtgtcggctatgggcgccggcagcctgccgcgcctcacctccgacgccaagtgagccgactggcgccggcgcgttctggcgacaggggagccaggggccgcggggaagcgaggactggcctgcgctgggctcgggagctctgtcgcgaggaggggcgcaggaccatggactgggggtggggcatggtggggattccagcatctgcgaacccaagcaatgggggcgcccacagagcagtggggagtgaggggatgttctctccgggacctgatcgagcgctgtctggctttaacctgagctggtccagtagacatcgttttatgaaaaggtaccgctgtgtgcattcctcactagaactcatccgacccccgacccccacctccgggaaaagattctaaaaacttctttccctgagagcgtggcctgacttgcagactcggcttgggcagcacttcggggggggagggggtgttatgggagggggacacattggggccttgctcctcttcctcctttcttggcgggtgggagactccgggtagccgcactgcagaagcaacagcccgaccgcgccctccagggtcgtccctggcccaaggccaggggccacaagttagttggaagccggcgttcggtatcagaagcgctgatggtcatatccaatctcaatatctgggtcaatccacaccctcttagaactgtggccgttcctccctgtctctcgttgatttgggagaatatggttttctaataaatctgtggatgttccttcttcaacagtatgagcaagtttatagacattcagagtagaaccacttgtggattggaataacccaaaactgccgatttcaggggcgggtgcattgtagttattattttaaaatagaaactaccccaccgactcatctttccttctctaagcacaaagtgatttggttattttggtacctgagaacgtaacagaattaaaaggcagttgctgtggaaacagtttgggttatttgggggttctgttggctttttaaaattttcttttttggatgtgtaaatttatcaatgatgaggtaagtgcgcaatgctaagctgtttgctcacgtgactgccagccccatcggagtctaagccggctttcctctattttggtttatttttgccacgtttaacacaaatggtaaactcctccacgtgcttcctgcgttccgtgcaagccgcctcggcgctgcctgcgttgcaaactgggctttgtagcgtctgccgtgtaacacccttcctctgatcgcaccgcccctcgcagagagtgtatcatctgttttatttttgtaaaaacaaagtgctaaataatatttattacttgtttggttgcaaaaacggaataaatgactgagtgttgagattttaaataaaatttaaagtaaa

SEQ ID NO: 21056 - DNA, 2578 bp, Homo sapiens
gcacattgttccccgcccccgcccccgccaccgctgccgccgtcgccgctgccaccgggctataaaaaccggccgagcccctaaaggtgcggatgcttattatagatcgacgcgacaccagcgcccggtgccaggttctcccctgaggcttttcggagcgagctcctcaaatcgcatccagattttcgggtccgagggaaggaggaccctgcgaaagctgcgacgactatcttcccctggggccatggactcggacgccagcctggtgtccagccgcccgtcgtcgccagagcccgatgacctttttctgccggcccggagtaagggcagcagcggcagcgccttcactgggggcaccgtgtcctcgtccaccccgagtgactgcccgccggagctgagcgccgagctgcgcggcgctatgggctctgcgggcgcgcatcctggggacaagctaggaggcagtggcttcaagtcatcctcgtccagcacctcgtcgtctacgtcgtcggcggctgcgtcgtccaccaagaaggacaagaagcaaatgacagagccggagctgcagcagctgcgtctcaagatcaacagccgcgagcgcaagcgcatgcacgacctcaacatcgccatggatggcctccgcgaggtcatgccgtacgcacacggcccttcggtgcgcaagctttccaagatcgccacgctgctgctggcgcgcaactacatcctcatgctcaccaactcgctggaggagatgaagcgactggtgagcgagatctacgggggccaccacgctggcttccacccgtcggcctgcggcggcctggcgcactccgcgcccctgcccgccgccaccgcgcacccggcagcagcagcgcacgccgcacatcaccccgcggtgcaccaccccatcctgccgcccgccgccgcagcggctgctgccgccgctgcagccgcggctgtgtccagcgcctctctgcccggatccgggctgccgtcggtcggctccatccgtccaccgcacggcctactcaagtctccgtctgctgccgcggccgccccgctggggggcgggggcggcggcagtggggcgagcgggggcttccagcactggggcggcatgccctgcccctgcagcatgtgccaggtgccgccgccgcaccaccacgtgtcggctatgggcgccggcagcctgccgcgcctcacctccgacgccaagtgagccgactggcgccggcgcgttctggcgacaggggagccaggggccgcggggaagcgaggactggcctgcgctgggctcgggagctctgtcgcgaggaggggcgcaggaccatggactgggggtggggcatggtggggattccagcatctgcgaacccaagcaatgggggcgcccacagagcagtggggagtgaggggatgttctctccgggacctgatcgagcgctgtctggctttaacctgagctggtccagtagacatcgttttatgaaaaggtaccgctgtgtgcattcctcactagaactcatccgacccccgacccccacctccgggaaaagattctaaaaacttctttccctgagagcgtggcctgacttgcagactcggcttgggcagcacttcggggggggagggggtgttatgggagggggacacattggggccttgctcctcttcctcctttcttggcgggtgggagactccgggtagccgcactgcagaagcaacagcccgaccgcgccctccagggtcgtccctggcccaaggccaggggccacaagttagttggaagccggcgttcggtatcagaagcgctgatggtcatatccaatctcaatatctgggtcaatccacaccctcttagaactgtggccgttcctccctgtctctcgttgatttgggagaatatggttttctaataaatctgtggatgttccttcttcaacagtatgagcaagtttatagacattcagagtagaaccacttgtggattggaataacccaaaactgccgatttcaggggcgggtgcattgtagttattattttaaaatagaaactaccccaccgactcatctttccttctctaagcacaaagtgatttggttattttggtacctgagaacgtaacagaattaaaaggcagttgctgtggaaacagtttgggttatttgggggttctgttggctttttaaaattttcttttttggatgtgtaaatttatcaatgatgaggtaagtgcgcaatgctaagctgtttgctcacgtgactgccagccccatcggagtctaagccggctttcctctattttggtttatttttgccacgtttaacacaaatggtaaactcctccacgtgcttcctgcgttccgtgcaagccgcctcggcgctgcctgcgttgcaaactgggctttgtagcgtctgccgtgtaacacccttcctctgatcgcaccgcccctcgcagagagtgtatcatctgttttatttttgtaaaaacaaagtgctaaataatatttattacttgtttggttgcaaaaacggaataaatgactgagtgttgagattttaaataaaatttaaagtaaa

SEQ ID NO: 21057 - DNA, 575 bp, Homo sapiens
ggatgcttattatagatcgacgcgacaccagcgcccggtgccaggttctcccctgaggcttttcggagcgagctcctcaaatcgcatccagagtaagtgtccccgccccacagcagccgcagcctagatcccagggacagactctcctcaactcggctgtgacccagaatgctccgatacagggggtctggatccctactctgcgggccatttctccagagcgactttgctcttctgtcctccccacactcaccgctgcatctccctcaccaaaagcgagaagtcggagcgacaacagctctttctgcccaagccccagtcagctgttttcgggtccgagggaaggaggaccctgcgaaagctgcgacgactatcttcccctggggccatggactcggacgccagcctggtgtccagccgcccgtcgtcgccagagcccgatgacctttttctgccggcccggagtaagggcagcagcggcagcgccttcactgggggcaccgtgtcctcgtccaccccgagtgactgcccgccggagctgagcgccgagctgcgcggcgctatgggctctgcgg

SEQ ID NO: 21058 - DNA, 1867 bp, Homo sapiens
gcagtcctcctatgtggtactgatcaggtggttgcagagcttcagctcacagcaacacaatgcagctgagcaggcaagcacagcccacagccagaaacagttccgactctacagaacaagacgacctttaagtttcccagagaaaatgagatgctgatgttgaagacgacaccacggctttgatggaatatcagatattgaaaatgtctctctgcctgttcatccttctgtttctcacacctggtattttatgcatttgtcctctccaatgtatatgcacagagaggcacaggcatgtggactgttcaggcagaaacttgtctacattaccatctggactgcaagagaatattatacatttaaacctgtcttataaccactttactgatctgcataaccagttaacccaatataccaatctgaggaccctggacatttcaaacaacaggcttgaaagcctgcctgctcacttacctcggtctctgtggaacatgtctgctgctaacaacaacattaaacttcttgacaaatctgatactgcttatcagtggaatcttaaatatctggatgtttctaagaacatgctggaaaaggttgtcctcattaaaaatacactaagaagtctcgaggttctcaacctcagtagtaacaaactttggacagttccaaccaacatgccctccaaactacatatcgtggacctgtctaataattctttgacacaaattcttccaggtacattaataaacctgacaaatctcacacatctttacctgcacaacaataagttcacattcattccagaccaatcttttgaccaactctttcagttgcaagagataaccctttacaataacaggtggtcatgtgaccacaaacaaaacattacttacttactgaagtggatgatggaaacaaaagcccatgtgatagggactccatgttctacccaaatatcatctttaaaggaacataacatgtatcccacaccttctggatttacctcaagcttattcactgtaagtgggatgcagacagtggacaccattaactctctgagtgtggtaactcaacccaaagtgaccaaaatacccaaacaatatcgaacaaaggaaacaacgtttggtgccactctaagcaaagacaccacctttactagcactgataaggcttttgtgccctatccagaagatacatccacagagactatcaattcacatgaagcagcagctgcaactctaactattcatctccaagatggaatggtcacaaacacaagcctcactagctcaacaaaatcatccccaacacccatgaccctaagtatcactagtggcatgccaaataatttctctgaaatgcctcaacaaagcacaacccttaacttatggagggaagagacaaccacaaatgtaaagactccattaccttctgtggcaaatgcttggaaagtaaatgcttcatttctcttattgctcaatgttgtggtcatgctggctgtctgagggtctgcattttctgaaactaatgaaagcactcctccctgatgtacagttgggaaaatatgtccatatctaaccagtgattcgagctatatttaagtattcaagaaagccagtcttaacatttctaactctgatgtaaatgaagtaacttgtcttaaataaaagaaatgcacaatgtcttggtacttgctgctattttactgtcttaattaagtaaactaatgagtttcttttataaaaaaaatgaaatgttttaaggcttcaatttattgcacaaaatataaagcatctaaactttaatatgtattttatgtatgtttacactgtcaaacatctggaaaataaaaggtctatgctcataa

SEQ ID NO: 21059 - DNA, 2196 bp, Homo sapiens
agttcaagcacacaccaactagctgtccaggaagcagcctaaccagagagaggggcgtgggagggagagaggcggggaaaagcagcgtctccgcttttcttctcacgtcttgccgcggagaagtgggttcctgggcagtgcagattttttttttttaattcaagattttctttaatttcccgcctaaagcctccccacggtagggccgcatcccctgtaataaaatgaattctgattcgagctctgtctccagcagagcttcatctccggacatggatgagatgtacctgagggaccaccaccaccgccaccaccaccaccaggagagccgtctcaactcggtctcgtccacgcagggcgatatgatgcagaagatgcccggggaaagcctctcgcgggctggcgccaaggccgcgggagagagcagcaagtacaaaatcaagaagcagctgtcggagcaggacctacagcagttgaggctgaagatcaacggacgcgaacgcaagcggatgcacgacctgaacctagccatggacgggctgcgcgaagtcatgccctacgcgcatgggccgtcggtgcgcaagctctccaagatcgccacactcctgctcgccagaaactacatcctcatgctcaccagctccctggaggagatgaagaggctggttggcgagatctatgggggccaccactcggcctttcactgcgggaccgtgggccactcggccggccaccccgcgcacgcggccaactccgtgcacccggtgcaccccatcttgggcggcgcgctctcatctggcaacgcctcgtcaccgctgtccgccgcctcacttcccgccatcggcaccatccggcctccccactcgctactcaaggcgccctccacgccgcccgcgctgcagctgggcagcggcttccagcactgggctggtctgccctgcccctgcaccatctgccagatgccgccgccgccgcacctgtccgctctctccacagccaacatggcccggctgtcggccgagtccaaggacttgctcaagtgagcagcgggcgggcccggctgccaaggaggagggagagcggcgggaggggccgcggtgccgggccgggagggaagagggaggctgcacgctcggcccacgggagggcaggctccggggcccgcagcctcccacgctgtctgagagatctcagactccacttgacccccggagggaaaggaccaaaatcaaaccgcaatttctaggtggtagcaaagggggactcgaaccagatgtcgtgtgttttgcatgcatgcttcttttccccatgccgcgccagtatttttcactgccatatgctcttgtcaaaactgcatttgttgtataaagatgggatcggtgtagttaaaaacttgcgaagggacttttgagttggctttctctgactctgtgttctcgctttggaaaaagacggccatcccttttgtgcaaaacaaatgtaaatattttcttgagatggatgcgattatgattgtctctgtccttgccacagtttttctagagacaatggagagagaaagagagagagagcgcgagagagatcaagacccaagttttgaatctcaaccgaggtccagggcatgacacctcctatgtgggttttcctttcgacgcagtgtaggtcaaaagaatgcatgcacgcttctaaatgaatcttgtctgaatatgtcgtgcaggctgtggtgccgttttccttgtaacaaggatttattagtgaattatcccaagtactccatatatctgtctgtggttgtatgaaatgaaaaaaggggcagagtgcaaagacccacactcacgcacacgcgcttcttctcccacccccacccccttcaaactttattcggaaccttcctttgctgttctggggccgctattgtaaaagcctgggctccctctagtagcttgcgccaccccccctcgctcagttattctgcatgcggggttggctctctctattatcagctttgaaaacttatcctggttttgggaggggtgccgtttttattttcctgaacatttgcttgaaatattttgttagggcctcaaagacgatacctgtctttattttttatatattcttgataactatgatatatttattaataaccagtgtttctggatgagatttcaaataaaaaagaacctttaaatcgtg

SEQ ID NO: 21060 - DNA, 843 bp, Homo sapiens
ccttcccggagcccgggacaggctgggcgcgcgcccgtgtgagtgagcgggactcagggcagaagtgtcccctcactgcgtttttttttccttttatccaaagaacggggcagttagtacgcttgccttcctgtcgcccggttgggagcggggttggtgtgcggagtggttcgcctttttttctttagaacttgacgcgtgaccaaaaccaaagacggccatgaagtgagatcgtgcaaagtagcagataaaacgggcagcatcactatttccgtgtgggatgagatcggaggtcttatacagccaggggatattattcggttgaccagagggtatgcatccatgtggaaaggatgtctgacactttatactggaaggggtggtgaacttcaaaaaattggggaattttgtatggtttattcagaagtgccaaatttcagtgaacccaacccagattatcgaggacagcagaacaaaggggcacagagtgaacagaagaataattccatgaatagtaatatgggtacaggtacatttggaccagtgggaaatggtgttcacactggccctgaatcaagggaacaccagttttcacatgctggcagaagcaatggccggggacttataaatccacaactacaaggaacagctagtaatcaaacagtgatgaccacaataagtaatggcagggaccctcggagagcctttaaaagatgacctatgctaaatactcatgtgtagtttttatactacatgccctacttgaacacttattgcacttttatttattgttaactgtgaaaagtacgtcctttattgggtttccttttatattcttggttt

SEQ ID NO: 21061 - DNA, 3387 bp, Homo sapiens
agtcgctgtttgggacgctgggtgtgcggtgttctgtctccgctcccgtttcgctgtcacagcccgttccttcccggagcccgggacaggctgggcgcgcgcccgtgacgcgtgaccaaaaccaaagacggccatgaagtgagatcgtgcaaagtagcagataaaacgggcagcatcactatttccgtgtgggatgagatcggaggtcttatacagccaggggatattattcggttgaccagagggtatgcatccatgtggaaaggatgtctgacactttatactggaaggggtggtgaacttcaaaaaattggggaattttgtatggtttattcagaagtgccaaatttcagtgaacccaacccagattatcgaggacagcagaacaaaggggcacagagtgaacagaagaataattccatgaatagtaatatgggtacaggtacatttggaccagtgggaaatggtgttcacactggccctgaatcaagggaacaccagttttcacatgctggcagaagcaatggccggggacttataaatccacaactacaaggaacagctagtaatcaaacagtgatgaccacaataagtaatggcagggaccctcggagagcctttaaaagatgacctatgctaaatactcatgtgtagtttttatactacatgccctacttgaacacttattgcacttttatttattgttaactgtgaaaagtacgtcctttattgggtttccttttatattcttggtttgttaagaagaatggtttgtttttatagcaaaactgttaagctgctcgagtctcctgttgaagaatgggaacactgaaaagtaggggcatttatttttagagtaaaaagattattggatagcctttaaaaaacctgcacccatttcatgggtgagttacttaagacatcagctttatagcctctatgagtctatcttctgtataagttttgtaatatttaacataaggcttaatgggagatgttcttttgtcttgtattcagatattgccaactaaagcaataaccatcaaaaaacacaagaacttgtcaatgctagcagtaatttttgagtgtttgtggctctcggaatgattgacttcgttcagtgactactattaagattttccaaggactgactcatcccaaatttttgttgtattaccaaaaaaacagattccttatcagaatttggaatagaatgtgatctctattgcaacaagtaattttaaaagaaagctacatttattttagagtagtgctcctaacatgtattatcaactttgtggattacattggaggaaaatttaaaactggggccttgaatatttattttttgaaactaccatgttaaatactgaagtataatttgggggagttataaagttatgataaacattcatctgattattttaaacaatagttgtggtagataaacatactggaggtgagtcaaattgaattcatatagtaacatgcagtctgaagtcctagttacttaataggtactcagcctggagtgaaaatcctgggtactgactttgagaggagtgagtgtgcatgttgtcaaagtttctgaacacagttcacatagccttattagcaaaagttttaagaaatggctctatcaaagaagcaattgcagctttattcagaaatataaaagtggaatttatgtacatgtcataagtggtacccacttcccctttttactgtagggtggataactcttaggatttaactctttgaatattatctcttgaataaagcatgtgttaatgttaacaaacctacgtaatttttgccctttcaatgacttacagtggagagccagtacatcttaactactgttgtagtgatggtatcaacctcatggttacttagctctgcatttgttgctttgttttttttccacttcaaatcacaaaataagtagattttgttttctgaaaactccatagcatttgaatacaaaaagttgtgccagattgtttgccctaattcactgtgtttaacaaatatttcagtacacactatgtattaggcactgtgtggaaagtgttaaggggtagacaaaataccgaataatctccacaagtttatttgtggtctatagtacttttgtaactggggttacaaaaattatagaaatttttttcctttgttcatatgcatattcatgattataatttggctttgtttgtgattaatgttttcttaagattttcacattatagaatacctcaaaagaagttgtctaaggactgggatagagagtatgtttcataaaattgtagatgtttagaatttttaaaaaccctacaaattagtatatgattgttttatataagtaagataggagcaacactttaaattatttgtgggagaatacagcattaaaggtgattttaaaagaaaaaaatttggaattttagaaaatttaaatgctgtcaggtatggaatgctgggcttccaatcctggcctcattgtctcctcacctgtgatgttggatgagttattacacttgaaatgtctttaagccttaggttccacaagtatgaaaacaagtaagtaacagtatcctttctagacttgtttaagatttccatgtaagtaattataatgacttctgacacataataatgtcgtcttataccccaacagtaggaaaaaaatgcagaattcagtatgaaagtattgttaccctttaacacagtggtccccaacctttttggcaccagagaccagtctcctggaagacagtttttccgtgggatcgggggatggttttgggatgaaactgttccacctcaggtcatcagtcattagttagattctcataaggagcgtgcaacctcaatcccttgcatactcatttcacaatagggttcatgctcctatgagaatctaatgccaccactcatctgacaggaggtggagctcaggcagtaagtctccctcgcccgccactcacctgctgggcgttcctgttcctagcaggccagaattgatactgatctaggggttggggacccctgcttaacatgttgagattaaatggagaaagacttaagcttttacttttgtgattgacacttgcttcaataatgtaaccttgttctgtgtttttatcatttattaacaaatttcttttttcttaagggaagcctccaaaatcaaagaaaagtgagttacaatccataatgaatatttgccttaccagcctactggaacacattcatcaagaacttaagaggaagaaagttttctgccttcctccttcctagtgctctcagctatcaactttgaaataagtttaaacaacacctactgaaaacaaaaaccacttagtataaaaatatcccccaccagaa

SEQ ID NO: 21062 - DNA, 1878 bp, Homo sapiens
cgcccctgtcccgggagggtgggaagctttgaccccgccctgcccactcgcgtctccgcagccgtagccgcgcctgtcccaatatgaatagggtcaacgacccacttatttttataagagatattaagcccggactgaaaaacttaaatgtcgtctttattgtcctggagataggacgcgtgaccaaaaccaaagacggccatgaagtgagatcgtgcaaagtagcagataaaacgggcagcatcactatttccgtgtgggatgagatcggaggtcttatacagccaggggatattattcggttgaccagagggtatgcatccatgtggaaaggatgtctgacactttatactggaaggggtggtgaacttcaaaaaattggggaattttgtatggtttattcagaagtgccaaatttcagtgaacccaacccagattatcgaggacagcagaacaaaggggcacagagtgaacagaagaataattccatgaatagtaatatgggtacaggtacatttggaccagtgggaaatggtgttcacactggccctgaatcaagggaacaccagttttcacatgctggcagaagcaatggccggggacttataaatccacaactacaaggaacagctagtaatcaaacagtgatgaccacaataagtaatggcagggaccctcggagagcctttaaaagatgacctatgctaaatactcatgtgtagtttttatactacatgccctacttgaacacttattgcacttttatttattgttaactgtgaaaagtacgtcctttattgggtttccttttatattcttggtttgttaagaagaatggtttgtttttatagcaaaactgttaagctgctcgagtctcctgttgaagaatgggaacactgaaaagtaggggcatttatttttagagtaaaaagattattggatagcctttaaaaaacctgcacccatttcatgggtgagttacttaagacatcagctttatagcctctatgagtctatcttctgtataagttttgtaatatttaacataaggcttaatgggagatgttcttttgtcttgtattcagatattgccaactaaagcaataaccatcaaaaaacacaagaacttgtcaatgctagcagtaatttttgagtgtttgtggctctcggaatgattgacttcgttcagtgactactattaagattttccaaggactgactcatcccaaatttttgttgtattaccaaaaaaacagattccttatcagaatttggaatagaatgtgatctctattgcaacaagtaattttaaaagaaagctacatttattttagagtagtgctcctaacatgtattatcaactttgtggattacattggaggaaaatttaaaactggggccttgaatatttattttttgaaactaccatgttaaatactgaagtataatttgggggagttataaagttatgataaacattcatctgattattttaaacaatagttgtggtagataaacatactggaggtgagtcaaattgaattcatatagtaacatgcagtctgaagtcctagttacttaataggtactcagcctggagtgaaaatcctgggtactgactttgagaggagtgagtgtgcatgttgtcaaagtttctgaacacagttcacatagccttattagcaaaagttttaagaaatggctctatcaaagaagcaattgcagctttattcagaaatataaaagtggaatttatgtacatgtcataagtggtacccacttcccctttttactgtagggtggataactcttaggatttaactctttgaatattatctcttgaataaagcatgtgttaatgttaacaaacctacgtaa

SEQ ID NO: 21063 - DNA, 1417 bp, Homo sapiens
aacttccgggaatgtccgcactcccgcgttccacggggcagcatccggcggcagcggagcctgtggctccccctgcgggctgctcagcggcgtgcacagtcctgccggctggcttggtggggtgccgaggctcaggcagcatgacgacggagacctttgtgaaggatatcaagcctgggctcaagaatctgaaccttatcttcattgtgctggagacaggccgagtgaccaagacaaaggacgggcatgaggttcggacctgcaaagtggcggacaaaacaggcagcatcaatatctctgtctgggacgatgttggcaatctgatccagcctggggacattatccggctcaccaaagggtacgcttcagttttcaaaggttgtctgacactatatactggccgtgggggtgatctgcagaagattggagaattctgtatggtttattctgaggttcctaacttcagtgagccaaacccagagtacagcacccagcaggcacccaacaaggcggtgcagaacgacagcaacccttcagcttcccagcctaccactggaccctctgctgcctctccagcctctgagaaccagaatgggaatggactgagtgccccaccaggtcccggtggtggcccacatccccctcatactccctcccacccacccagcacccgaatcactcgaagccagcccaaccacacacctgcaggcccgcctggcccttccagcaaccctgttagtaacggcaaagaaacccggaggagcagcaagagatagcatgacattctttcttcctgccaccaaccacatcccaagtgtcccctggagagcaagatagccttccactgattggctggtgtagcagtattttagccactgaacttcagtggagggtggtgagcagtgtccttatccaccctaatctcatactccctcattgtccagctgaactacctgtcccctgggagtcaggaccctctgcctgctctctttcctctttagaaatggcagttactggctgggcgcagtggctcacgcttgtaatcccagcactttgggaagccgaggtgggcggatcacctgaggtcgggagttcaagaccagcctgaccaacatggagaaaccccgtgtctactaaaaatacagaattagccaggcatggtggcgtatgcctgtaatcccagctacttaggaggctgaggcaggagaatctcttgaaaccgggaggcggaggttgaggtgagccgaaattgcaccattgcactccagcctgggcaataagagcgaaactccatctcaaaaaaaaaagaaagaaagaaagaaagaaagaaagaaatggcagttaccatctgtttcttctgtgtgagacatgggagtctaactgaagtctctccttcctaataaatgttaccactcta

SEQ ID NO: 21064 - DNA, 1411 bp, Homo sapiens
gggctgctcagcggcgtgcacagtcctgccggctggcttgggtgggtggtgggctgcgggtaggggaggggatggaccgagtcccggcttgtcgggatgagggttccggaagatctggccatggggtgccgaggctcaggcagcatgacgacggagacctttgtgaaggatatcaagcctgggctcaagaatctgaaccttatcttcattgtgctggagacaggccgagtgaccaagacaaaggacgggcatgaggttcggacctgcaaagtggcggacaaaacaggcagcatcaatatctctgtctgggacgatgttggcaatctgatccagcctggggacattatccggctcaccaaagggtacgcttcagttttcaaaggttgtctgacactatatactggccgtgggggtgatctgcagaagattggagaattctgtatggtttattctgaggttcctaacttcagtgagccaaacccagagtacagcacccagcaggcacccaacaaggcggtgcagaacgacagcaacccttcagcttcccagcctaccactggaccctctgctgcctctccagcctctgagaaccagaatgggaatggactgagtgccccaccaggtcccggtggtggcccacatccccctcatactccctcccacccacccagcacccgaatcactcgaagccagcccaaccacacacctgcaggcccgcctggcccttccagcaaccctgttagtaacggcaaagaaacccggaggagcagcaagagatagcatgacattctttcttcctgccaccaaccacatcccaagtgtcccctggagagcaagatagccttccactgattggctggtgtagcagtattttagccactgaacttcagtggagggtggtgagcagtgtccttatccaccctaatctcatactccctcattgtccagctgaactacctgtcccctgggagtcaggaccctctgcctgctctctttcctctttagaaatggcagttactggctgggcgcagtggctcacgcttgtaatcccagcactttgggaagccgaggtgggcggatcacctgaggtcgggagttcaagaccagcctgaccaacatggagaaaccccgtgtctactaaaaatacagaattagccaggcatggtggcgtatgcctgtaatcccagctacttaggaggctgaggcaggagaatctcttgaaaccgggaggcggaggttgaggtgagccgaaattgcaccattgcactccagcctgggcaataagagcgaaactccatctcaaaaaaaaaagaaagaaagaaagaaagaaagaaagaaatggcagttaccatctgtttcttctgtgtgagacatgggagtctaactgaagtctctccttcctaataaatgt

SEQ ID NO: 21065 - DNA, 1775 bp, Homo sapiens
ggggcagcatccggcggcagcggagcctgtggctccccctgcgggctgctcagcggcgtgcacagtcctgccggctggcttgggtgggtggtgggctgcgggtaggggaggggatggaccgagtcccggcttgtcgggatgagggttccggaagatctggccagtaagattctactccctggctgtgcaccgggttccctacccctgtctacgtcggctccgccacttcgcggcttgagactaaaagagcatcccggcagggggccttccagccccaaagcagcctgtccagagacccccaaattctgatcctgaagttggaggcctccggggatgttcttttttaatcttttagaagggttagaggggttgaggctgcctgaccccagcctaatggggtaggtaggccttgggaagtggagcatgggggcaaaggatccaagcattgagccttcatcctctattccccatccagtggggtgccgaggctcaggcagcatgacgacggagacctttgtgaaggatatcaagcctgggctcaagaatctgaaccttatcttcattgtgctggagacaggccgagtgaccaagacaaaggacgggcatgaggttcggacctgcaaagtggcggacaaaacaggcagcatcaatatctctgtctgggacgatgttggcaatctgatccagcctggggacattatccggctcaccaaagggtacgcttcagttttcaaaggttgtctgacactatatactggccgtgggggtgatctgcagaagattggagaattctgtatggtttattctgaggttcctaacttcagtgagccaaacccagagtacagcacccagcaggcacccaacaaggcggtgcagaacgacagcaacccttcagcttcccagcctaccactggaccctctgctgcctctccagcctctgagaaccagaatgggaatggactgagtgccccaccaggtcccggtggtggcccacatccccctcatactccctcccacccacccagcacccgaatcactcgaagccagcccaaccacacacctgcaggcccgcctggcccttccagcaaccctgttagtaacggcaaagaaacccggaggagcagcaagagatagcatgacattctttcttcctgccaccaaccacatcccaagtgtcccctggagagcaagatagccttccactgattggctggtgtagcagtattttagccactgaacttcagtggagggtggtgagcagtgtccttatccaccctaatctcatactccctcattgtccagctgaactacctgtcccctgggagtcaggaccctctgcctgctctctttcctctttagaaatggcagttactggctgggcgcagtggctcacgcttgtaatcccagcactttgggaagccgaggtgggcggatcacctgaggtcgggagttcaagaccagcctgaccaacatggagaaaccccgtgtctactaaaaatacagaattagccaggcatggtggcgtatgcctgtaatcccagctacttaggaggctgaggcaggagaatctcttgaaaccgggaggcggaggttgaggtgagccgaaattgcaccattgcactccagcctgggcaataagagcgaaactccatctcaaaaaaaaaagaaagaaagaaagaaagaaagaaagaaatggcagttaccatctgtttcttctgtgtgagacatgggagtctaactgaagtctctccttcctaataaatgttaccactcta

SEQ ID NO: 21066 - DNA, 663 bp, Homo sapiens
agccaggagctgcctacgaggagggacgaaggctggccaggcctccactctagacaggaagtctagtctagagtctatatggtcccagccaggactatgtagccatttaggagggagaactctatgttcttcccggcaaaaacgtgtgggcctggccggccacgcttcgctttggaggggtgcagtggggtgccgaggctcaggcagcatgacgacggagacctttgtgaaggatatcaagcctgggctcaagaatctgaaccttatcttcattgtgctggagacaggccgagtgaccaagacaaaggacgggcatgaggttcggacctgcaaagtggcggacaaaacaggcagcatcaatatctctgtctgggacgatgttggcaatctgatccagcctggggacattatccggctcaccaaagggtacgcttcagttttcaaaggttgtctgacactatatactggccgtgggggtgatctgcagaagattggagaattctgtatggtttattctgaggttcctaacttcagtgagccaaacccagagtacagcacccagcaggcacccaacaaggcggtgcagaacgacagcaacccttcagcttcccagcctaccactggaccctctgctgcctctccagcctctgagaaccagaatgg

SEQ ID NO: 21067 - DNA, 770 bp, Homo sapiens
agccaggagctgcctacgaggagggacgaaggctggccaggcctccactctagacaggaagtctagtctagagtctatatggtcccagccaggactatgtagccatttaggagggagaactctatgttcttcccggcaaaaacgtgtgggcctggccggccacgcttcgctttggaggggtgcaggttccatttcttccaagaagggtgagcctgccttttgtctctggtgtaaatgccacttttcccagagaccttgaccaagctgggtagtgcattaaagatgagaaccccaaatcaggaacaaagataacgtggggtgccgaggctcaggcagcatgacgacggagacctttgtgaaggatatcaagcctgggctcaagaatctgaaccttatcttcattgtgctggagacaggccgagtgaccaagacaaaggacgggcatgaggttcggacctgcaaagtggcggacaaaacaggcagcatcaatatctctgtctgggacgatgttggcaatctgatccagcctggggacattatccggctcaccaaagggtacgcttcagttttcaaaggttgtctgacactatatactggccgtgggggtgatctgcagaagattggagaattctgtatggtttattctgaggttcctaacttcagtgagccaaacccagagtacagcacccagcaggcacccaacaaggcggtgcagaacgacagcaacccttcagcttcccagcctaccactggaccctctgctgcctctc

SEQ ID NO: 21068 - DNA, 7879 bp, Homo sapiens
tgtgcgtcgcgctctcgccctcctcttcccgctgcagtgtctatggagcgaggctacgtttcattgccgccctggcttaacccttccggcgcctaaaaggacggccggccggccggctcccttgcaccaggaagaagtcttagcagccagcgggccctggtcaggaaactctaaggtacaaggaaaacagttgaggaaggagccagagcgctccggtttggtcctcgggcttcgctggggcggggcgcaggcgttggctttaagaaaggggaggggacagtgcaatccgggttgcccgcggagttcggccaaggaagtcttccgctcgctccggagcgaggagcctgtagagaggctgttcccagctccagctctaacctcgcctacaccttgggcgggcccaagtgtcacgtttgcaattgctcaggaaggatccggcccgtctccggaggcaagtcgggctgcggtttttgctgcttatctgggaaggcgatgcctaagggacatgctgcttgctaggcagcaccctgccgggatccgactgcgatagttagctctccctggccctgaagccatcgccggggcgcctgttctctgtccggaccagccagcgctcctcaggagtctcactgaaacagaaccatgggtcatcccccgctggagttcagcgactgctacctggacagccccgatttccgcgagaggctcaagtgttatgagcaggaactggagaggaccaacaaattcatcaaagacgtaatcaaagacggcaacgcgcttatcagcgctatgagaaattattcttctgctgttcagaaattttcccagacgctgcagtcatttcagtttgatttcattggagacactctgactgatgatgaaattaacatcgctgaatccttcaaggaatttgctgaattgctcaacgaggtagaaaatgagaggatgatgatggtacacaatgctagtgatttgctgattaaacccttggaaaatttccggaaggaacaaataggcttcaccaaggagcggaaaaagaaatttgaaaaggatggtgagaggttttattctttactggatcggcacttacacctgtcttcaaaaaagaaagaatctcagttacaagaggcagacctacaggtggacaaggagaggcacaattttttcgagtcctctcttgattatgtttatcaaatccaggaagttcaggagtccaagaagttcaatattgtggagcctgtcttggcctttcttcatagtctgttcatttctaacagcctgactgtggagctcacacaggatttcctcccatacaaacaacagctccaactcagtttacagaatacaagaaatcatttctccagtacccgggaagagatggaagaacttaagaaaaggatgaaagaagctccccagacatgcaaacttccaggacagccaactattgaaggctatctctatacacaagagaaatgggctttaggaatatcctgggtgaaatactattgccagtatgagaaagagaccaaaacactgaccatgacgcctatggagcagaagccaggtgctaagcaggggcccttggacttaacactgaagtactgtgtgagaaggaagacggagtctatcgacaagaggttctgttttgacatagaaactaatgaaaggccaggaaccatcactctgcaggccctttcagaagctaacagaaggctatggatggaagccatggatgggaaagaacctatctaccacagccctataacaaaacagcaagaaatggagctaaatgaagtgggcttcaagtttgtcaggaagtgcatcaatattattgagaccaaagggatcaagacagaagggttgtaccgcactgtgggcagcaatattcaggttcagaagctgctgaatgccttttttgatcctaaatgcccaggagatgttgattttcataatagtgactgggacattaagacaatcaccagctccttgaaattctacctcaggaatctttctgaacctgtcatgacctatagacttcacaaagagctggtctctgctgccaagtctgacaacctggattaccgcctaggagctattcactccctggtatataagctaccagaaaagaaccgagagatgctggaacttctgataagacacttggtcaatgtgtgtgagcacagcaaagagaatcttatgaccccctccaacatgggagtaatctttgggcccaccctgatgagagctcaggaggacactgtggccgccatgatgaacatcaaattccagaacatagtggtggaaatactaatcgagcactttggcaagatctatttaggtccacctgaggaaagcgctgcaccgccagtgcctccgcctcgggtgacagcaagaaggcacaaaccaatcacgatttcaaagcgcttgctgcgagaaaggacggttttctatacttcttccctggatgaaagcgaagatgaaatccaacatcaaacaccgaatggtactatcaccagcagcatagaaccccccaagccaccacaacaccccaaactacctattcagaggagtggggaaactgatcctgggaggaagtccccaagcaggcctattttggatggcaagttggagccctgcccagaggtggacgtggggaagttggtgtctaggctgcaggatggagggaccaagatcaccccaaaggccaccaatggacccatgccaggctctgggcccaccaagaccccctctttccacataaagagaccagctccccggcccctggcccaccacaaggagggggatgctgacagtttcagcaaagtgcggcctccaggagaaaagccaaccatcatccgccccccagtgaggcccccagatcctccctgccgggcagctactccccaaaagccagaaccaaagccagatattgtggctggcaatgcgggggaaatcacatcatctgtggtggcttccaggaccaggttttttgaaacagcttcccggaaaacaggaagttctcaaggcagacttcctggagatgaaagttgaggctacaggttttaaaagccttggcctcagaggaccctttccaggttctgaaagagtctttcttcttcaaacctttgtgtgcggagtcattttgtgttgaagagcagctccttcctagccttgcactttcagactctctctgggaggccataaaataaggagcatatgtcctagacaggtgtttatatctcctttgtattctgtcttcatcccctcagaaggtctgttttgagttcctataacactgtgaagagctggactccctcaagccagactctgccaaaaccaagatatccacttacctgagttgaagaggggagctcagttttcaactcttccctgaacttcctgcttcctcagagggccattgaactctgagagatttggggctaaagactgatctcaggggtcttaccttgaactgaaggccacttgagttggggccattgcttaccttggttggaagggaatagaaatgtttgctgaacattggagaatctcaacatgtctcctactgaggatatggacactggtgccatgtcagcgctctggtgctgcagtatgttgccaagagcccgtctgctcctgcgaggctatgagtgggatgagtgatgcccccacagcacctccatgtggacttaggaaggtggccttcctgctgttacatgcagccacttaggacaaatctgcaaagcatgttttgcatgtaaaagcctaggtctatttggattattctttctccttttttttgacagcttcctgtcaagcaatcaagaaacaaacaaaagctgaacacatttctttttaaaaaaaggagactgtgtttggtcctgtaggagttctattttggggtcaaatgctagaaaaattgttaaggtggattgaggccaggcagctgtcactgctgcttcatgtttgccttctgcacataaactcttttatctcctgaaaaaagcagttcttaacccagtgtccatggactcagaaactccatgatgcccctgagatggtatgcacaattccatgacaatatgccctttctggggagatagtccataatgttctgctaaatttcaaatgggctcgtgacccaaaaaagtcaagaaccacagcacttgagtaaaatactctttttacaatccatataagcccttgattggaagggcttttcaaaatcatttagtctaacaactgcccagtttccagtcgggggaactgaggcagagcaaggtagtgatcacaccagtacaagatctcaggtcccaggctcctatgcaagttttttttccccattatatcacacttatctagcaagggaccttgtggtttgtggctttagtggccatcatttctgggggttggcttttaccctttttcttgaatatttgccaccaagtgaaaaatgttaggacataaacccttgccaggtccctttcatttgctatctctattattggaaaggacctaaaaattggtgtaatggggcagaaatctgaggaatggacatttctaattcctgtttgttgaagggaagttgctggaaagagcatcagtacttgtttctatgcagatgcctgggccgtagcttgtctgtagcgtctgtataattataatgttgcccagtgtgagggaaagagctttcctacttgcactcttctaccaaggccctgttagtgcactgattatagtactgacagataaacctagataaagagatagagagtgagtacatgcacactcatgtgcaaacccactcagagatgcatttggaacagtgctactgaaaggcagtagtcattttcaagactgaattccaaacatggtttattggtgagttaggaacatgtaaggccaagtacactgagagcctttttgaaagtaattgagtggaaacttgatgccattctaaatcaaggcatatccaggtggcccggttgaactcactccactgtacccagtctcaaaggccaggttgctaagaaaccaggagtaaaagagtcaagtgaccatcatttcacctgctgcttgcccccaatagtagtctctgtgaggccttactgacctcacctaggaagtgatttttgagcccttgtttcagggctgtggcctccctgctctatcctgaataaagcagacaggtgtgcagattttggccatgaaagcatggctaatagggccacagtccctttaaagaaacatggtttgactctggttttcttgggggaaaataccacaatcaccgatgcaaacattggaagattattgagagccctagaaagctgctgtgatcccagtagaaaatatgtcccagaaatgtcatgagattgctgtgtgttgcctgggacacagatcaagggcctatcttggagagctggggaccagcagtctgcctggaggccagggagcagtggctgagtagctctgcctttgctctggtctataccttaagaatgccaaagaatgaatttcaacgcctgcctttggcactctgacttaaagtgcaaaaagcttctgtggcgaggcatgctatcatggaatgagactggcttgccctaggcttaatggatgggcagtcattttgcagaggctatgggaagagggtgataatagaagagtggcagctataggaaattatcaacataccttggccagcaagttagagaatctggcaatggatgaactgaaagtgatgaactggcagggataacaaagaacctaacatttattaagcacgtatttattaactgctcagtgtttcatattcatgcaagtattctcattttacagagaaagaaattatggcccagggggctaaagtaaacaactcaagggcacatagaaagtaaataaaaggactgtgatttgaatccaggccactcttagcccatgctgttttccctttgccacactgtggtaggtgtttgaacagaggccacattactagagttggcatgactcttgactcttgcctgcctaacaaaatattgaaaggcaaacatttgaaggagggagggggtgcaggttcagtttatatggaaatgcaaactgggctggaagatattcctgagttaggctttctcttcatattcagcttgcacatttggtaatgtttttaagatgatcatctaattttattttgtgaagtgaaggatttgtgttttagttggcagttgttaagtccttggcttgccatttttcaaaaagtaaaaaggtcctcacaggtgtctccatacttcgccaaggttgtagcatgggcagtttcagtttcagcctaagagactggtgacatccacaaatgcagttttagaagcagaaaaggtcttggtgcctctgcagtacttgatgtattggggtcaaatctctacaaatttttctgtggtgatagcaaaatcaagagatggcttacaaaaagaaatattgaatttttatttttgaagtttttgttttttaaaaggttgggggtgttcagccactgagggacaaaacttagcatctaatttcaattatagtgtcatgcagagtatttctaaagtaattggttatcatgggaaagtattctcttttcaagaagttctttgattctgtaataactagaacaaataaagtagtaaaagaagaaatagttctgtgactaggaaaaaattgcttttgagagaacatagatcaattatactacttctaaggtagctgcagataagtggccttgacacattacaagcctggaaaaaaacatcagaaataataaaaaatttcagagagaatcaagatacctttttttttcttttttttttcttttttttattatactctaagttttagggtacatgtgcacattgtgcaggttagttacatatgtatacatgtgccatgctggtgcgctgcacccactaatgtgtcatctagcattaggtatatctcccagtgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtccaaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcgaaggacaagataccttaaagataagttttcgataaagaaaagccttcattttcctgggggaaatgaagcacttgatgccaaggacattagtagagggctagaaagattgcctgtgtgaaagacatatgctatatccaaataataaaacaaacgagatcctggggctcattcatgtgactttcaataaagtatgtagactgtctaatataa

SEQ ID NO: 21069 - DNA, 2959 bp, Homo sapiens
agtgcaatccgggttgcccgcggagttcggccaaggaagtcttccgctcgctccggagcgaggagcctgtagagaggctgttcccagctccagctctaacctcgcctacaccttgggcgggcccaagtgtcacgtttgcaattgctcaggaaggatccggcccgtctccggaggcaagtcgggctgcggtttttgctgcttatctgggaaggcgatgcctaagggacatgctgcttgctaggcagcaccctgccgggatccgactgcgatagttagctctccctggccctgaagccatcgccggggcgcctgttctctgtccggaccagccagcgctcctcaggagtctcactgaaacagaaccatgggtcatcccccgctggagttcagcgactgctacctggacagccccgatttccgcgagaggctcaagtgttatgagcaggaactggagaggaccaacaaattcatcaaagacgtaatcaaagacggcaacgcgcttatcagcgctatgagaaattattcttctgctgttcagaaattttcccagacgctgcagtcatttcagtttgatttcattggagacactctgactgatgatgaaattaacatcgctgaatccttcaaggaatttgctgaattgctcaacgaggtagaaaatgagaggatgatgatggtacacaatgctagtgatttgctgattaaacccttggaaaatttccggaaggaacaaataggcttcaccaaggagcggaaaaagaaatttgaaaaggatggtgagaggttttattctttactggatcggcacttacacctgtcttcaaaaaagaaagaatctcagttacaagaggcagacctacaggtggacaaggagaggcacaattttttcgagtcctctcttgattatgtttatcaaatccaggaagttcaggagtccaagaagttcaatattgtggagcctgtcttggcctttcttcatagtctgttcatttctaacagcctgactgtggagctcacacaggatttcctcccatacaaacaacagctccaactcagtttacagaatacaagaaatcatttctccagtacccgggaagagatggaagaacttaagaaaaggatgaaagaagctccccagacatgcaaacttccaggacagccaactattgaaggctatctctatacacaagagaaatgggctttaggaatatcctgggtgaaatactattgccagtatgagaaagagaccaaaacactgaccatgacgcctatggagcagaagccaggtgctaagcaggggcccttggacttaacactgaagtactgtgtgagaaggaagacggagtctatcgacaagaggttctgttttgacatagaaactaatgaaaggccaggaaccatcactctgcaggccctttcagaagctaacagaaggctatggatggaagccatggatgggaaagaacctatctaccacagccctataacaaaacagcaagaaatggagctaaatgaagtgggcttcaagtttgtcaggaagtgcatcaatattattgagaccaaagggatcaagacagaagggttgtaccgcactgtgggcagcaatattcaggttcagaagctgctgaatgccttttttgatcctaaatgcccaggagatgttgattttcataatagtgactgggacattaagacaatcaccagctccttgaaattctacctcaggaatctttctgaacctgtcatgacctatagacttcacaaagagctggtctctgctgccaagtctgacaacctggattaccgcctaggagctattcactccctggtatataagctaccagaaaagaaccgagagatgctggaacttctgataagacacttggtcaatgtgtgtgagcacagcaaagagaatcttatgaccccctccaacatgggagtaatctttgggcccaccctgatgagagctcaggaggacactgtggccgccatgatgaacatcaaattccagaacatagtggtggaaatactaatcgagcactttggcaagatctatttaggtccacctgaggaaagcgctgcaccgccagtgcctccgcctcgggtgacagcaagaaggcacaaaccaatcacgatttcaaagcgcttgctgcgagaaaggacggttttctatacttcttccctggatgaaagcgaaggggatgctgacagtttcagcaaagtgcggcctccaggagaaaagccaaccatcatccgccccccagtgaggcccccagatcctccctgccgggcagctactccccaaaagccagaaccaaagccagatattgtggctggcaatgcgggggaaatcacatcatctgtggtggcttccaggaccaggttttttgaaacagcttcccggaaaacaggaagttctcaaggcagacttcctggagatgaaagttgaggctacaggttttaaaagccttggcctcagaggaccctttccaggttctgaaagagtctttcttcttcaaacctttgtgtgcggagtcattttgtgttgaagagcagctccttcctagccttgcactttcagactctctctgggaggccataaaataaggagcatatgtcctagacaggtgtttatatctcctttgtattctgtcttcatcccctcagaaggtctgttttgagttcctataacactgtgaagagctggactccctcaagccagactctgccaaaaccaagatatccacttacctgagttgaagaggggagctcagttttcaactcttccctgaacttcctgcttcctcagagggccattgaactctgagagatttggggctaaagactgatctcaggggtcttaccttgaactgaaggccacttgagttggggccattgcttaccttggttggaagggaatagaaatgtttgctgaacattggagaatctcaacatgtct

SEQ ID NO: 21070 - DNA, 582 bp, Homo sapiens
ataatgcgtctttgttgaaacaagggagctttgttctttacttctgggctctctcagtgattttaacaggaatccagaggcagcagcacacttctcagtaccacaaggaaggtggatgggaataggtttccagctggaagtttatctagtctgacaacctggattaccgcctaggagctattcactccctggtatataagctaccagaaaagaaccgagagatgctggaacttctgataagacacttggtcaatgtgtgtgagcacagcaaagagaatcttatgaccccctccaacatgggagtaatctttgggcccaccctgatgagagctcaggaggacactgtggccgccatgatgaacatcaaattccagaacatagtggtggaaatactaatcgagcactttggcaagatatcttccttctttctccacagatctatttaggtccacctgaggaaagcgctgcaccgccagtgcctccgcctcgggtgacagcaagaaggcacaaaccaatcacgatttcaaagcgcttgctgcgagaaaggacggttttctatacttcttccctggatgaaagcga

SEQ ID NO: 21071 - DNA, 3310 bp, Homo sapiens
tagatggtcaattagagttcccagggtttgaagcctgtaactgctgccgccgctcaagccctccagagcattgctacggctgctgcccttgtactactacctccaaatacgttcttgctggtagtggcggcagcaggaccaattacctcttttttgctctccctcgagaagctccagatggcgtcttccgtgggcaacgtggccgacagcacagggttagctgagttggcacatcgagaatatcaggcaggagattttgaggcagctgagagacactgcatgcagctctggagacaagagccagacaatactggtgtgcttttattactttcatctatacacttccagtgtcgaaggctggacagatctgctcactttagcactctggcaattaaacagaacccccttctggcagaagcttattcgaatttggggaatgtgtacaaggaaagagggcagttgcaggaggcaattgagcattatcgacatgcattgcgtctcaaacctgatttcatcgatggttatattaacctggcagccgccttggtagcagcgggtgacatggaaggggcagtacaagcttacgtctctgctcttcagtacaatcctgatttgtactgtgttcgcagtgacctggggaacctgctcaaagccctgggtcgcttggaagaagccaaggcatgttatttgaaagcaattgagacgcaaccgaactttgcagtagcttggagtaatcttggctgtgttttcaatgcacaaggggaaatttggcttgcaattcatcactttgaaaaggctgtcacccttgacccaaactttctggatgcttatatcaatttaggaaatgtcttgaaagaggcacgcatttttgacagagctgtggcagcttatcttcgtgccctaagtttgagtccaaatcacgcagtggtgcacggcaacctggcttgtgtatactatgagcaaggcctgatagatctggcaatagacacctacaggcgggctatcgaactacaaccacatttccctgatgcttactgcaacctagccaatgctctcaaagagaagggcagtgttgctgaagcagaagattgttataatacagctctccgtctgtgtcccacccatgcagactctctgaataacctagccaatatcaaacgagaacagggaaacattgaagaggcagttcgcttgtatcgtaaagcattagaagtcttcccagagtttgctgctgcccattcaaatttagcaagtgtactgcagcagcagggaaaactgcaggaagctctgatgcattataaggaggctattcgaatcagtcctacctttgctgatgcctactctaatatgggaaacactctaaaggagatgcaggatgttcagggagccttgcagtgttatacgcgtgccatccaaattaatcctgcatttgcagatgcacatagcaatctggcttccattcataaggattcagggaatattccagaagccatagcttcttaccgcacggctctgaaacttaagcctgattttcctgatgcttattgtaacttggctcattgcctgcagattgtctgtgattggacagactatgatgagcgaatgaagaagttggtcagtattgtggctgaccagttagagaagaataggttgccttctgtgcatcctcatcatagtatgctatatcctctttctcatggcttcaggaaggctattgctgagaggcacggcaacctgtgcttagataagattaatgttcttcataaaccaccatatgaacatccaaaagacttgaagctcagtgatggtcggctgcgtgtaggatatgtgagttccgactttgggaatcatcctacttctcaccttatgcagtctattccaggcatgcacaatcctgataaatttgaggtgttctgttatgccctgagcccagacgatggcacaaacttccgagtgaaggtgatggcagaagccaatcatttcattgatctttctcagattccatgcaatggaaaagcagctgatcgcatccatcaggatggaattcatatccttgtaaatatgaatggctatactaagggcgctcgaaatgagctttttgctctcaggccagctcctattcaggcaatgtggctgggataccctgggacgagtggtgcgcttttcatggattatattatcactgatcaggaaacttcgccagctgaagttgctgagcagtattccgagaaattggcttatatgccccacactttttttattggtgatcatgctaatatgttccctcacctgaagaaaaaagcagtcatcgattttaagtccaatgggcacatttatgacaatcggatagttctgaatggcatcgacctcaaagcatttcttgatagtctaccagatgtgaaaattgtcaagatgaagtgtcctgatggaggagacaatgcagatagcagtaacacagctcttaatatgcctgttattcctatgaatactattgcagaagcagttattgaaatgattaaccgaggacagattcaaataacaattaatggattcagtattagcaatggactggcaactactcagatcaacaataaggctgcaactggagaggaggttccccgtaccattattgtaaccacccgttctcagtacgggttaccagaagatgccatcgtatactgtaactttaatcagttgtataaaattgacccttctactttgcagatgtgggcaaacattctgaagcgtgttcccaatagtgtactctggctgttgcgttttccagcagtaggagaacctaatattcaacagtatgcacaaaacatgggcctgccccagaaccgtatcattttttcacctgttgctcctaaagaggaacacgtcaggagaggccagctggctgatgtctgcttggacactccactctgtaatgggcacaccacagggatggatgtcctctgggcagggacccccatggtgactatgccaggagagactcttgcttctcgagttgcagcatcccagctcacttgcttaggttgtcttgagcttattgctaaaaacagacaagaatatgaagacatagctgtgaagctgggaactgatctagaatacctgaagaaagttcgtggcaaagtctggaagcaaagaatatctagccctctgttcaacaccaaacaatacacaatggaactagagcggctctatctacagatgtgggagcattatgcagctggcaacaaacctgaccacatgattaagcctgttgaagtcactgagtcagcataaataaagactgcacaggagaatt

SEQ ID NO: 21072 - DNA, 5461 bp, Homo sapiens
ggccgaggagccgtcgccgccatttcaagaccgtactaggtagatggtcaattagagttcccagggtttgaagcctgtaactgctgccgccgctcaagccctccagagcattgctacggctgctgcccttgtactactacctccaaatacgttcttgctggtagtggcggcagcaggaccaattacctcttttttgctctccctcgagaagctccagatggcgtcttccgtgggcaacgtggccgacagcacagaaccaacgaaacgtatgctttccttccaagggttagctgagttggcacatcgagaatatcaggcaggagattttgaggcagctgagagacactgcatgcagctctggagacaagagccagacaatactggtgtgcttttattactttcatctatacacttccagtgtcgaaggctggacagatctgctcactttagcactctggcaattaaacagaacccccttctggcagaagcttattcgaatttggggaatgtgtacaaggaaagagggcagttgcaggaggcaattgagcattatcgacatgcattgcgtctcaaacctgatttcatcgatggttatattaacctggcagccgccttggtagcagcgggtgacatggaaggggcagtacaagcttacgtctctgctcttcagtacaatcctgatttgtactgtgttcgcagtgacctggggaacctgctcaaagccctgggtcgcttggaagaagccaaggcatgttatttgaaagcaattgagacgcaaccgaactttgcagtagcttggagtaatcttggctgtgttttcaatgcacaaggggaaatttggcttgcaattcatcactttgaaaaggctgtcacccttgacccaaactttctggatgcttatatcaatttaggaaatgtcttgaaagaggcacgcatttttgacagagctgtggcagcttatcttcgtgccctaagtttgagtccaaatcacgcagtggtgcacggcaacctggcttgtgtatactatgagcaaggcctgatagatctggcaatagacacctacaggcgggctatcgaactacaaccacatttccctgatgcttactgcaacctagccaatgctctcaaagagaagggcagtgttgctgaagcagaagattgttataatacagctctccgtctgtgtcccacccatgcagactctctgaataacctagccaatatcaaacgagaacagggaaacattgaagaggcagttcgcttgtatcgtaaagcattagaagtcttcccagagtttgctgctgcccattcaaatttagcaagtgtactgcagcagcagggaaaactgcaggaagctctgatgcattataaggaggctattcgaatcagtcctacctttgctgatgcctactctaatatgggaaacactctaaaggagatgcaggatgttcagggagccttgcagtgttatacgcgtgccatccaaattaatcctgcatttgcagatgcacatagcaatctggcttccattcataaggattcagggaatattccagaagccatagcttcttaccgcacggctctgaaacttaagcctgattttcctgatgcttattgtaacttggctcattgcctgcagattgtctgtgattggacagactatgatgagcgaatgaagaagttggtcagtattgtggctgaccagttagagaagaataggttgccttctgtgcatcctcatcatagtatgctatatcctctttctcatggcttcaggaaggctattgctgagaggcacggcaacctgtgcttagataagattaatgttcttcataaaccaccatatgaacatccaaaagacttgaagctcagtgatggtcggctgcgtgtaggatatgtgagttccgactttgggaatcatcctacttctcaccttatgcagtctattccaggcatgcacaatcctgataaatttgaggtgttctgttatgccctgagcccagacgatggcacaaacttccgagtgaaggtgatggcagaagccaatcatttcattgatctttctcagattccatgcaatggaaaagcagctgatcgcatccatcaggatggaattcatatccttgtaaatatgaatggctatactaagggcgctcgaaatgagctttttgctctcaggccagctcctattcaggcaatgtggctgggataccctgggacgagtggtgcgcttttcatggattatattatcactgatcaggaaacttcgccagctgaagttgctgagcagtattccgagaaattggcttatatgccccacactttttttattggtgatcatgctaatatgttccctcacctgaagaaaaaagcagtcatcgattttaagtccaatgggcacatttatgacaatcggatagttctgaatggcatcgacctcaaagcatttcttgatagtctaccagatgtgaaaattgtcaagatgaagtgtcctgatggaggagacaatgcagatagcagtaacacagctcttaatatgcctgttattcctatgaatactattgcagaagcagttattgaaatgattaaccgaggacagattcaaataacaattaatggattcagtattagcaatggactggcaactactcagatcaacaataaggctgcaactggagaggaggttccccgtaccattattgtaaccacccgttctcagtacgggttaccagaagatgccatcgtatactgtaactttaatcagttgtataaaattgacccttctactttgcagatgtgggcaaacattctgaagcgtgttcccaatagtgtactctggctgttgcgttttccagcagtaggagaacctaatattcaacagtatgcacaaaacatgggcctgccccagaaccgtatcattttttcacctgttgctcctaaagaggaacacgtcaggagaggccagctggctgatgtctgcttggacactccactctgtaatgggcacaccacagggatggatgtcctctgggcagggacccccatggtgactatgccaggagagactcttgcttctcgagttgcagcatcccagctcacttgcttaggttgtcttgagcttattgctaaaaacagacaagaatatgaagacatagctgtgaagctgggaactgatctagaatacctgaagaaagttcgtggcaaagtctggaagcaaagaatatctagccctctgttcaacaccaaacaatacacaatggaactagagcggctctatctacagatgtgggagcattatgcagctggcaacaaacctgaccacatgattaagcctgttgaagtcactgagtcagcataaataaagactgcacaggagaattacccctatacctgagcctcaaccttctgggggaaagggaactagataacatacttcttacttgtctgtacagtaccttgttgcagatgggtgatatataatggtaatagaatagcacagccagacttgcttcctgcatggtagggagagacacaaaagatgggaaactgcttttccacaaggaatctccgtagaattttgcggcgaccagatggtgcataggtctggaaggtctgatctcccttggtcttccatgggatggttagtgtggaggggagatatagattgtccggccgctttgtgattccatggattgattcagtcttctggatttttttttctttatattttgggtactggagcttttaaaaatgtttggtttcaggtatttttattcatgtgaagtgtatatgattctcttgagataaggttttaagctaaaatgttactccctgttttagtttctgaactctgacagattgacagggactttgctggtgtagtctttttataggttttataaaccacttgagcctatatcagtcgttttagtgtctgacctaatatttggagctatcagtgctttgttgatttagatgatgactcaagattttttctggtccatttcccatttccttttcttccctgacccccataccctcacccttaaaattctcctgtaactcaactaacaaaatcaagcctgattcaaaacatcctagggtgttttaaacacaccatctggtgccaaatgaagatttttaggagtgattactaattatcaagggcacagttgtggtactgtcattgataataatatagtttttttttttttcctaattttgacctgtttcaccagtgttttacccttgactgccccttctatgctgcttccaaaagtgatagtgtgtgtaagatttttaccttcctttctaaagttttttttttttttttttaagtgagtcctgttcttcctatttctttcagcagaaatgaaatcccaggtaagtataagtattcaagtatttgatcagtaagtcacagttatctccagtgcattaaataaccttcatcaagaaataggttataggtaaaatctctgaaggatcatctatgtattcaagtaattattttttagataataactgtcttctggacttggtcttgaagtctgtacagattcagcctcagtagtagcgaactgcactgctgtttggtttggagtacaaattagacttatagtcctcctggaacttgagttattaaaatcataggaataaaattatgggatctcaacaaagggtcgagggtttgaggcttaaacaagccaacatatgaatatatgttttgtctcgctatactgcacttacgctatccagttgcaggtaattttttgtctgctagtagtgttctagattatgtctttccaaagcgctgaggctgtgcacctattctgtagttgcagctgatgcctgaatgtatcctagctgacaaattattgattaataagaacttgaatttctggaagattcttactgttaaccaaattttgagcaaggagtctcaaaggtaattctgaaccagaattacatgttaatgaacagtgtaccttttaacagtgtaaatcacggaatatccgtgaagggatttcttaatttattttttaccggttgattgaaatatcagttaaaggttgccagcatggttgcagataaactgatgtttgaaattcgctgaaatacttaatgtggaataggataatatacttccaatgccctcaaggctgtgaccttacagccattttacatagcacatcattcctcctatagggatgaactttttcctggcacgaaaagtagccgctctggttgaagctttgcttattgtaacaggcttttatttccaggtaatatgtcttggaagacttaattctgattagagatatagatattactggaaactaattgttttttttctattgtactctgctttatcaaagaagtaaaacatttaaatcgtactacagaaattaagatgttgtcttgcgatccttaataaatgaatgatttccctttaatacgg

SEQ ID NO: 21073 - DNA, 695 bp, Homo sapiens
cagtgggcctgggaagatgtgtttcccctggatgtgcacattcctgtttgtggcttatcgcctctcatttattctgtgtgagtaggtagaaaatgagcatcacggacgtgctcagtgctgacgacattgcagcagcgctccaggaatgccgagacccagacacttttgaaccccaaaaattcttccagacatcaggcctctccaagatgtcagccaatcaggtgaaggatgttttccggttcatagacaacgaccagagcgggtacctggatgaagaagagcttaagtttttcctccagaagtttgagagtggtgccagagaactgaccgagtcagaaaccaagtccttgatggctgcggcggataatgatggagatgggaaaattggagcagaggaattccaggaaatggtgcattcttaaaagccccagtctctggagaaaagagagaaagggataatcacctggaaggattccaaagccctgggaatggggaaccccacatcccatccctacctaatttgttaattttccctgaaaaccttctgcagtttgctcattgttttagtgaggtcacgagggagtcactcctgactttcttggtggtgggtatatgccctgacaacttctgtaagccccccttcccccaacaggcaatgcctctaaaaatcacccaataaagacaggcttctcatc

SEQ ID NO: 21074 - DNA, 623 bp, Homo sapiens
ggaaatctaagaggttgtaactatcactttttctagcctatataaggtaggtcagtaaggtagcaaaaacacatctgttgttttgctccttcaactctttttcctgattcttcctggggggaaaccgaaaacggtgaaaaatgagcatcacggacgtgctcagtgctgacgacattgcagcagcgctccaggaatgccgagacccagacacttttgaaccccaaaaattcttccagacatcaggcctctccaagatgtcagccaatcaggtgaaggatgttttccggttcatagacaacgaccagagcgggtacctggatgaagaagagcttaagtttttcctccagaagtttgagagtggtgccagagaactgaccgagtcagaaaccaagtccttgatggctgcggcggataatgatggagatgggaaaattggagcagaggaattccaggaaatggtgcattcttaaaagccccagtctctggagaaaagagagaaagggataatcacctggaaggattccaaagccctgggaatggggaaccccacatcccatccctacctaatttgttaattttccctgaaaaccttctgcagtttgctcattgttttagtgaggtca

SEQ ID NO: 21075 - DNA, 2365 bp, Homo sapiens
aaagcagtgcttctctctggggccaaggccagagctgtggacaccttatcccactcatcctcatcctcttcctctgataaagcccctaccagtgctgataaagtctttctcgtgagagcctagaggccttaaaaaaaaaagtgcttgaaagagaaggggacaaaggaacaccagtattaagaggattttccagtgtttctggcagttggtccagaaggatgcctccattcctgcttctcacctgcctcttcatcacaggcacctccgtgtcacccgtggccctagatccttgttctgcttacatcagcctgaatgagccctggaggaacactgaccaccagttggatgagtctcaaggtcctcctctatgtgacaaccatgtgaatggggagtggtaccacttcacgggcatggcgggagatgccatgcctaccttctgcataccagaaaaccactgtggaacccacgcacctgtctggctcaatggcagccaccccctagaaggcgacggcattgtgcaacgccaggcttgtgccagcttcaatgggaactgctgtctctggaacaccacggtggaagtcaaggcttgccctggaggctactatgtgtatcgtctgaccaagcccagcgtctgcttccacgtctactgtggtcatttttatgacatctgcgacgaggactgccatggcagctgctcagataccagcgagtgcacatgcgctccaggaactgtgctaggccctgacaggcagacatgctttgatgaaaatgaatgtgagcaaaacaacggtggctgcagtgagatctgtgtgaacctcaaaaactcctaccgctgtgagtgtggggttggccgtgtgctaagaagtgatggcaagacttgtgaagacgttgaaggatgccacaataacaatggtggctgcagccactcttgccttggatctgagaaaggctaccagtgtgaatgtccccggggcctggtgctgtctgaggataaccacacttgccaagtccctgtgttgtgcaaatcaaatgccattgaagtgaacatccccagggagctggttggtggcctggagctcttcctgaccaacacctcctgccgaggagtgtccaacggcacccatgtcaacatcctcttctctctcaagacatgtggtacagtggtcgatgtggtgaatgacaagattgtggccagcaacctcgtgacaggtctacccaagcagaccccggggagcagcggggacttcatcatccgaaccagcaagctgctgatcccggtgacctgcgagtttccacgcctgtacaccatttctgaaggatacgttcccaaccttcgaaactccccactggaaatcatgagccgaaatcatgggatcttcccattcactctggagatcttcaaggacaatgagtttgaagagccttaccgggaagctctgcccaccctcaagcttcgtgactccctctactttggcattgagcccgtggtgcacgtgagcggcttggaaagcttggtggagagctgctttgccacccccacctccaagatcgacgaggtcctgaaatactacctcatccgggatggctgtgtttcagatgactcggtaaagcagtacacatcccgggatcacctagcaaagcacttccaggtccctgtcttcaagtttgtgggcaaagaccacaaggaagtgtttctgcactgccgggttcttgtctgtggagtgttggacgagcgttcccgctgtgcccagggttgccaccggcgaatgcgtcgtggggcaggaggagaggactcagccggtctacagggccagacgctaacaggcggcccgatccgcatcgactgggaggactagttcgtagccatacctcgagtccctgcattggacggctctgctctttggagcttctccccccaccgccctctaagaacatctgccaacagctgggttcagacttcacactgtgagttcagactcccagcaccaactcactctgattctggtccattcagtgggcacaggtcacagcactgctgaacaatgtggcctgggtggggtttcatctttctagggttgaaaactaaactgtccacccagaaagacactcaccccatttccctcatttctttcctacacttaaatacctcgtgtatggtgcaatcagaccacaaaatcagaagctgggtataatatttcaagttacaaaccctagaaaaattaaacagttactgaaattatgacttaaatacccaatgactccttaaatatgtaaattatagttataccttgaaatttcaattcaaatgcagactaattatagggaatttggaagtgtatcaataaaacagtatataattttaaaa

SEQ ID NO: 21076 - DNA, 1181 bp, Homo sapiens
aaagcagtgcttctctctggggccaaggccagagctgtggacaccttatcccactcatcctcatcctcttcctctgataaagcccctaccagtgctgataaagtctttctcgtgagagcctagaggccttaaaaaaaaaagtgcttgaaagagaaggggacaaaggaacaccagtattaagaggattttccagtgtttctggcagttggtccagaaggatgcctccattcctgcttctcacctgcctcttcatcacaggcacctccgtgtcacccgtggccctagatccttgttctgcttacatcagcctgaatgagccctggaggaacactgaccaccagttggatgagtctcaaggtcctcctctatgtgacaaccatgtgaatggggagtggtaccacttcacgggcatggcgggagatgccatgcctaccttctgcataccagaaaaccactgtggaacccacgcacctgtctggctcaatggcagccaccccctagaaggcgacggcattgtgcaacgccaggcttgtgccagcttcaatgggaactgctgtctctggaacaccacggtggaagtcaaggcttgccctggaggctactatgtgtatcgtctgaccaagcccagcgtctgcttccacgtctactgtggtcatttttatgacatctgcgacgaggactgccatggcagctgctcagataccagcgagtgcacatgcgctccaggaactgtgctaggccctgacaggcagacatgctttgatgaaaatgaatgtgagcaaaacaacggtggctgcagtgagatctgtgtgaacctcaaaaactcctaccgctgtgagtgtggggttggccgtgtgctaagaagtgatggcaagacttgtgaagacgttgaaggatgccacaataacaatggtggctgcagccactcttgccttggatctgagaaaggctaccagtgtgaatgtccccggggcctggtgctgtctgaggataaccacacttgccaagtccctgtgttgtgcaaatcaaatgccattgaagtgaacatccccagggagctggttggtggcctggagctcttcctgaccaacacctcctgccgaggagtgtccaacggcacccatgtcaacatcctcttctctctcaagacatgtggtacagtggtcgattcctgttttcaa

SEQ ID NO: 21077 - DNA, 1854 bp, Homo sapiens
gtcacccccagcgggcgcgggccggagcacgggcacccagcatgggggtactgctcacacagaggacgctgctcagtctggtccttgcactcctgtttccaagcatggcgagcatggcggctataggcagctgctcgaaagagtaccgcgtgctccttggccagctccagaagcagacagatctcatgcaggacaccagcagactcctggacccctatatacgtatccaaggcctggatgttcctaaactgagagagcactgcagggagcgccccggggccttccccagtgaggagaccctgagggggctgggcaggcggggcttcctgcagaccctcaatgccacactgggctgcgtcctgcacagactggccgacttagagcagcgcctccccaaggcccaggatttggagaggtctgggctgaacatcgaggacttggagaagctgcagatggcgaggccgaacatcctcgggctcaggaacaacatctactgcatggcccagctgctggacaactcagacacggctgagcccacgaaggctggccggggggcctctcagccgcccacccccacccctgcctcggatgcttttcagcgcaagctggagggctgcaggttcctgcatggctaccatcgcttcatgcactcagtggggcgggtcttcagcaagtggggggagagcccgaaccggagccggagacacagcccccaccaggccctgaggaagggggtgcgcaggaccagaccctccaggaaaggcaagagactcatgaccaggggacagctgccccggtagcctcgagagcaccccttgccggtgaaggatgcggcaggtgctctgtggatgagaggaaccatcgcaggatgacagctcccgggtccccaaacctgttcccctctgctactagccactgagaagtgcactttaagaggtgggagctgggcagacccctctacctcctccaggctgggagacagagtcaggctgttgcgctcccacctcagccccaagttccccaggcccagtggggtggccgggcgggccacgcgggaccgactttccattgattcaggggtctgatgacacaggctgactcatggccgggctgactgcccccctgccttgctccccgaggcctgccggtccttccctctcatgacttgcagggccgttgcccccagacttcctcctttccgtgtttctgaaggggaggtcacagcctgagctggcctcctatgcctcatcatgtcccaaaccagacacctggatgtctgggtgacctcactttaggcagctgtaacagcggcagggtgtcccaggagccctgatccgggggtccagggaatggagctcaggtcccaggccagccccgaagtcgccacgtggcctggggcaggtcactttacctctgtggacctgttttctctttgtgaagctagggagttagaggctgtacaaggcccccactgcctgtcggttgcttggattccctgacgtaaggtggatattaaaaatctgtaaatcaggacaggtggtgcaaatggcgctgggaggtgtacacggaggtctctgtaaaagcagacccacctcccagcgccgggaagcccgtcttgggtcctcgctgctggctgctccccctggtggtggatcctggaattttctcacgcaggagccattgctctcctagagggggtctcagaaactgcgaggccagttccttggagggacatgactaatttatcgatttttatcaatttttatcagttttatatttataagccttatttatgatgtatatttaatgttaatattgtgcaaacttatatttaaaacttgcctggtttctaaa

SEQ ID NO: 21078 - DNA, 1000 bp, Homo sapiens
ggagggaggcaagagaggtcaggggagagccctggccttgtgtgacctgagtaggaccttctcctgagacttggtttacctgtcaggaaagtggggacatggactggaaggtcttccacatctgttccaggctgcacctctggttgaaaaggcagcctctcctggttctagacagagctgaggacacaagctgctcccgggctgcctgccctgaagccctctcaggcccatctacctggatggccagagcagctgacaaggtctggtccttgcactcctgtttccaagcatggcgagcatggcggctataggcagctgctcgaaagagtaccgcgtgctccttggccagctccagaagcagacagatctcatgcaggacaccagcagactcctggacccctatatacgtatccaaggcctggatgttcctaaactgagagagcactgcagggagcgccccggggccttccccagtgaggagaccctgagggggctgggcaggcggggcttcctgcagaccctcaatgccacactgggctgcgtcctgcacagactggccgacttagagcagcgcctccccaaggcccaggatttggagaggtctgggctgaacatcgaggacttggagaagctgcagatggcgaggccgaacatcctcgggctcaggaacaacatctactgcatggcccagctgctggacaactcagacacggctgagcccacgaaggctggccggggggcctctcagccgcccacccccacccctgcctcggatgcttttcagcgcaagctggagggctgcaggttcctgcatggctaccatcgcttcatgcactcagtggggcgggtcttcagcaagtggggggagagcccgaaccggagccggagacacagcccccaccaggccctgaggaagggggtgcgcaggaccagaccctccaggaaaggcaagagactcatgaccaggggacagctgccccggtagcctcgagagcacccc

SEQ ID NO: 21079 - DNA, 5539 bp, Homo sapiens
gcgcttgccccgcagctgattcatagccccggcccgggccgcctctgcacgtccgccccggagcccgcacccgcgccccacgcgccgccgaggactcggcccggctcgtggagcccttcgcccgcggcgtgagtacccccgacccgcccgtccccgctctgctcgcgccctgccgctgcgccgccctcggtggcttttccgacgggcgagccccgtgctgtgcgggaaagaatccgacaacttcgcagcccatcccggctggacgcgaccgggagtgcagcagcccgttcccctcctcggtgccgcctctgcccagcgtttgcttggctgggctaccacctgcgctcggacggcgctcggagggtcctcgcccccggcctgcctacctgaaaaccagaactgatggctctatttgcagtctttcagacaacattcttcttaacattgctgtccttgaggacttaccagagtgaagtcttggctgaacgtttaccattgactcctgtatcacttaaagtttccaccaattctacgcgtcagagtttgcacttacaatggactgtccacaaccttccttatcatcaggaattgaaaatggtatttcagatccagatcagtaggattgaaacatccaatgtcatctgggtggggaattacagcaccactgtgaagtggaaccaggttctgcattggagctgggaatctgagctccctttggaatgtgccacacactttgtaagaataaagagtttggtggacgatgccaagttccctgagccaaatttctggagcaactggagttcctgggaggaagtcagtgtacaagattctactggacaggatatattgttcgttttccctaaagataagctggtggaagaaggcaccaatgttaccatttgttacgtttctaggaacattcaaaataatgtatcctgttatttggaagggaaacagattcatggagaacaacttgatccacatgtaactgcattcaacttgaatagtgtgcctttcattaggaataaagggacaaatatctattgtgaggcaagtcaaggaaatgtcagtgaaggcatgaaaggcatcgttctttttgtctcaaaagtacttgaggagcccaaggacttttcttgtgaaaccgaggacttcaagactttgcactgtacttgggatcctgggacggacactgccttggggtggtctaaacaaccttcccaaagctacactttatttgaatcattttctggggaaaagaaactttgtacacacaaaaactggtgtaattggcaaataactcaagactcacaagaaacctataacttcacactcatagctgaaaattacttaaggaagagaagtgtcaatatcctttttaacctgactcatcgagtttatttaatgaatccttttagtgtcaactttgaaaatgtaaatgccacaaatgccatcatgacctggaaggtgcactccataaggaataatttcacatatttgtgtcagattgaactccatggtgaaggaaaaatgatgcaatacaatgtttccatcaaggtgaacggtgagtacttcttaagtgaactggaacctgccacagagtacatggcgcgagtacggtgtgctgatgccagccacttctggaaatggagtgaatggagtggtcagaacttcaccacacttgaagctgctccctcagaggcccctgatgtctggagaattgtgagcttggagccaggaaatcatactgtgaccttattctggaagccattatcaaaactgcatgccaatggaaagatcctgttctataatgtagttgtagaaaacctagacaaaccatccagttcagagctccattccattccagcaccagccaacagcacaaaactaatccttgacaggtgttcctaccaaatctgcgtcatagccaacaacagtgtgggtgcttctcctgcttctgtaatagtcatctctgcagaccccgaaaacaaagaggttgaggaagaaagaattgcaggcacagagggtggattctctctgtcttggaaaccccaacctggagatgttataggctatgttgtggactggtgtgaccatacccaggatgtgctcggtgatttccagtggaagaatgtaggtcccaataccacaagcacagtcattagcacagatgcttttaggccaggagttcgatatgacttcagaatttatgggttatctacaaaaaggattgcttgtttattagagaaaaaaacaggatactctcaggaacttgctccttcagacaaccctcacgtgctggtggatacattgacatcccactccttcactctgagttggaaagattactctactgaatctcaacctggttttatacaagggtaccatgtctatctgaaatccaaggcgaggcagtgccacccacgatttgaaaaggcagttctttcagatggttcagaatgttgcaaatacaaaattgacaacccggaagaaaaggcattgattgtggacaacctaaagccagaatccttctatgagtttttcatcactccattcactagtgctggtgaaggccccagtgctacgttcacgaaggtcacgactccggatgaacactcctcgatgctgattcatatcctactgcccatggttttctgcgtcttgctcatcatggtcatgtgctacttgaaaagtcagtggatcaaggagacctgttatcctgacatccctgacccttacaagagcagcatcctgtcattaataaaattcaaggagaaccctcacctaataataatgaatgtcagtgactgtatcccagatgctattgaagttgtaagcaagccagaagggacaaagatacagttcctaggcactaggaagtcactcacagaaaccgagttgactaagcctaactacctttatctccttccaacagaaaagaatcactctggccctggcccctgcatctgttttgagaacttgacctataaccaggcagcttctgactctggctcttgtggccatgttccagtatccccaaaagccccaagtatgctgggactaatgacctcacctgaaaatgtactaaaggcactagaaaaaaactacatgaactccctgggagaaatcccagctggagaaacaagtttgaattatgtgtcccagttggcttcacccatgtttggagacaaggacagtctcccaacaaacccagtagaggcaccacactgttcagagtataaaatgcaaatggcagtctccctgcgtcttgccttgcctcccccgaccgagaatagcagcctctcctcaattacccttttagatccaggtgaacactactgctaaccagcatgccgatttcataccttatgctacacagacattaagaagagcagagctggcaccctgtcatcaccagtggccttggtccttaatcccagtacgatttgcaggtctggtttatataagaccactacagtctggctaggttaaaggccagaggctatggaacttaacactccccattggagcaagcttgccctagagacggcaggatcatgggagcatgcttaccttctgctgtttgttccaggctcacctttagaacaggagacttgagcttgacctaaggatatgcattaaccactctacagactcccactcagtactgtacagggtggctgtggtcctagaagttcagtttttactgaggaaatatttccattaacagcaattattatattgaaggctttaataaaggccacaggagacattactatagcatagattgtcaaatgtaaatttactgagcgtgttttataaaaaactcacaggtgtttgaggccaaaacagattttagacttaccttgaacggataagaatctatagttcactgacacagtaaaattaactctgtgggtgggggcggggggcatagctctaatctaatatataaaatgtgtgatgaatcaacaagatttccacaattcttctgtcaagcttactacagtgaaagaatgggattggcaagtaacttctgacttactgtcagttgtacttctgctccatagacatcagtattctgccatcatttttgatgactacctcagaacataaaaaggaacgtatatcacataattccagtcacagtttttggttcctcttttctttcaagaactatatataaatgacctgttttcacttagcatcctttggactctgcagtaggttgtctgggtcaagataactctcagtcacatttatattcatattatgctaaaatagtaaaatgaaacctcattgttggacataatttagatataactaaaaagttctatgaagtgggaaattccgtgttggctctggagcagctttgtctcctctgaaccaatatatcccaaaccaatatatgcaaagcacctggtacacaactggtattttagtacatgttggttcttttggtgcaatctcagctcactgcagcttccgcctcctagattcaaacaaacagttctcctgccccagcctccagagcacctaggactccaggtgcatgctaccacacctgactagtttttatatttttagtagagattgggttttaccatattggccaggctggtctcaaactcctgaccgcaggtgatccacctgcctcagcttccccaagggctgggattacaggtgtgagccaccatgcccagcctatttgtcacattatttgtcacatttattttacttttatttattttttgagatgaaatttcgctcttgttgcccaggctggagtgcaatggtgcagccttggctcactgcaacctccgcctcccagggtcaagcaattctcctgcctcagcctcctgagtagctgggattacaggcatgcaccaccacacccaggtaattttgtatctttagtagagatggggtttcaccatgttggtcaggctgttctcgaactcctgacctcaggtgatctgcctgccttggcctcccaaagtgctgggattacaggcgtgagccactgcgcctagccgtcacatttctaaacaagcatgaaaggggttcatttttgtcttcttcttgcctgccgtcagcatggtggaaatggctctgcctatgctcatgcttctggtgcccaatgccttgcactgtgccattcaacactatgaagagaaacaagtagccacacctcaaaataatgtggctgtcaacaactggcctaaataaacctacacaaaccagtacttgccttttgctggaaacattgattatgtgctcctcacgtagtagaaagcggtatcctgattagtctaacagttgtgttagactttagggccagtattgtcagcatttatttatttatgtacctttgttatgatgggatatttttcatttgaaacttgttcataaaaatgtcaatgacattgatgactgatttgtacatatttttcatatagttttgtttaaaaaataattcacgcaaaatcttgaagtcatttttgctattgaaataaaccttaattaaaatatttcatcatca

SEQ ID NO: 21080 - DNA, 1740 bp, Homo sapiens
gcggccgcctccccccgggactgaagggagggaattcctgtgggtcccaggagtgccaagagtgcgcagcaagacgggaaattgcaaaagacctcacccctctgccctcccccgcggttttccagtaactcccgcccctccgcgcttgccccgcagctgattcatagccccggcccgggccgcctctgcacgtccgccccggagcccgcacccgcgccccacgcgccgccgaggactcggcccggctcgtggagcccttcgcccgcggcaaaaccagaactgatggctctatttgcagtctttcagacaacattcttcttaacattgctgtccttgaggacttaccagagtgaagtcttggctgaacgtttaccattgactcctgtatcacttaaagtttccaccaattctacgcgtcagagtttgcacttacaatggactgtccacaaccttccttatcatcaggaattgaaaatggtatttcagatccagatcagtaggattgaaacatccaatgtcatctgggtggggaattacagcaccactgtgaagtggaaccaggttctgcattggagctgggaatctgagctccctttggaatgtgccacacactttgtaagaataaagagtttggtggacgatgccaagttccctgagccaaatttctggagcaactggagttcctgggaggaagtcagtgtacaagattctactggacaggatatattgttcgttttccctaaagataagctggtggaagaaggcaccaatgttaccatttgttacgtttctaggaacattcaaaataatgtatcctgttatttggaagggaaacagattcatggagaacaacttgatccacatgtaactgcattcaacttgaatagtgtgcctttcattaggaataaagggacaaatatctattgtgaggcaagtcaaggaaatgtcagtgaaggcatgaaaggcatcgttctttttgtctcaaaagtacttgaggagcccaaggacttttcttgtgaaaccgaggacttcaagactttgcactgtacttgggatcctgggacggacactgccttggggtggtctaaacaaccttcccaaagctacactttatttgaatcattttctggggaaaagaaactttgtacacacaaaaactggtgtaattggcaaataactcaagactcacaagaaacctataacttcacactcatagctgaaaattacttaaggaagagaagtgtcaatatcctttttaacctgactcatcgaggtgagactagagttgtcacagcccaccgtggccactaacgtgtctttgtttcacagactgtgtgatcaagtaaatgtgctgtagatctttgcctcattcacagcggaggtgagagttagaatttatacctattgttcatgccacgtttctcctcatggatgcacgcatcccctattatttgtttcttttaataatgtcacgagcaccaatgagcttactacccaacttcaaaactaggactctaacaataacttctgtcatatctcatcctgtaacgcccccaccttcgctccttccgccaagataattatcactttaaattgtgtgcgtgtgtattctcatttcttatgtgatggtaaaaatgcctttattttgtttggttttaatgcatagaaaggacatcaagctgtatgtaataattcagtaattatgtttatataatattaaattgctaatatttgcccata

SEQ ID NO: 21081 - DNA, 2092 bp, Homo sapiens
ccccacagtgagaggaaggaaggcaacagtcgccagcagccgatgtgaagaccggactccgtgcgcccctcgccgcctctgcctggccacatcgatgttgtgtccgccgcctgctcgcccggatcacgatgaacgcgcagctgaccatggaagcgatcggcgagctgcacggggtgagccatgagccggtgcccgcccctgccgacctgctgggcggcagcccccacgcgcgcagctccgtggcgcaccgcggcagccacctgccccccgcgcacccgcgctccatgggcatggcgtccctgctggacggcggcagcggcggcggagattaccaccaccaccaccgggcccctgagcacagcctggccggccccctgcatcccaccatgaccatggcctgcgagactcccccaggtatgagcatgcccaccacctacaccaccttgacccctctgcagccgctgcctcccatctccacagtctcggacaagttcccccaccatcaccaccaccaccatcaccaccaccacccgcaccaccaccagcgcctggcgggcaacgtgagcggtagcttcacgctcatgcgggatgagcgcgggctggcctccatgaataacctctataccccctaccacaaggacgtggccggcatgggccagagcctctcgcccctctccagctccggtctgggcagcatccacaactcccagcaagggctcccccactatgcccacccgggggccgccatgcccaccgacaagatgctcacccccaacggcttcgaagcccaccacccggccatgctcggccgccacggggagcagcacctcacgcccacctcggccggcatggtgcccatcaacggccttcctccgcaccatccccacgcccacctgaacgcccagggccacgggcaactcctgggcacagcccgggagcccaacccttcggtgaccggcgcgcaggtcagcaatggaagtaattcagggcagatggaagagatcaataccaaagaggtggcgcagcgtatcaccaccgagctcaagcgctacagcatcccacaggccatcttcgcgcagagggtgctctgccgctcccaggggaccctctcggacctgctgcgcaaccccaaaccctggagcaaactcaaatccggccgggagaccttccggaggatgtggaagtggctgcaggagccggagttccagcgcatgtccgcgctccgcttagcagcatgcaaaaggaaagaacaagaacatgggaaggatagaggcaacacacccaaaaagcccaggttggtcttcacagatgtccagcgtcgaactctacatgcaatattcaaggaaaataagcgtccatccaaagaattgcaaatcaccatttcccagcagctggggttggagctgagcactgtcagcaacttcttcatgaacgcaagaaggaggagtctggacaagtggcaggacgagggcagctccaattcaggcaactcatcttcttcatcaagcacttgtaccaaagcatgaaggaagaaccacaaactaaaacctcggtggaaaagctttaaattaaaaaaaatttttaaaagaccaggacctcaagatagcaggtttatacttagaaatatttgaagaaaaaaaagcgttatttatagtccaaagaaaccaaagacttagctcacctgcattctgactttgtttggagacacacacttcagcagggcggcgacttggcaagacaaatgatgagcaggaaaacaccactggatctcacaccttcaatccatgaccatcctcgctgtgcttggctgtttagtggtttggagcatagtgattttgagccattgagcggacatcttttaagatcgaactttctcatctgttctaccatgccacgaaggtgtatggtgtctcagtactaccaccaccagtggttacagacttaggcagagctggtcttcagaaatggttgttctataggagtgcaaccaacatggtatggggttgtctgagttcattggattaggagtgtgattttgctcgtctagcctaacgtttgaacctgccaggcccgcaacctaaatgcagattca

SEQ ID NO: 21082 - DNA, 16121 bp, Homo sapiens
gcccccgccgcccccgggccctgatggactgaatgaaggctgcctacaccgcctatcgatgcctcaccaaagacctagaaggctgcgccatgaacccggagctgacaatggaaagtctgggcactttgcacgggccggccggcggcggcagtggcgggggcggcggcgggggcggcgggggcggcggcgggggcccgggccatgagcaggagctgctggccagccccagcccccaccacgcgggccgcggcgccgctggctcgctgcggggccctccgccgcctccaaccgcgcaccaggagctgggcacggcggcagcggcggcagcggcggcgtcgcgctcggccatggtcaccagcatggcctcgatcctggacggcggcgactaccggcccgagctctccatcccgctgcaccacgccatgagcatgtcctgcgactcgtctccgcctggcatgggcatgagcaacacctacaccacgctgacaccgctccagccgctgccacccatctccaccgtgtctgacaagttccaccaccctcacccgcaccaccatccgcaccaccaccaccaccaccaccaccagcgcctgtccggcaacgtcagcggcagcttcaccctcatgcgcgacgagcgcgggctcccggccatgaacaacctctacagtccctacaaggagatgcccggcatgagccagagcctgtccccgctggccgccacgccgctgggcaacgggctaggcggcctccacaacgcgcagcagagtctgcccaactacggtccgccgggccacgacaaaatgctcagccccaacttcgacgcgcaccacactgccatgctgacccgcggtgagcaacacctgtcccgcggcctgggcaccccacctgcggccatgatgtcgcacctgaacggcctgcaccacccgggccacactcagtctcacgggccggtgctggcacccagtcgcgagcggccaccctcgtcctcatcgggctcgcaggtggccacgtcgggccagctggaagaaatcaacaccaaagaggtggcccagcgcatcacagcggagctgaagcgctacagtatcccccaggcgatctttgcgcagagggtgctgtgccggtctcaggggactctctccgacctgctccggaatccaaaaccgtggagtaaactcaaatctggcagggagaccttccgcaggatgtggaagtggcttcaggagcccgagttccagcgcatgtccgccttacgcctggcagcgtgcaaacgcaaagagcaagaaccaaacaaagacaggaacaattcccagaagaagtcccgcctggtgttcactgacctccaacgccgaacactcttcgccatcttcaaggagaacaaacgcccgtcaaaggagatgcagatcaccatttcccagcagctgggcctggagctcacaaccgtcagcaacttcttcatgaacgcccggcgccgcagcctggagaagtggcaagacgatctgagcacagggggctcctcgtccacctccagcacgtgtaccaaagcatgatggaaggactctcacttgggcacaagtcacctccaaatgaggacaacagataccaaaagaaaacaaaggaaaaagacaccggattcctagctggggcccttcactggtgatttgaaagcacaattctcttgcaaagaaacttatattctagctgtaatcataggccaggtgttcttcttttgtttttaatggctatggagtccaagtgcaagctgaaaaattaatctcttagaaccagacactgttctctgagcatgctaagcatcccagaaacccaaatggggccttcctggagcgagttaattccagtatggtgtcaaccaagctcgggattgcttaaaatatcatccatcccacttcaggtcctgtcagcttcttgcagtcagagttcctatgagtaacaataggagtttggcctatgtaaggactctgagtttaggcttccaagatacaacaataagagaagaatctagcaacgagaatgacctcatttgctttccacatgcttagcctcattataccatgttatgtccaagttcacagccacaacatcagaatggtaattactgagcacaagttttaaatatggacgttaaaaaaaaaaatccaaggacctgtttttccaacccagacatcttttcattgaatgatttagaaagctttaagttgatccagcttacaattttttttttctttacctcctggaaatctcatatggtcttggatccgtcaaaaaaaccagtcagttcacttgcgctcaaagtatcaagcacaacaaagataaacagaagtgaggaaggttctgggttcactacatctggattttcaagacacctattgtgaagtcattagggaattgatgagaatatggcttcaagcacattttgcagtttgctacaaattctgttgtacataatgcagacgcacactcaggaggccaatttaactgttaacagtgcatggagcgaatgcagcattttaaaagatctaggtttttttaggtcattaatgtgtccttggttgatcagtcatctggtccctcctactgtgtgttatgaccaccacgtaatccattctcgctctttctgatttggggtttttcctcatccatcccattagtagggatgttttctgtgttttctagcaagaaaaaaaaatcaatcaatcaaacctgcatacatgttactcatgactgtcatctagtcctaaatctcttctgttgttgaatcatccttgcaaaacagctgaatacatctggagaaaacacagcacaccaaagaagcagaatactgcaaaccaaagacatttatgacttgtcattttctagcctaaaaatactgtgattacttttagaaatcagaaaacctctgcaactccgaatggcattcagctcttgcatttggcgcatcatcgggctgagcggaccagctacaccaaggacattagccaagccacccagaggggtggctttgccacaccagttgtcaccttcccatagcaagtggaagagcgcccacagaactctgggagattgcaaaggtcacaatgtgcatatttaccagtgaatggccccgggtggggccacgtgggggtgttcaaagcaagccaaacgctgcaatcattctttacagacacttgagactgacttttttatgaattacttagtcgaaaccaaagaaactttttctgcacctacttctgcaacaaacaaaactgtcccattaaaatgaataaataaatccgtaaatcaatggaaatcaccaccaataagaaggaagcacgccagaaaataaacgaaaacaaaaacagggagacacactgtgttcaaacagacctcttgggacattttttggaagcagattttaaagaaagggttgagacaaagatagaaataaggaagagcctcagtggctgctgcttcatttgacaactcacacggtaatcttaaagctgaagattgtctttaatttgtgcctatgcagtttttcaaaagaacacggaacagagcaacagaaacctcaacagctacaataccaaagatgaggatttctcacaccttttgtttcagttcattatctcctcttgcctggctaaaatactaatagcgccattgaactgtataaaggtaatcaattatgtttctctgagcaacaaaaggaaagggccatttatttgattttattgtttcatttcaattttgtcttatggttttttgccccaacatggaatctctcaaaagtttccatggactccaagtttaagatgttgggatattgaacagttctctctgctcagcagagggtagggaataacattatcacttgaatgttctttgcttaacccttagacttggttccttctatgttcagagtctcatcatcaggggaaggaaagggagtgagggtcagggataggggtcttggtgatgcatcctctcccgagccacagaaccaaagagtttatagaggaatttacagcctcgttttcatgtgattgctacatcctaacagggcttcatttgggggtggggggaaacatgtaaaaataattgccagtttctacttttctattagctttttaaaaatcagctgtaaagttgcatttctaaagaaagatatatataatatataaaatacatatatagatcaacttgacattggtgataaccaaaattattgctgtccaaattcatgtcttgttttggtccagtgcttcatttgctaagtattcggttcagaatttttctcatttctcatgccattccagagttaatttgccactgtggatgatttgaagtattcagatctctatggaagtttctgggacaggtttaaagtcaagatcaagcattttagcatttaacctgttgataaatggatccatggtgtacatgagttttatttgtattcggagtcatctctattctatccctcagcctcgattaaggtggtgagtgaagtgcatccaacagactcggcccagaactgggtcctgacagtggggtgctcatcttctgtaactgttgggaaggctcggtggtccattttcaccagttaaagaatatgaggccagcccagaaatctgttctccaggagctgccctgtcccatctgggtgtgccagaccccctcagtgagcaggtccaccaaagggacttctcacaggggaagcccaactcctgttgcaatgggttgatagatttcctcagggtggtaattaccaattcgtattttgacaagcctatgtgcaaccacagctggcactggggtgggcagtggtgttgggtgggatgggggagagtgtctcaatcctgaagagaaaatataaagcaggttttggggagacttctggagtcctgcccctagagagccccattgttgttctttgtgccccctcctcattccccctatgtgggtctccctatgcaggagctgtgagagaatgtgactctccacaatttttataattcatccttcctaggagattgttcattggctcttcccttgtgtccctttgtcccttgctcatactccatgtttcctttgtcaaaggactaagaaaagagcatatttcagcagaggagtgttcccatgtgggttgatttcaacttgggtatttctaaaagagtccttgtgacatgtgtccagtggaaatggttgctcttttccagactggattgaggaatggagcctgtttgatttggttagtgattctttgacatactaatctcagcgtttgggtctccagcatcctctgaagatgtctagactagtagaggctgcctttgtgacctgacattacaacattggtcaaaccagtcctctgataatcagaagaacatgtcataattgtttaaaaaaaaaaaaaaggcaagaatttctctccaaggagctttaataaatgtctcattccagataatgtcataccagagaaaagtgcttgcttttagaaaattatttacatacatatataaatatatatgtgtatctatacagttatgtatcaaaattttaagccctgcagaatttcaatttgttagaaatctaacagaaaaaaatttctatattgaaaggtaatagaatttaacccagtgagtttactcaaggatttttaaatttaagttaataatttcagagaaaataaccatttgggtgtggttatagtttagtatccattacctcaatccaaggaaaattccaggcattcctcaaccatcaggaaaaggtacagtgtgaaggaacagttctcagccaaatttcacattcttgaggcaacagaaatcaaaacactcagagccattgagtggaaaaacaatttactttattcctttacacaaataggcttgcattgtttttgttttaatgtgattttggtactagggatataattatttcattccaggaaataataaaaaaaaacagacagagccaatacatttctttttttaaaggaaacagcaacaacaataaaaactcagcaccaatatttaaaagcttttccaaaatgtaaaagaagtgtttagcttgcaccatgcataaaggtgcaggctagttgaaccaggaagcatggcacttcctctggagaaatccagaaagagttgcttctaagctcccttttccccctgcaggctcttggcaattgtaggctttagcaaatccagaataattttcaattcaagctaaaataaaatcaacatttggaatgtaaatctgatacacacacacttttctaagtcaaacaacatatttcaaaaccaaaaataaataccttttagataatcagttattttctttgtctatactgggcacccacctactagtgccagtaaattcaagttgaacagatttttaaaatcactattatctgggtatgggggaaacttccccacttttgaaaatgttggtagaattataggaatgtctgtttgattatcattaccaaagtgtcatgacagtatgcctttgtagtgaactcggattttcaggagtttgaatagttggatattttaaaatctaagaagaaaaggcctgtttccaatgttgttgaagaataatgaactctattaaaaagtggagaaaaagataatacatgtggtcaaggttgaccacaaggcccaggcacaactaccttggcgataatcttctagattcgtaacaggttagagctgactttttgtttttgttgttgctgatgctgtgtgattcagacttctcagcctaaccaggaagagtaagtggaaatggtagatgaagaaggggtagagctggtgtatctataactttctgatatttgtctgccaaacttgatatattagtaatttttttatctttagctaagatcaagtcacccctgaaacaacaggagattctagttttaaaataaggccacaaaaatccttacggaatgaagaatggcaccccagttggttgtataagtctcataagataatgatgttgattttaaatatggatgtctcaatgcctgttttctatcaatgatttgtttgtttccaaggtcggggagggaaagaggggagggtttatctgttttagaaagtctcagaatacttataaaatacagaagtagttattaaaatatataggacctcacataggtagatacagaacttaccattgaggctgatgggctgttgtgtgaatcacacaggaccttaaatgaggctcattattctcacacaccaaaatgactctgacagcctgaagcagttattgctagagcccaagctttccttggaggttttggagttaggttgattggaagtaaccagctaataccttttctagtggagaaaaagacattgctaccagcttgttcatcccatagaagtcttccactctgctccatttttagcagcaagcatttcatgtagcataaaccttggcagataagtgtgcctaaggtttatacagtctgtccgcttggatgtatacaaatttagatacatattttaacatgtgttctcatagatgactttataacaacacacattacctataggtgtctagactgtgtacatacaagtgtgtacagacaagcttcatacgtatatactgtaatccgttacaacaaataaattttaaatcatcgtttaacatgtatgtggtacttctacagtgtacattgttttcattatttattgtaacattgaaaaccacagtgcagggaaaacaaaagtatcccagcatcttcatcctgtacacttggaattaatttcatttgggcatatccaagataaactcaactttcaagaaatcttgtatattatttaatcatctgtgttaggatgacacctatgattgatgacttcggttgaatagctttattctggatttttcataactaaagctaaatccaaagacctgaaaaaggacaaaaagaaaaaaaaaaaaagaaaaaacaaagaaaaagaagaaaaaataataaagtcaagcgcaaactgatggggagacagtgggctctggtttccaggattgagacaatggtactgcggtcttggggagactgcgttagctagtggggagtggtgatttttttcatgcttgtcacatctaaatggtctttaacatgagaaagttttagaggttataatttcctgctttgtttttatttagactatcaaatgaagttatacatgttgtcagtcaaaaaatgaagacaccctctgccccaccccacagaatgctttttatcttgtctctttgggttatgacccaacaagctaagtaccattaatgtaattaacttatttaaattagttcctagtacataaatgtataggatttgggtaattatttaatcatccttccttagtttgattctactccttgtacttatttatcaaaacctagaccaatggtgcatcagagatgcaaaattctacttggaatactcttgaagtttagtttgctttataaagcagtgaaattctgttacagacagggaagaaatacaggttacaaaaagagaatttgggatattcttccctcttaaattaacttttaaaatagtctaagtaacaatttttaaattatttaacttaagttcgcagccccacctggtaccaggcgaacttcacctcttaattattgtggccctcggagccttcatattgtaacttatttatttaacttattcagcatctgtgaaaggtgcactgtatagtttatatttttaatttaaaacaacagagagcactgcagtttgtttgctgtcagaacaacagagcaaattttgtggacaagcaatgactattcagcctgaacctgtgcattcagaaaacataagctgagaccctgcttcaccagcctggatttcggggcttctatacagaaactggaaaaataaattttaaaaaaatcgtaaacaaaaagagagaaacccttacactagctgcttccaagaatgaactctgtgtgtatgtaaagcaacaaaacaaaaaaggaaaaaaacaaaaagcagaaaaaagaaaaaaaaaatgaaaaactttctatttctagtgagaaccaaagaaggctacctcactgactttttccatttgtaattttaatcgtgttgatgacaccaaagataccaaagatttctttctctgtgcggtctgcattttgcttgtgctcttttataatttgaacgattttctctgacatatggtatgtacagccacagctcagataccccaaagaaataattatctatgcgacggcggctgctaatttggaaagggatattttctgtgtttctcttatatgtttgctgtctgctcgacatgttcaagatgcgagttcagatgctgctgtaattggattccttaaattctgattacaaattgaggaaggaaactggttggaaatggccttcagtcctagccatggcctctatccccgctgggacctgtcacagtaaagactgccaattactgaaccacagaagctctgaccattgagtagttgagctggaagagaccttaggaatcatttagtccaagccccggtggcccagaggaatgaaatagttatccaaatcaaataactcttgagagtgaaagcccacacatgcctcctggttcctgccccagtgctccgcttattgtacagtgctacctctgcatgagagcggtcccacattgacaaataggatggtggcaatcctttagcaatgagcagggactggggtttatctcttaacattttcagctgtaaaattagtcacaagcattttcagtgtcccattagtacatagtcacatatggtcggttgcttcgtgaaggtggcctgtcttgaaatactagggctcatacgggatttttgccctaggaaaaacatgttgatcccaatgatgtgatcacttttgaacctttccattacaaagcattgtatagataactttttaattcagtaggaggagaaagttcattcttggcctgttggctttgattattatgggtactttaaagtcagtatttatcaagaaagggaacttgaccaccattggcacatgtgacatttaagctcttcagccttttcctttttagttgtaggtgtttacatttcatttctaagccaactctgtatttatgagagaagtttaagccttacatcatttgatactaaagggttatttgtggtaaatgaaaaatgaccccaaaattacagaggaatatgccagtttaagaaatggctacttaaagttgcttctctctttccttcttactcatgaaattaattggtcttcttcaagtttctttagattccattaaatgattaaatcactattaagagccattcatcaacgtgatttgtgtgttagccaatgaatctgtctcagcttttgaccaaatgggttttagacaaatgcaaagatctgcctctagtccatatggctctttttgagtgctagtattttgcatttcacataatgtagttattttgagcttttaaagagagcatttagacaaagaagcaaagagaggaagggaccaatcaactcatcagttccatgcatcaacaaagcatagctagtagaggaatataaatgacagattgacaaactgtaggaaacactgttactctctttctgaagttttcaagcaccatcctatgtgaaagttccctcctgtccaaacaagctcaaggcccatcttctccctatacaaggcaaacctgtaaggccttccttccaaagagtacattgctttggttttcttcctaaattcctattggaattagaactctcagaatccctgggagacagagcaaagatgacttaattcattgagcagcagagctccctataagtgaacatcaccttccccatctttcctactgccacacccatacgagagaggatctagaaagagcgatggcagcctgaacacagaaaacatccccacttggcagacctctcctcagcaatccccccagcctcatgcttcacttgcaaagtgtgacataaccacgggacgagtgccttgcttgaaccaaagcaacgatttagccagtctggacctctctgtgctttttttaattcttcctgtgaatacctcagcttcaactgggcctccatacagtcagttggtgggcttattgtactgtggtgctttgcaatgcaaccctgcaaagaacaagatttgtactaataccaaaggttctttctctatgtctcctcctctgcctccctcgttcttcccttttttctagttcttcacggttccaaagctttactatgaacctgggcatgttggcaatgcagaccgcgcaattccttaccgaattttctcagatatacctcatagacaatagtgtttagagtaatgttattatagcgtatgtaataaattattcactgtttcttttggtaactgtgatttaaaaaaagaaaaaagaaaaaaaagctttatacgttttaggttgtgcttttgtaatagatgaaaaaaggtgcgcttaaaaagaaaatgtatgtttttttccccctttggattttatttatgctggattggggaaagttgcagaatgagcccaaagtttacagtttcatattttgctgaagaaacaatctgtgttcatttgctctgttgaaaagaataattattttctacatttgtgccacttggtctgaacaattaattgttccgtgttaacagtgtagtattatgattagcaactgccaatcagtgctataattttatgcatgaggctaaaaatttagcagtgtgatgcattgtggtcttaatagcaacatttttcattttgaactagatcttcccctttggttcaatggactttatttatgcatgggcgcctattgtttgttagcagttgtggaacagttgtgtatacattaaactgtgaaaatgtacacagttcagcctcagacggtggtaatattggttttattgggagatgtgtcacctcgaaaataccctttacatctgttgggatctgaaaatgagtcacattgaattgggttccagctttataatgagaaacgttattcctaatttttgagttagccaatttgcattccacaaattgggatcctcataacccaaatatatcaccgtatgtgagagggatttgaaagcgagtattgaaaaactcacctttgcatatttaatttccaccaaaaggagttattttggctttatgctcatgaacttagacctaactggccatgtatatgtagatgcaaattcatctagctgtggccctctttgatctctgcttgggaatggctatttttgactatgcgtggtttcttctcgtattttgtgatcaggtcagctcccagtagaaactcaaatggcatcaatattactaactcttctctgcccacttctcttttgtccactctcctagacattcccaccaactgttccagtgatttgggcaaaaatacgcagccatttcccaaaacttcacatgtgcagctatcatggctgtccctccctagacttggaggtgactctcacttaatttttacctgcccaacaatgttccatctaccatctaaaaggtaatataagaagaagttttgaaacccactttaggaaaaccatcttctttaaatccttcaattatctgaggcctctatatgtcaaaactatttttcagttgcaggggattgggcaaacttgttctttcttatacttgggttcaaagacccattctccagtttcatatttcccaaaccaaaatgcttgacataaagccaaatcaactgccaagcacactttattttgcataggagtatgcagcctagggaaccttggttgaaaagcagcagtctgctatgcaaaatattggaaatcactgacagtgtagcattcatattatctgtcaatgagggtatattgggaacgtgctctcgtgaataataaaaagcaacatatttttatttggccttataaattaggttgtggtaatgtaaactttgatatatagtctttttatttttctcttattaatctgccaaagatgggaacagatacaagaatttttcaaattggcttttgtaagacaattgatgattgtaatagtgtttaatcttccagaaagctttatatgttgttccacaataaaattgatatttgtttcagcaaagttttcctgacactcacaaacccacaaactgttcctcttaatgcagatattgtagaatctacaaagttcaaatccatttttgatccaaagaaagtagaggagtatttgagacatgagtgtacccagccctttttttaatcacaggcaatgcatgggtctggctggttacactttgccaagaagacttgtcttatgaaacccaaggtatattttgttatgccattttatgtccttttcttttaacattgtggaaagtggtatgttgaatcaagtgtaagctgagttttccagacaactgaagtagctacatcatgaatgttattttgttattaaagggtttttactcagtgctttgtgccaatggatgtccttttccttggagacacataactacaaaattacctcagcttggcctggttttctctcctgccctcttggggaaacatgggcctggcctgggaaaaggcaggtcatgggctggaaggtaggttttggtactaggaagaaatctctgtatctgtcagctttaaagagaactgggccaaaaatctctaacctcactctctctggactccaacacttccctgcaatcctttggtcttgagcatgtgccagcatgaaggcagactccagttcatacatgaaaggcaagaaaaagaaaatagtaaccttgaatcttctgtgggccaccaggcactcacctttccccaccttgcacactatccagtcaaggctattgcagcccatctggtggctttacatgggacattaccaaaggcttcttcctccatcctggggttgcaaaggatccaggtcccctccatccagtggggctcttccacatcagaagtccccctcccaccatcctctgcatcctgtttagctatcccatctataccttttggagatgattatttagaaaacaaagaaaggtatggaatggggtttcctattgtttgctaggttatattttagcaattctcaattctttgatctggaaaaatacaagagggaaaaggagaccccactatctccctgtgctttgctcccatctcagggggcaggggcagtgcacattgcctatgctgttgatctgtcttgggcgacaggctgaatcacagctattgccccagccaaaaacatggcccatcaatgcctactttatctctgcttgaaaatcctattcaaaaagttgtagagtttgaggtttttatccccccatatcctttgctttggtccagtttggcctttagcataagagtcagctttatctctaggaaagttttttcagattatgacaaggaacctgccacctgggaagaaaagagtccgaagactagcaatcggataggtagtcataccattaacagatacttccttgaaggtagaatattatttcctttctttacagttttgtgttacacaagtccaagtggtgccagcaaacttcttaccgtgaaatgttgtaaaacacctggcatactgaaatttctgaaacaaaaacacaagctccacattgataacttgataaataaccactaaagtttagatgcagggactgagatgatacaggcaaaatcttggtgttggtttctcttttaattcgtatcttcgatcacctaacctttctcaatccaagagcagttcagtcttttctccccaagtctaggatgccaaagagcatcataggaaaagataattagggattgaccagcatttcaattagttctcttcttcatctttgcatttctcaaaagtgttctcctggaccagagggaaagagctggtccattttttttcattctttctattcaaatttttccacccagacaatactttattaacacagatactgtagatccttccttggtcagtgaattattacaagaggagctatccttccaccaaagtgagtgaaaacaagttccagtatcttttcttccatccagttttgttctcagaatccaagtcagtcctgggtcttttctcactttagaccctggcctcagatgtgtttattcttgctatttaaaaatacctttaaatttcacatgctggcctgcagaacttgcatcctttgttctatactgttgactgcttgatggtattgaaaggtgactataatgagggaagaaaggaggaggtaaagagagaagaatttgtcccagatctgtttaaagtttcaaaatttaaaaagggacccattaaattatgggaaaatggctatagagtgtgagcctccgttgaccatatgctcaaagaccgtactctgccacctgccttccaggtagctattctagaaactcagtcctttgtggaaacccaactaccttttaaaagtctctttccagattccaaaaggacaagagatcagagagtcacatatacgcctcttgttttattttcttgctttcacgggtattattgccaagaaaatcgtagggaaaaactttaaacttttcttttcagttgatccctttgacatcacctctcatgtttaaaatcaggaaaacacacccctaaaatttgcactctcttccgttttgaaaaagaaaacccacacacaaatgcacactattaccgtctttcaccctgcgctatatttccaaagtgtattataatccagatattgccccatctcaaacatgttaagtcagactgtgctgaaagactttccagggacggtcaacagggtatatgttcagtggctgccctgaaatcctggtggggatgaggatcacgcttcatcatcaaggggatgcccatcccctgataagctcccagtccttttggaagatttctttgaatgttaattgcattttcagttttgctcatttcccaccccaatgttttgtctgcaacatcgcttacactggattctttctatttttattcctatcattaaatggtagtgctgtaaattctgcaattaatgttaaataaactgctttaattcattg

SEQ ID NO: 21083 - DNA, 16122 bp, Homo sapiens
gcccccgccgcccccgggccctgatggactgaatgaaggctgcctacaccgcctatcgatgcctcaccaaagacctagaaggctgcgccatgaacccggagctgacaatggaaagtctgggcactttgcacgggccggccggcggcggcagtggcgggggcggcggcgggggcggcgggggcggcggcgggggcccgggccatgagcaggagctgctggccagccccagcccccaccacgcgggccgcggcgccgctggctcgctgcggggccctccgccgcctccaaccgcgcaccaggagctgggcacggcggcagcggcggcagcggcggcgtcgcgctcggccatggtcaccagcatggcctcgatcctggacggcggcgactaccggcccgagctctccatcccgctgcaccacgccatgagcatgtcctgcgactcgtctccgcctggcatgggcatgagcaacacctacaccacgctgacaccgctccagccgctgccacccatctccaccgtgtctgacaagttccaccaccctcacccgcaccaccatccgcaccaccaccaccaccaccaccaccagcgcctgtccggcaacgtcagcggcagcttcaccctcatgcgcgacgagcgcgggctcccggccatgaacaacctctacagtccctacaaggagatgcccggcatgagccagagcctgtccccgctggccgccacgccgctgggcaacgggctaggcggcctccacaacgcgcagcagagtctgcccaactacggtccgccgggccacgacaaaatgctcagccccaacttcgacgcgcaccacactgccatgctgacccgcggtgagcaacacctgtcccgcggcctgggcaccccacctgcggccatgatgtcgcacctgaacggcctgcaccacccgggccacactcagtctcacgggccggtgctggcacccagtcgcgagcggccaccctcgtcctcatcgggctcgcaggtggccacgtcgggccagctggaagaaatcaacaccaaagaggtggcccagcgcatcacagcggagctgaagcgctacagtatcccccaggcgatctttgcgcagagggtgctgtgccggtctcaggggactctctccgacctgctccggaatccaaaaccgtggagtaaactcaaatctggcagggagaccttccgcaggatgtggaagtggcttcaggagcccgagttccagcgcatgtccgccttacgcctggcagcgtgcaaacgcaaagagcaagaaccaaacaaagacaggaacaattcccagaagaagtcccgcctggtgttcactgacctccaacgccgaacactcttcgccatcttcaaggagaacaaacgcccgtcaaaggagatgcagatcaccatttcccagcagctgggcctggagctcacaaccgtcagcaacttcttcatgaacgcccggcgccgcagcctggagaagtggcaagacgatctgagcacagggggctcctcgtccacctccagcacgtgtaccaaagcatgatggaaggactctcacttgggcacaagtcacctccaaatgaggacaacagataccaaaagaaaacaaaggaaaaagacaccggattcctagctggggcccttcactggtgatttgaaagcacaattctcttgcaaagaaacttatattctagctgtaatcataggccaggtgttcttcttttgtttttaatggctatggagtccaagtgcaagctgaaaaattaatctcttagaaccagacactgttctctgagcatgctaagcatcccagaaacccaaatggggccttcctggagcgagttaattccagtatggtgtcaaccaagctcgggattgcttaaaatatcatccatcccacttcaggtcctgtcagcttcttgcagtcagagttcctatgagtaacaataggagtttggcctatgtaaggactctgagtttaggcttccaagatacaacaataagagaagaatctagcaacgagaatgacctcatttgctttccacatgcttagcctcattataccatgttatgtccaagttcacagccacaacatcagaatggtaattactgagcacaagttttaaatatggacgttaaaaaaaaaaatccaaggacctgtttttccaacccagacatcttttcattgaatgatttagaaagctttaagttgatccagcttacaattttttttttctttacctcctggaaatctcatatggtcttggatccgtcaaaaaaaccagtcagttcacttgcgctcaaagtatcaagcacaacaaagataaacagaagtgaggaaggttctgggttcactacatctggattttcaagacacctattgtgaagtcattagggaattgatgagaatatggcttcaagcacattttgcagtttgctacaaattctgttgtacataatgcagacgcacactcaggaggccaatttaactgttaacagtgcatggagcgaatgcagcattttaaaagatctaggtttttttaggtcattaatgtgtccttggttgatcagtcatctggtccctcctactgtgtgttatgaccaccacgtaatccattctcgctctttctgatttggggtttttcctcatccatcccattagtagggatgttttctgtgttttctagcaagaaaaaaaaatcaatcaatcaaacctgcatacatgttactcatgactgtcatctagtcctaaatctcttctgttgttgaatcatccttgcaaaacagctgaatacatctggagaaaacacagcacaccaaagaagcagaatactgcaaaccaaagacatttatgacttgtcattttctagcctaaaaatactgtgattacttttagaaatcagaaaacctctgcaactccgaatggcattcagctcttgcatttggcgcatcatcgggctgagcggaccagctacaccaaggacattagccaagccacccagaggggtggctttgccacaccagttgtcaccttcccatagcaagtggaagagcgcccacagaactctgggagattgcaaaggtcacaatgtgcatatttaccagtgaatggccccgggtggggccacgtgggggtgttcaaagcaagccaaacgctgcaatcattctttacagacacttgagactgacttttttatgaattacttagtcgaaaccaaagaaactttttctgcacctacttctgcaacaaacaaaactgtcccattaaaatgaataaataaatccgtaaatcaatggaaatcaccaccaataagaaggaagcacgccagaaaataaacgaaaacaaaaacagggagacacactgtgttcaaacagacctcttgggacattttttggaagcagattttaaagaaagggttgagacaaagatagaaataaggaagagcctcagtggctgctgcttcatttgacaactcacacggtaatcttaaagctgaagattgtctttaatttgtgcctatgcagtttttcaaaagaacacggaacagagcaacagaaacctcaacagctacaataccaaagatgaggatttctcacaccttttgtttcagttcattatctcctcttgcctggctaaaatactaatagcgccattgaactgtataaaggtaatcaattatgtttctctgagcaacaaaaggaaagggccatttatttgattttattgtttcatttcaattttgtcttatggttttttgccccaacatggaatctctcaaaagtttccatggactccaagtttaagatgttgggatattgaacagttctctctgctcagcagagggtagggaataacattatcacttgaatgttctttgcttaacccttagacttggttccttctatgttcagagtctcatcatcaggggaaggaaagggagtgagggtcagggataggggtcttggtgatgcatcctctcccgagccacagaaccaaagagtttatagaggaatttacagcctcgttttcatgtgattgctacatcctaacagggcttcatttgggggtggggggaaacatgtaaaaataattgccagtttctacttttctattagctttttaaaaatcagctgtaaagttgcatttctaaagaaagatatatataatatataaaatacatatatagatcaacttgacattggtgataaccaaaattattgctgtccaaattcatgtcttgttttggtccagtgcttcatttgctaagtattcggttcagaatttttctcatttctcatgccattccagagttaatttgccactgtggatgatttgaagtattcagatctctatggaagtttctgggacaggtttaaagtcaagatcaagcattttagcatttaacctgttgataaatggatccatggtgtacatgagttttatttgtattcggagtcatctctattctatccctcagcctcgattaaggtggtgagtgaagtgcatccaacagactcggcccagaactgggtcctgacagtggggtgctcatcttctgtaactgttgggaaggctcggtggtccattttcaccagttaaagaatatgaggccagcccagaaatctgttctccaggagctgccctgtcccatctgggtgtgccagaccccctcagtgagcaggtccaccaaagggacttctcacaggggaagcccaactcctgttgcaatgggttgatagatttcctcagggtggtaattaccaattcgtattttgacaagcctatgtgcaaccacagctggcactggggtgggcagtggtgttgggtgggatgggggagagtgtctcaatcctgaagagaaaatataaagcaggttttggggagacttctggagtcctgcccctagagagccccattgttgttctttgtgccccctcctcattccccctatgtgggtctccctatgcaggagctgtgagagaatgtgactctccacaatttttataattcatccttcctaggagattgttcattggctcttcccttgtgtccctttgtcccttgctcatactccatgtttcctttgtcaaaggactaagaaaagagcatatttcagcagaggagtgttcccatgtgggttgatttcaacttgggtatttctaaaagagtccttgtgacatgtgtccagtggaaatggttgctcttttccagactggattgaggaatggagcctgtttgatttggttagtgattctttgacatactaatctcagcgtttgggtctccagcatcctctgaagatgtctagactagtagaggctgcctttgtgacctgacattacaacattggtcaaaccagtcctctgataatcagaagaacatgtcataattgtttaaaaaaaaaaaaaaggcaagaatttctctccaaggagctttaataaatgtctcattccagataatgtcataccagagaaaagtgcttgcttttagaaaattatttacatacatatataaatatatatgtgtatctatacagttatgtatcaaaattttaagccctgcagaatttcaatttgttagaaatctaacagaaaaaaatttctatattgaaaggtaatagaatttaacccagtgagtttactcaaggatttttaaatttaagttaataatttcagagaaaataaccatttgggtgtggttatagtttagtatccattacctcaatccaaggaaaattccaggcattcctcaaccatcaggaaaaggtacagtgtgaaggaacagttctcagccaaatttcacattcttgaggcaacagaaatcaaaacactcagagccattgagtggaaaaacaatttactttattcctttacacaaataggcttgcattgtttttgttttaatgtgattttggtactagggatataattatttcattccaggaaataataaaaaaaaacagacagagccaatacatttctttttttaaaggaaacagcaacaacaataaaaactcagcaccaatatttaaaagcttttccaaaatgtaaaagaagtgtttagcttgcaccatgcataaaggtgcaggctagttgaaccaggaagcatggcacttcctctggagaaatccagaaagagttgcttctaagctcccttttccccctgcaggctcttggcaattgtaggctttagcaaatccagaataattttcaattcaagctaaaataaaatcaacatttggaatgtaaatctgatacacacacacttttctaagtcaaacaacatatttcaaaaccaaaaataaataccttttagataatcagttattttctttgtctatactgggcacccacctactagtgccagtaaattcaagttgaacagatttttaaaatcactattatctgggtatgggggaaacttccccacttttgaaaatgttggtagaattataggaatgtctgtttgattatcattaccaaagtgtcatgacagtatgcctttgtagtgaactcggattttcaggagtttgaatagttggatattttaaaatctaagaagaaaaggcctgtttccaatgttgttgaagaataatgaactctattaaaaagtggagaaaaagataatacatgtggtcaaggttgaccacaaggcccaggcacaactaccttggcgataatcttctagattcgtaacaggttagagctgactttttgtttttgttgttgctgatgctgtgtgattcagacttctcagcctaaccaggaagagtaagtggaaatggtagatgaagaaggggtagagctggtgtatctataactttctgatatttgtctgccaaacttgatatattagtaatttttttatctttagctaagatcaagtcacccctgaaacaacaggagattctagttttaaaataaggccacaaaaatccttacggaatgaagaatggcaccccagttggttgtataagtctcataagataatgatgttgattttaaatatggatgtctcaatgcctgttttctatcaatgatttgtttgtttccaaggtcggggagggaaagaggggagggtttatctgttttagaaagtctcagaatacttataaaatacagaagtagttattaaaatatataggacctcacataggtagatacagaacttaccattgaggctgatgggctgttgtgtgaatcacacaggaccttaaatgaggctcattattctcacacaccaaaatgactctgacagcctgaagcagttattgctagagcccaagctttccttggaggttttggagttaggttgattggaagtaaccagctaataccttttctagtggagaaaaagacattgctaccagcttgttcatcccatagaagtcttccactctgctccatttttagcagcaagcatttcatgtagcataaaccttggcagataagtgtgcctaaggtttatacagtctgtccgcttggatgtatacaaatttagatacatattttaacatgtgttctcatagatgactttataacaacacacattacctataggtgtctagactgtgtacatacaagtgtgtacagacaagcttcatacgtatatactgtaatccgttacaacaaataaattttaaatcatcgtttaacatgtatgtggtacttctacagtgtacattgttttcattatttattgtaacattgaaaaccacagtgcagggaaaacaaaagtatcccagcatcttcatcctgtacacttggaattaatttcatttgggcatatccaagataaactcaactttcaagaaatcttgtatattatttaatcatctgtgttaggatgacacctatgattgatgacttcggttgaatagctttattctggatttttcataactaaagctaaatccaaagacctgaaaaaggacaaaaagaaaaaaaaaaaaagaaaaaacaaagaaaaagaagaaaaaataataaagtcaagcgcaaactgatggggagacagtgggctctggtttccaggattgagacaatggtactgcggtcttggggagactgcgttagctagtggggagtggtgatttttttcatgcttgtcacatctaaatggtctttaacatgagaaagttttagaggttataatttcctgctttgtttttatttagactatcaaatgaagttatacatgttgtcagtcaaaaaatgaagacaccctctgccccaccccacagaatgctttttatcttgtctctttgggttatgacccaacaagctaagtaccattaatgtaattaacttatttaaattagttcctagtacataaatgtataggatttgggtaattatttaatcatccttccttagtttgattctactccttgtacttatttatcaaaacctagaccaatggtgcatcagagatgcaaaattctacttggaatactcttgaagtttagtttgctttataaagcagtgaaattctgttacagacagggaagaaatacaggttacaaaaagagaatttgggatattcttccctcttaaattaacttttaaaatagtctaagtaacaatttttaaattatttaacttaagttcgcagccccacctggtaccaggcgaacttcacctcttaattattgtggccctcggagccttcatattgtaacttatttatttaacttattcagcatctgtgaaaggtgcactgtatagtttatatttttaatttaaaacaacagagagcactgcagtttgtttgctgtcagaacaacagagcaaattttgtggacaagcaatgactattcagcctgaacctgtgcattcagaaaacataagctgagaccctgcttcaccagcctggatttcggggcttctatacagaaactggaaaaataaattttaaaaaaatcgtaaacaaaaagagagaaacccttacactagctgcttccaagaatgaactctgtgtgtatgtaaagcaacaaaacaaaaaaggaaaaaaacaaaaagcagaaaaaagaaaaaaaaaatgaaaaactttctatttctagtgagaaccaaagaaggctacctcactgactttttccatttgtaattttaatcgtgttgatgacaccaaagataccaaagatttctttctctgtgcggtctgcattttgcttgtgctcttttataatttgaacgattttctctgacatatggtatgtacagccacagctcagataccccaaagaaataattatctatgcgacggcggctgctaatttggaaagggatattttctgtgtttctcttatatgtttgctgtctgctcgacatgttcaagatgcgagttcagatgctgctgtaattggattccttaaattctgattacaaattgaggaaggaaactggttggaaatggccttcagtcctagccatggcctctatccccgctgggacctgtcacagtaaagactgccaattactgaaccacagaagctctgaccattgagtagttgagctggaagagaccttaggaatcatttagtccaagccccggtggcccagaggaatgaaatagttatccaaatcaaataactcttgagagtgaaagcccacacatgcctcctggttcctgccccagtgctccgcttattgtacagtgctacctctgcatgagagcggtcccacattgacaaataggatggtggcaatcctttagcaatgagcagggactggggtttatctcttaacattttcagctgtaaaattagtcacaagcattttcagtgtcccattagtacatagtcacatatggtcggttgcttcgtgaaggtggcctgtcttgaaatactagggctcatacgggatttttgccctaggaaaaacatgttgatcccaatgatgtgatcacttttgaacctttccattacaaagcattgtatagataactttttaattcagtaggaggagaaagttcattcttggcctgttggctttgattattatgggtactttaaagtcagtatttatcaagaaagggaacttgaccaccattggcacatgtgacatttaagctcttcagccttttcctttttagttgtaggtgtttacatttcatttctaagccaactctgtatttatgagagaagtttaagccttacatcatttgatactaaagggttatttgtggtaaatgaaaaatgaccccaaaattacagaggaatatgccagtttaagaaatggctacttaaagttgcttctctctttccttcttactcatgaaattaattggtcttcttcaagtttctttagattccattaaatgattaaatcactattaagagccattcatcaacgtgatttgtgtgttagccaatgaatctgtctcagcttttgaccaaatgggttttagacaaatgcaaagatctgcctctagtccatatggctctttttgagtgctagtattttgcatttcacataatgtagttattttgagcttttaaagagagcatttagacaaagaagcaaagagaggaagggaccaatcaactcatcagttccatgcatcaacaaagcatagctagtagaggaatataaatgacagattgacaaactgtaggaaacactgttactctctttctgaagttttcaagcaccatcctatgtgaaagttccctcctgtccaaacaagctcaaggcccatcttctccctatacaaggcaaacctgtaaggccttccttccaaagagtacattgctttggttttcttcctaaattcctattggaattagaactctcagaatccctgggagacagagcaaagatgacttaattcattgagcagcagagctccctataagtgaacatcaccttccccatctttcctactgccacacccatacgagagaggatctagaaagagcgatggcagcctgaacacagaaaacatccccacttggcagacctctcctcagcaatccccccagcctcatgcttcacttgcaaagtgtgacataaccacgggacgagtgccttgcttgaaccaaagcaacgatttagccagtctggacctctctgtgctttttttaattcttcctgtgaatacctcagcttcaactgggcctccatacagtcagttggtgggcttattgtactgtggtgctttgcaatgcaaccctgcaaagaacaagatttgtactaataccaaaggttctttctctatgtctcctcctctgcctccctcgttcttcccttttttctagttcttcacggttccaaagctttactatgaacctgggcatgttggcaatgcagaccgcgcaattccttaccgaattttctcagatatacctcatagacaatagtgtttagagtaatgttattatagcgtatgtaataaattattcactgtttcttttggtaactgtgatttaaaaaaagaaaaaagaaaaaaaagctttatacgttttaggttgtgcttttgtaatagatgaaaaaaggtgcgcttaaaaagaaaatgtatgtttttttccccctttggattttatttatgctggattggggaaagttgcagaatgagcccaaagtttacagtttcatattttgctgaagaaacaatctgtgttcatttgctctgttgaaaagaataattattttctacatttgtgccacttggtctgaacaattaattgttccgtgttaacagtgtagtattatgattagcaactgccaatcagtgctataattttatgcatgaggctaaaaatttagcagtgtgatgcattgtggtcttaatagcaacatttttcattttgaactagatcttcccctttggttcaatggactttatttatgcatgggcgcctattgtttgttagcagttgtggaacagttgtgtatacattaaactgtgaaaatgtacacagttcagcctcagacggtggtaatattggttttattgggagatgtgtcacctcgaaaataccctttacatctgttgggatctgaaaatgagtcacattgaattgggttccagctttataatgagaaacgttattcctaatttttgagttagccaatttgcattccacaaattgggatcctcataacccaaatatatcaccgtatgtgagagggatttgaaagcgagtattgaaaaactcacctttgcatatttaatttccaccaaaaggagttattttggctttatgctcatgaacttagacctaactggccatgtatatgtagatgcaaattcatctagctgtggccctctttgatctctgcttgggaatggctatttttgactatgcgtggtttcttctcgtattttgtgatcaggtcagctcccagtagaaactcaaatggcatcaatattactaactcttctctgcccacttctcttttgtccactctcctagacattcccaccaactgttccagtgatttgggcaaaaatacgcagccatttcccaaaacttcacatgtgcagctatcatggctgtccctccctagacttggaggtgactctcacttaatttttacctgcccaacaatgttccatctaccatctaaaaggtaatataagaagaagttttgaaacccactttaggaaaaccatcttctttaaatccttcaattatctgaggcctctatatgtcaaaactatttttcagttgcaggggattgggcaaacttgttctttcttatacttgggttcaaagacccattctccagtttcatatttcccaaaccaaaatgcttgacataaagccaaatcaactgccaagcacactttattttgcataggagtatgcagcctagggaaccttggttgaaaagcagcagtctgctatgcaaaatattggaaatcactgacagtgtagcattcatattatctgtcaatgagggtatattgggaacgtgctctcgtgaataataaaaagcaacatatttttatttggccttataaattaggttgtggtaatgtaaactttgatatatagtctttttatttttctcttattaatctgccaaagatgggaacagatacaagaatttttcaaattggcttttgtaagacaattgatgattgtaatagtgtttaatcttccagaaagctttatatgttgttccacaataaaattgatatttgtttcagcaaagttttcctgacactcacaaacccacaaactgttcctcttaatgcagatattgtagaatctacaaagttcaaatccatttttgatccaaagaaagtagaggagtatttgagacatgagtgtacccagccctttttttaatcacaggcaatgcatgggtctggctggttacactttgccaagaagacttgtcttatgaaacccaaggtatattttgttatgccattttatgtccttttcttttaacattgtggaaagtggtatgttgaatcaagtgtaagctgagttttccagacaactgaagtagctacatcatgaatgttattttgttattaaagggtttttactcagtgctttgtgccaatggatgtccttttccttggagacacataactacaaaattacctcagcttggcctggttttctctcctgccctcttggggaaacatgggcctggcctgggaaaaggcaggtcatgggctggaaggtaggttttggtactaggaagaaatctctgtatctgtcagctttaaagagaactgggccaaaaatctctaacctcactctctctggactccaacacttccctgcaatcctttggtcttgagcatgtgccagcatgaaggcagactccagttcatacatgaaaggcaagaaaaagaaaatagtaaccttgaatcttctgtgggccaccaggcactcacctttccccaccttgcacactatccagtcaaggctattgcagcccatctggtggctttacatgggacattaccaaaggcttcttcctccatcctggggttgcaaaggatccaggtcccctccatccagtggggctcttccacatcagaagtccccctcccaccatcctctgcatcctgtttagctatcccatctataccttttggagatgattatttagaaaacaaagaaaggtatggaatggggtttcctattgtttgctaggttatattttagcaattctcaattctttgatctggaaaaatacaagagggaaaaggagaccccactatctccctgtgctttgctcccatctcagggggcaggggcagtgcacattgcctatgctgttgatctgtcttgggcgacaggctgaatcacagctattgccccagccaaaaacatggcccatcaatgcctactttatctctgcttgaaaatcctattcaaaaagttgtagagtttgaggtttttatccccccatatcctttgctttggtccagtttggcctttagcataagagtcagctttatctctaggaaagttttttcagattatgacaaggaacctgccacctgggaagaaaagagtccgaagactagcaatcggataggtagtcataccattaacagatacttccttgaaggtagaatattatttcctttctttacagttttgtgttacacaagtccaagtggtgccagcaaacttcttaccgtgaaatgttgtaaaacacctggcatactgaaatttctgaaacaaaaacacaagctccacattgataacttgataaataaccactaaagtttagatgcagggactgagatgatacaggcaaaatcttggtgttggtttctcttttaattcgtatcttcgatcacctaacctttctcaatccaagagcagttcagtcttttctccccaagtctaggatgccaaagagcatcataggaaaagataattagggattgaccagcatttcaattagttctcttcttcatctttgcatttctcaaaagtgttctcctggaccagagggaaagagctggtccattttttttcattctttctattcaaatttttccacccagacaatactttattaacacagatactgtagatccttccttggtcagtgaattattacaagaggagctatccttccaccaaagtgagtgaaaacaagttccagtatcttttcttccatccagttttgttctcagaatccaagtcagtcctgggtcttttctcactttagaccctggcctcagatgtgtttattcttgctatttaaaaatacctttaaatttcacatgctggcctgcagaacttgcatcctttgttctatactgttgactgcttgatggtattgaaaggtgactataatgagggaagaaaggaggaggtaaagagagaagaatttgtcccagatctgtttaaagtttcaaaatttaaaaagggacccattaaattatgggaaaatggctatagagtgtgagcctccgttgaccatatgctcaaagaccgtactctgccacctgccttccaggtagctattctagaaactcagtcctttgtggaaacccaactaccttttaaaagtctctttccagattccaaaaggacaagagatcagagagtcacatatacgcctcttgttttattttcttgctttcacgggtattattgccaagaaaatcgtagggaaaaactttaaacttttcttttcagttgatccctttgacatcacctctcatgtttaaaatcaggaaaacacacccctaaaatttgcactctcttccgttttgaaaaagaaaacccacacacaaatgcacactattaccgtctttcaccctgcgctatatttccaaagtgtattataatccagatattgccccatctcaaacatgttaagtcagactgtgctgaaagactttccagggacggtcaacagggtatatgttcagtggctgccctgaaatcctggtggggatgaggatcacgcttcatcatcaaggggatgcccatcccctgataagctcccagtccttttggaagatttctttgaatgttaattgcattttcagttttgctcatttcccaccccaatgttttgtctgcaacatcgcttacactggattctttctatttttattcctatcattaaatggtagtgctgtaaattctgcaattaatgttaaataaactgctttaattcattga

SEQ ID NO: 21084 - DNA, 478 bp, Homo sapiens
atggtcgatgatgctggtgccgctgagtcccagcggggcaaacagactccggcccactccctggagcagctgcgtaggttaccacttccgccgccacagattcgcatccggccctggtggtttccggtgcaggaactgagagaccctttggtgttctacctagaggcatggctggcagacgagctctttggcccagaccgagccataattccagaaatggagtggacgagccaggccctgctgacagtggacatagttgactcagggaacctagtcgaaatcaccgttttcgggcggccccgtgtacagaatcgggtgaagagcatgctcctgtgcctggcatggtttcaccgagaacatcgtgcccgagctgagaagatgaaacaccttgagaagaacttgaaggcccatgcatcagacccccactctccccaggatcctgttgcttaagacaacatagttactgttgggaacatct

SEQ ID NO: 21085 - DNA, 1774 bp, Homo sapiens
ccgaggagcctgcggctgctcctggctcacagcgctccgggcgaggagagcgggcggacgccgggggctgggccggtgcgggcggcgaggcaggcggacgaggcgcagagacagcggggcggccggggcgcggcagccggcggcgtcggggccgcggcctctgccttgccgctcccctcgcgtcggatccccgcgcccagggcgcacggtggagagggacgcggcggagccggccggcagccatggaaccggccccctccgccggcgccgagctgcagcccccgctcttcgccaacgcctcggacgcctaccctagcgcctgccccagcgctggcgccaatgcgtcggggccgccaggcgcgcggagcgcctcgtccctcgccctggcaatcgccatcaccgcgctctactcggccgtgtgcgccgtggggctgctgggcaacgtgcttgtcatgttcggcatcgtccggtacactaagatgaagacggccaccaacatctacatcttcaacctggccttagccgatgcgctggccaccagcacgctgcctttccagagtgccaagtacctgatggagacgtggcccttcggcgagctgctctgcaaggctgtgctctccatcgactactacaatatgttcaccagcatcttcacgctcaccatgatgagtgttgaccgctacatcgctgtctgccaccctgtcaaggccctggacttccgcacgcctgccaaggccaagctgatcaacatctgtatctgggtcctggcctcaggcgttggcgtgcccatcatggtcatggctgtgacccgtccccgggacggggcagtggtgtgcatgctccagttccccagccccagctggtactgggacacggtgaccaagatctgcgtgttcctcttcgccttcgtggtgcccatcctcatcatcaccgtgtgctatggcctcatgctgctgcgcctgcgcagtgtgcgcctgctgtcgggctccaaggagaaggaccgcagcctgcggcgcatcacgcgcatggtgctggtggttgtgggcgccttcgtggtgtgttgggcgcccatccacatcttcgtcatcgtctggacgctggtggacatcgaccggcgcgacccgctggtggtggctgcgctgcacctgtgcatcgcgctgggctacgccaatagcagcctcaaccccgtgctctacgctttcctcgacgagaacttcaagcgctgcttccgccagctctgccgcaagccctgcggccgcccagaccccagcagcttcagccgcgcccgcgaagccacggcccgcgagcgtgtcaccgcctgcaccccgtccgatggtcccggcggtggcgctgccgcctgaccaggccatccggcccccagagcgcccctccctagtgacccggaggccacatgagtcccagtgggaggcgcgagccatgatgtggagtggggcagtagaaggtcggaggcttgggaccgccagatggggcctctgtttcggagacgggaccgggccgctagatgggcatggggtgggcctctggtttggggcgaggcagaggacagatcaatggcgcagtgcctctggtctgggtgccccgtccacggctctaggtggggcgggaaagccagtgactccaggagaggagcgggacctgtggctctacaactgagtccttaaacagggcatctccaggaaggcggggcttcaaccttgagacagcttcggtttctaacttggagccggactttcggagttgggggtccgggccc

SEQ ID NO: 21086 - DNA, 975 bp, Homo sapiens
atggaaccggccccctccgccggcgccgagctgcagcccccgctcttcgccaacgcctcggacgcctaccctagcgcctgccccagcgctggcgccaatgcgtcggggccgccaggcgcgcggagcgcctcgtccctcgccctggcaatcgccatcaccgcgctctactcggccgtgtgcgccgtggggctgctgggcaacgtgcttgtcatgttcggcatcgtccggtacactaagatgaagacggccaccaacatctacatcttcaacctggccttagccgatgcgctggccaccagcacgctgcctttccagagtgccaagtacctgatggagacgtggcccttcggcgagctgctctgcaaggctgtgctctccatcgactactacaatatgttcaccagcatcttcacgctcaccatgatgagtgttgaccgctacatcgctgtctgccaccctgtcaaggccctggacttccgcacgcctgccaaggccaagctgatcaacatctgtatctgggtcctggcctcaggcgttggcgtgcccatcatggtcatggctgtgacccgtccccgggacggggcagtggtgtgcatgctccagttccccagccccagctggtactgggacacggtgaccaagatctgcgtgttcctcttcgccttcgtggtgtgttgggcgcccatccacatcttcgtcatcgtctggacgctggtggacatcgaccggcgcgacccgctggtggtggctgcgctgcacctgtgcatcgcgctgggctacgccaatagcagcctcaaccccgtgctctacgctttcctcgacgagaacttcaagcgctgcttccgccagctctgccgcaagccctgcggccgcccagaccccagcagcttcagccgcgcccgcgaagccacggcccgcgagcgtgtcaccgcctgcaccccgtccgatggtcccggcggtggcgctgccgcctga

SEQ ID NO: 21087 - DNA, 5014 bp, Homo sapiens
agccgcgtcccggctgcgtcccgccggtcccgccccgccccgccccgcagagccgccgccagtagtgggagacgtgcgctgagaggcgggggctgcgctcggcggaacagcagccctcgggcggagagcggggccggggtccgagagcaggtgatgccaagagctgagcgggactcgtgagcgcgcggttcagcacctaccagggcgtcccgtaaaaaacctcgccttcgcctgtctctgggaaccatagcgccgcaggtgccgcctgtcctcgccttcctgctgcaatcgccccaccatggactccccgatccagatcttccgcggggagccgggccctacctgcgccccgagcgcctgcctgccccccaacagcagcgcctggtttcccggctgggccgagcccgacagcaacggcagcgccggctcggaggacgcgcagctggagcccgcgcacatctccccggccatcccggtcatcatcacggcggtctactccgtagtgttcgtcgtgggcttggtgggcaactcgctggtcatgttcgtgatcatccgatacacaaagatgaagacagcaaccaacatttacatatttaacctggctttggcagatgctttagttactacaaccatgccctttcagagtacggtctacttgatgaattcctggccttttggggatgtgctgtgcaagatagtaatttccattgattactacaacatgttcaccagcatcttcaccttgaccatgatgagcgtggaccgctacattgccgtgtgccaccccgtgaaggctttggacttccgcacacccttgaaggcaaagatcatcaatatctgcatctggctgctgtcgtcatctgttggcatctctgcaatagtccttggaggcaccaaagtcagggaagacgtcgatgtcattgagtgctccttgcagttcccagatgatgactactcctggtgggacctcttcatgaagatctgcgtcttcatctttgccttcgtgatccctgtcctcatcatcatcgtctgctacaccctgatgatcctgcgtctcaagagcgtccggctcctttctggctcccgagagaaagatcgcaacctgcgtaggatcaccagactggtcctggtggtggtggcagtcttcgtcgtctgctggactcccattcacatattcatcctggtggaggctctggggagcacctcccacagcacagctgctctctccagctattacttctgcatcgccttaggctataccaacagtagcctgaatcccattctctacgcctttcttgatgaaaacttcaagcggtgtttccgggacttctgctttccactgaagatgaggatggagcggcagagcactagcagagtccgaaatacagttcaggatcctgcttacctgagggacatcgatgggatgaataaaccagtatgactagtcgtggagatgtcttcgtacagttcttcgggaagagaggagttcaatgatctaggtttaactcagatcactactgcagtctgacatgaaaagatagaatttaaaataaacttttagagatctcatggtctgaagtcatcagatgcagaccacgttcgtgatcagtggaaacatcaaggacaaaaggtccacgcaacacatgcacctcttctctagggcacagaagcgaggcagagcctcagttcctctgatgaacaagggaacaggtcttttccttctggtttgctaggtaaggttcagcacccatctgctgtggccttcctatgaaacgtagtttcaaaagctcggtttaagaaaaaaggaaaagaaaaaacattgctttcagagctcaatgggcatccaatccagatgtttcacaatgacagcaacaacctccaacggaatgggaactatttccagggttcatgcccagctcactgtatgctgtgtggacatgcatttcatgtggctgtgtggtaagaattacagcttacatatggcttggacccacatctgaggaatctgatgttcacttataccagaacattatcttgctatttatgaaattatttaaacgttcaaaagattgtttttaacatggtttaatttcccaaaaactacagttttttttcttagcatgctattcaggtaaacagtcttataataaagcatgtcccattgtcaagaaacataaagtggtgtgaataccactgaaaatatatatatagtatcttctgtaaataatagtacctgtgtgaataaggaataggcttgcctcccagccaggcaatttcctgagggcacactaatgatatcccctgagttgctaagttgatgctgagacattttgctgggaattagtcatggcatgatctctttcagactccctgaataccatttagtcccgtaacagtgctcacaactcatgtgctaatgaatcacaaaggctttaactagctcccaggttgtagccttcgcaggatctagtttatttgccacatctctttatgaacatatagcgattcgcagatctctctattcacggagaggaaggtgttttgcttctgtagatctcaaggtactattttgtggctctcagcaggaagtagaattgttcctaaatgtgtgctgaatgaggacatgatgtccctcctggtgccaggacacatcctgcatggcattctgtgaagggcatacctgctgaggataatgccaggagcagcacatttagggtaattttgctaaaacttccagatgacatataaattccctctttttccccctgaaacttaccatttcagaggtaatggctttttctgtaatttgcctgagaagaaaaaagggataatttagaaataacactccaagcctatatattactagggctgcatcctctggaatttaatagaaaaattgaatatatagccctatgtaactacagacatcattacaactgttaagttctgttcaccatgcaagttctcggtggtgtatgtactctcaccttttggaaacaaaaccttgcattgaaggttttacacatggcttcagaatgttactctgaccatgtttgcctctactccagattatcatggcacctaacacagatgacatatggcagaatggaagtgatttctcctaatgaaaatgaagtgctcttttgagtatttcttgttttattgagattcctatctgcccttgtatttttataactgaatgtaaataggaattgcttaaatactggtttacactaatcccatagttaaaaatcttggctatggtacaggaaggatatctatatagaggatagttccagaaacaagccctggtgaaataggaaatataaaaacttctttatggaacaggaaaacccaagagactttctcgtcagattcctttccagtgcaaagtataacagagataggattatgagatgaaatcacagtagtgtgtttcctttaattttttctgtcttctttttttttttttttttttttgagacggagtctcgctctgttgcccaggctggagtgcggtagcacagtcttggctcactgcaacctccacctcctgggttcaagcgattctcctgcctctgcctcctaagtagctgggattacaggcgtgcaccgccaagcccggctaatttttgtatttttagtagagacggggtttcaccatgttatgcaggctggtctcaaactcctgacctcagaatattcacctgcctcggcctcccaaagtgctgggattacagatgtgaatggccacgcctggcctgtttcctttaagttagcacttcacgtgctcttacagcgttaattgccattattggtttgcctgattttcctgcatctcctcatatgtaagtctgcagcccaaggagagaatagtagctgtatgtgcccacaaggggtgtccaagcttcttgattcttgttaatatcgactccccaacattgaaaaaggagtgaagaagggaatatcattttagggtactgctttaaaggaatgataaagtaaacaacgtagcagggaaaataccacttgcacaaatgtatttctttgtcaaagtgtgtacacgctttctgtttgtcctgatgtcctgctgtgaagcagggaccacattgccatttattcattgttccaggcaatgcatttgtccaaacccctctggctctctgatatctctcatttcttgatgttcctattctctgacctcaacaaggaggacactgtctgttgtgtctctttgagactagaactccatgtgtttaaccttcagatccattctctacatgaaccctattctttccaccctggtaagaaggtctggaagacaggtcctaacgaggggtcagagaaggcacagagaaatgaaccagccatgcaggggcagcactgaggaggaaaccccccactctaactgggaggagagtggaaacactcttagtatctcagagtagttaccaatctaagagcatccttcgagtttaagtcaaaactctaggcttaataccaaaaataatacatcatttggaaaaatagcttggagaaaaaaaatcaataaagagtcacataaaatcttaagaaaatggttctattctgtgatatattactaagaaatacagttcttaaacgtgtataactattgtcagacaatttataggtgtttcatctagtcctgggatgaaatacgatgactcatgcaaattcagggagcacactggctgactttaaattggaacattgtaaagtgaaagctgtgaaaggttgtgtgtcctatcaatgagatttattttctaaccaagagctgttcggatgattcagtataaatacgaaaatcacatccaaaaacggtataacccagcttccttaaggcaattttcttctctgaaacaagaatatactcatatgttctttactataatgtatatgatttttatcttgtactttaaaagatgataattatgcattgtatatacgattgtgtgccttgcaataaaatcaaaactgtacctgctgaaaatca

SEQ ID NO: 21088 - DNA, 1395 bp, Homo sapiens
agtgggagacgtgcgctgagaggcgggggctgcgctcggcggaacagcagccctcgggcggagagcggggccggggtccgagagcaggtgatgccaagagctgagcgggactcgtgagcgcgcggttcagcacctaccagggcgtcccgtaaaaaacctcgccttcgcctgtctctgggaaccatagcgccgcaggtgccgcctgtcctcgccttcctgctgcaatcgccccaccatggactccccgatccagatcttccgcggggagccgggccctacctgcgccccgagcgcctgcctgccccccaacagcagcgccggctcggaggacgcgcagctggagcccgcgcacatctccccggccatcccggtcatcatcacggcggtctactccgtagtgttcgtcgtgggcttggtgggcaactcgctggtcatgttcgtgatcatccgatacacaaagatgaagacagcaaccaacatttacatatttaacctggctttggcagatgctttagttactacaaccatgccctttcagagtacggtctacttgatgaattcctggccttttggggatgtgctgtgcaagatagtaatttccattgattactacaacatgttcaccagcatcttcaccttgaccatgatgagcgtggaccgctacattgccgtgtgccaccccgtgaaggctttggacttccgcacacccttgaaggcaaagatcatcaatatctgcatctggctgctgtcgtcatctgttggcatctctgcaatagtccttggaggcaccaaagtcagggaagacgtcgatgtcattgagtgctccttgcagttcccagatgatgactactcctggtgggacctcttcatgaagatctgcgtcttcatctttgccttcgtgatccctgtcctcatcatcatcgtctgctacaccctgatgatcctgcgtctcaagagcgtccggctcctttctggctcccgagagaaagatcgcaacctgcgtaggatcaccagactggtcctggtggtggtggcagtcttcgtcgtctgctggactcccattcacatattcatcctggtggaggctctggggagcacctcccacagcacagctgctctctccagctattacttctgcatcgccttaggctataccaacagtagcctgaatcccattctctacgcctttcttgatgaaaacttcaagcggtgtttccgggacttctgctttccactgaagatgaggatggagcggcagagcactagcagagtccgaaatacagttcaggatcctgcttacctgagggacatcgatgggatgaataaaccagtatgactagtcgtggagatgtcttcgtacagttcttcgggaagagaggagttcaatgatctagg

SEQ ID NO: 21089 - DNA, 1602 bp, Homo sapiens
gagctccgtgctgggaggtgggaagggggcttgaccctggggactcaggcagtctggggacagttccaccaggggccggtgcctagaattggtgagggaggcacctcaggggctgggggagaaggagcgagcgctcttcgcccctctctggcacccagcggcgcgcctgctggccggaaaggcagcgagaagtccgttctccctgtcctgcccccggcgacttgcggcccgggtgggagtccgcaggctccgggtccccagcgccgctggccagggcgcgggcaaagtttgcctctccgcgtccagccggttctttcgctcccgcagcgccgcaggtgccgcctgtcctcgccttcctgctgcaatcgccccaccatggactccccgatccagatcttccgcggggagccgggccctacctgcgccccgagcgcctgcctgccccccaacagcagcgcctggtttcccggctgggccgagcccgacagcaacggcagcgccggctcggaggacgcgcagctggagcccgcgcacatctccccggccatcccggtcatcatcacggcggtctactccgtagtgttcgtcgtgggcttggtgggcaactcgctggtcatgttcgtgatcatccgatacacaaagatgaagacagcaaccaacatttacatatttaacctggctttggcagatgctttagttactacaaccatgccctttcagagtacggtctacttgatgaattcctggccttttggggatgtgctgtgcaagatagtaatttccattgattactacaacatgttcaccagcatcttcaccttgaccatgatgagcgtggaccgctacattgccgtgtgccaccccgtgaaggctttggacttccgcacacccttgaaggcaaagatcatcaatatctgcatctggctgctgtcgtcatctgttggcatctctgcaatagtccttggaggcaccaaagtcagggaagacgtcgatgtcattgagtgctccttgcagttcccagatgatgactactcctggtgggacctcttcatgaagatctgcgtcttcatctttgccttcgtgatccctgtcctcatcatcatcgtctgctacaccctgatgatcctgcgtctcaagagcgtccggctcctttctggctcccgagagaaagatcgcaacctgcgtaggatcaccagactggtcctggtggtggtggcagtcttcgtcgtctgctggactcccattcacatattcatcctggtggaggctctggggagcacctcccacagcacagctgctctctccagctattacttctgcatcgccttaggctataccaacagtagcctgaatcccattctctacgcctttcttgatgaaaacttcaagcggtgtttccgggacttctgctttccactgaagatgaggatggagcggcagagcactagcagagtccgaaatacagttcaggatcctgcttacctgagggacatcgatgggatgaataaaccagtatgactagtcgtggagatgtcttcgtacagttcttcgggaagagaggagttcaatgatctaggtttaactcagatcactactgcagtc

SEQ ID NO: 21090 - DNA, 1465 bp, Homo sapiens
cggtgctcctggctacctcgcacagcggtgcccgcccggccgtcagtaccatggacagcagcgctgcccccacgaacgccagcaattgcactgatgccttggcgtactcaagttgctccccagcacccagccccggttcctgggtcaacttgtcccacttagatggcaacctgtccgacccatgcggtccgaaccgcaccgacctgggcgggagagacagcctgtgccctccgaccggcagtccctccatgatcacggccatcacgatcatggccctctactccatcgtgtgcgtggtggggctcttcggaaacttcctggtcatgtatgtgattgtcagatacaccaagatgaagactgccaccaacatctacattttcaaccttgctctggcagatgccttagccaccagtaccctgcccttccagagtgtgaattacctaatgggaacatggccatttggaaccatcctttgcaagatagtgatctccatagattactataacatgttcaccagcatattcaccctctgcaccatgagtgttgatcgatacattgcagtctgccaccctgtcaaggccttagatttccgtactccccgaaatgccaaaattatcaatgtctgcaactggatcctctcttcagccattggtcttcctgtaatgttcatggctacaacaaaatacaggcaaggttccatagattgtacactaacattctctcatccaacctggtactgggaaaacctgctgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaccaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcagtgcctacctataccttccctgtcttgctgggctctagagcaaggctgcttggttgtgtaccctggaccactgcaaggacctcttgtcagatatgacctcccagctatccttcactcgtcctgccttcgtggaaatactgctcccagcccgtctggtggagcatttctcctgagttaagcatgattattcttcagttgcccgacactgcccttgactcccttccaaattcggcattttcacatcagtatggc

SEQ ID NO: 21091 - DNA, 2178 bp, Homo sapiens
gatgagcctctgtgaactactaaggtgggagggggctatacgcagaggagaatgtcagatgctcagctcggtcccctccgcctgacgctcctctctgtctcagccaggactggtttctgtaagaaacagcaggagctgtggcagcggcgaaaggaagcggctgaggcgcttggaacccgaaaagtctcggtgctcctggctacctcgcacagcggtgcccgcccggccgtcagtaccatggacagcagcgctgcccccacgaacgccagcaattgcactgatgccttggcgtactcaagttgctccccagcacccagccccggttcctgggtcaacttgtcccacttagatggcaacctgtccgacccatgcggtccgaaccgcaccgacctgggcgggagagacagcctgtgccctccgaccggcagtccctccatgatcacggccatcacgatcatggccctctactccatcgtgtgcgtggtggggctcttcggaaacttcctggtcatgtatgtgattgtcagatacaccaagatgaagactgccaccaacatctacattttcaaccttgctctggcagatgccttagccaccagtaccctgcccttccagagtgtgaattacctaatgggaacatggccatttggaaccatcctttgcaagatagtgatctccatagattactataacatgttcaccagcatattcaccctctgcaccatgagtgttgatcgatacattgcagtctgccaccctgtcaaggccttagatttccgtactccccgaaatgccaaaattatcaatgtctgcaactggatcctctcttcagccattggtcttcctgtaatgttcatggctacaacaaaatacaggcaaggttccatagattgtacactaacattctctcatccaacctggtactgggaaaacctgctgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaccaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcagctagaaaatctggaagcagaaactgctccgttgccctaacagggtctcatgccattccgaccttcaccaagcttagaagccaccatgtatgtggaagcaggttgcttcaagaatgtgtaggaggctctaattctctaggaaagtgcctgcttttaggtcatccaacctctttcctctctggccactctgctctgcacattagagggacagccaaaagtaagtggagcatttggaaggaaaggaatataccacaccgaggagtccagtttgtgcaagacacccagtggaaccaaaacccatcgtggtatgtgaattgaagtcatcataaaaggtgacccttctgtctgtaagattttattttcaagcaaatatttatgacctcaacaaagaagaaccatcttttgttaagttcaccgtagtaacacataaagtaaatgctacctctgatcaaagcaccttgaatggaaggtccgagtctttttagtgttttgcaagggaatgaatccattattctattttagacttttaacttcaccttaaaattagcatctggctaaggcatcattttcacctccatttcttggttttgtattgtttaaaaaaataacatctctttcatctagctccataattgcaagggaagagattagcatgaaaggtaatctgaaacacagtcatgtgtcagctgtagaaaggttgattctcatgcactgcaaatacttccaaagagtcatcatgggggatttttcattcttaggctttcagtggtttgttcct

SEQ ID NO: 21092 - DNA, 1389 bp, Homo sapiens
cggtgctcctggctacctcgcacagcggtgcccgcccggccgtcagtaccatggacagcagcgctgcccccacgaacgccagcaattgcactgatgccttggcgtactcaagttgctccccagcacccagccccggttcctgggtcaacttgtcccacttagatggcaacctgtccgacccatgcggtccgaaccgcaccgacctgggcgggagagacagcctgtgccctccgaccggcagtccctccatgatcacggccatcacgatcatggccctctactccatcgtgtgcgtggtggggctcttcggaaacttcctggtcatgtatgtgattgtcagatacaccaagatgaagactgccaccaacatctacattttcaaccttgctctggcagatgccttagccaccagtaccctgcccttccagagtgtgaattacctaatgggaacatggccatttggaaccatcctttgcaagatagtgatctccatagattactataacatgttcaccagcatattcaccctctgcaccatgagtgttgatcgatacattgcagtctgccaccctgtcaaggccttagatttccgtactccccgaaatgccaaaattatcaatgtctgcaactggatcctctcttcagccattggtcttcctgtaatgttcatggctacaacaaaatacaggcaaggttccatagattgtacactaacattctctcatccaacctggtactgggaaaacctgctgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaccaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcagccacccttggcagtcagcatggcccagatctttacacgatatcctcctccgactcatcgtgagaaaacctgcaatgattacatgaagaggtagataatgtattaccctgatttggtaggtaaagtattatcctgatttatgtgacagagtgaaaggcaacttttaattgttaacc

SEQ ID NO: 21093 - DNA, 1446 bp, Homo sapiens
gatgagcctctgtgaactactaaggtgggagggggctatacgcagaggagaatgtcagatgctcagctcggtcccctccgcctgacgctcctctctgtctcagccaggactggtttctgtaagaaacagcaggagctgtggcagcggcgaaaggaagcggctgaggcgcttggaacccgaaaagtctcggtgctcctggctacctcgcacagcggtgcccgcccggccgtcagtaccatggacagcagcgctgcccccacgaacgccagcaattgcactgatgccttggcgtactcaagttgctccccagcacccagccccggttcctgggtcaacttgtcccacttagatggcaacctgtccgacccatgcggtccgaaccgcaccgacctgggcgggagagacagcctgtgccctccgaccggcagtccctccatgatcacggccatcacgatcatggccctctactccatcgtgtgcgtggtggggctcttcggaaacttcctggtcatgtatgtgattgtcagatacaccaagatgaagactgccaccaacatctacattttcaaccttgctctggcagatgccttagccaccagtaccctgcccttccagagtgtgaattacctaatgggaacatggccatttggaaccatcctttgcaagatagtgatctccatagattactataacatgttcaccagcatattcaccctctgcaccatgagtgttgatcgatacattgcagtctgccaccctgtcaaggccttagatttccgtactccccgaaatgccaaaattatcaatgtctgcaactggatcctctcttcagccattggtcttcctgtaatgttcatggctacaacaaaatacaggcaaggttccatagattgtacactaacattctctcatccaacctggtactgggaaaacctgctgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaccaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcagatcagagatccaatatcaaaccttcccagggtgtctgtattctga

SEQ ID NO: 21094 - DNA, 2485 bp, Homo sapiens
cggtgctcctggctacctcgcacagcggtgcccgcccggccgtcagtaccatggacagcagcgctgcccccacgaacgccagcaattgcactgatgccttggcgtactcaagttgctccccagcacccagccccggttcctgggtcaacttgtcccacttagatggcaacctgtccgacccatgcggtccgaaccgcaccgacctgggcgggagagacagcctgtgccctccgaccggcagtccctccatgatcacggccatcacgatcatggccctctactccatcgtgtgcgtggtggggctcttcggaaacttcctggtcatgtatgtgattgtcagatacaccaagatgaagactgccaccaacatctacattttcaaccttgctctggcagatgccttagccaccagtaccctgcccttccagagtgtgaattacctaatgggaacatggccatttggaaccatcctttgcaagatagtgatctccatagattactataacatgttcaccagcatattcaccctctgcaccatgagtgttgatcgatacattgcagtctgccaccctgtcaaggccttagatttccgtactccccgaaatgccaaaattatcaatgtctgcaactggatcctctcttcagccattggtcttcctgtaatgttcatggctacaacaaaatacaggcaaggttccatagattgtacactaacattctctcatccaacctggtactgggaaaacctgctgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaccaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcagggacctccagccaagtttgttgctgaccaacttgccgggtcgtcttgaaaagggggcttacaggtgttccaagcccgtgttttatcctgaagtatccctcaacacagaaaaacgacctcataacacaaaatacaccagcttaaaaatagcctttgaattatttttcacattaatcaaaactttacagaggagataaacactgatttttttattttattttattttattttattttattttattgccattcattcaaccgtttgcacagagagaaagaagacagaaatctgactggtaagaaattgttacccttttgccagcatgccaggcttctgggttccctttccctgagcggccctagtgatccggcttgcggcaccatcgcctacgggccaagctgcatcataaaggaaatttttttttttcattctggccagagcaaaacacatgtgataaaacataggcattagctactctgcttagcaccaaatatcagactagcttaaatttgcccccagatgggttccatcatctttaatccgacctctgacttgcagtttcaacacgtgctctctgggcaaaacagttgccctgagtaacagaaaagataggaaaggaaaaggagagagagaaaaacgtgccagtggaagggtggggaaggtgaaatgatcaaggaggccagagaaagactcacctattgcagcaacactgtagaagttcaggcagctgcttctcggtagcaaaaggatcttttccagcaatcctattagctctcaagtttccccttttagggaggaaaaagctccccatgtcccgcgatcctgtacatgtccaaccctgccatccacagccatcagcaaagagtgcaagacagattaatccaaagagaatagcaattaatatcccatagcatcaaagctgttcttagccaagagggactttaacgagaggggtctctaacaccctaaatcttagaagagactctaaccatcctaagtagggcctctaaccccgctttataaacttttaattgactcccatcttaacagttgcaatccatggaggaatgcttgataacctcggtgataagataaaaaaccaagcatactagaagtgttctctaaaattaaaaatacagtagttactagagaaaaattttagtccaaaaatccaactatagaaacatagaatgtgagaggtagcacataagaaataagtcatggggattttatttcatggaccagcaatatgatgataaaagccatctaacc

SEQ ID NO: 21095 - DNA, 1402 bp, Homo sapiens
cggtgctcctggctacctcgcacagcggtgcccgcccggccgtcagtaccatggacagcagcgctgcccccacgaacgccagcaattgcactgatgccttggcgtactcaagttgctccccagcacccagccccggttcctgggtcaacttgtcccacttagatggcaacctgtccgacccatgcggtccgaaccgcaccgacctgggcgggagagacagcctgtgccctccgaccggcagtccctccatgatcacggccatcacgatcatggccctctactccatcgtgtgcgtggtggggctcttcggaaacttcctggtcatgtatgtgattgtcagatacaccaagatgaagactgccaccaacatctacattttcaaccttgctctggcagatgccttagccaccagtaccctgcccttccagagtgtgaattacctaatgggaacatggccatttggaaccatcctttgcaagatagtgatctccatagattactataacatgttcaccagcatattcaccctctgcaccatgagtgttgatcgatacattgcagtctgccaccctgtcaaggccttagatttccgtactccccgaaatgccaaaattatcaatgtctgcaactggatcctctcttcagccattggtcttcctgtaatgttcatggctacaacaaaatacaggcaaggttccatagattgtacactaacattctctcatccaacctggtactgggaaaacctgctgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaccaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcaggtggaattgaacctggactgtcactgtgaaaatgcaaagccttggccactgagctacaatgcagggcagtctccatttcccttcccaggaagagtctagagcattaattttgagtttgcaaaggcttgtaactatttcatatgatttttagagctgactatgacatgaaccctaaaattcctgttccc

SEQ ID NO: 21096 - DNA, 1481 bp, Homo sapiens
gcagaggagaatgtcagatgctcagctcggtcccctccgcctgacgctcctctctgtctcagccaggactggtttctgtaagaaacagcaggagctgtggcagcggcgaaaggaagcggctgaggcgcttggaacccgaaaagtctcggtgctcctggctacctcgcacagcggtgcccgcccggccgtcagtaccatggacagcagcgctgcccccacgaacgccagcaattgcactgatgccttggcgtactcaagttgctccccagcacccagccccggttcctgggtcaacttgtcccacttagatggcaacctgtccgacccatgcggtccgaaccgcaccgacctgggcgggagagacagcctgtgccctccgaccggcagtccctccatgatcacggccatcacgatcatggccctctactccatcgtgtgcgtggtggggctcttcggaaacttcctggtcatgtatgtgattgtcagatacaccaagatgaagactgccaccaacatctacattttcaaccttgctctggcagatgccttagccaccagtaccctgcccttccagagtgtgaattacctaatgggaacatggccatttggaaccatcctttgcaagatagtgatctccatagattactataacatgttcaccagcatattcaccctctgcaccatgagtgttgatcgatacattgcagtctgccaccctgtcaaggccttagatttccgtactccccgaaatgccaaaattatcaatgtctgcaactggatcctctcttcagccattggtcttcctgtaatgttcatggctacaacaaaatacaggcaaggttccatagattgtacactaacattctctcatccaacctggtactgggaaaacctgctgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaccaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcaggtacgcagtctctagaattaggtatatctactggggatgacataaaaattataaggctttgtgctaaactaggagtttaatccattatagaggatgagaatggagggaagaggggaagcaa

SEQ ID NO: 21097 - DNA, 2033 bp, Homo sapiens
cctgtaaagaaaatgatgagggctaaatccatcagcaccaaagctgggaagccctccaggttcatttggaagaaaatactcctctgagctcaaaggaagtgtgatctgtcacaatattgtatgcctgcactaagtttgcatcctgaaaactcactggaagataggaaagcaagcatgaaaaagcagccgggtcagacaggcttctggattcagtgtgtggacatgactttgcctgcatgaattgcccctttctcctacaaacaagagaattcggtcaagtggatgtggcagaactgggctgctctgagatgatagaaaagggctcctgcttttcctgtaattgcagccccttgttcttgtggttgctacatgcaataaatgtaattctatgagaaggaccagcccttacatcccatcaaaatgtttcctggaaacctggagcacagaactctgatatcctctcacactgtggcaggagaagcagcacaaggcacaatgctgaaatagcatggtccaggatgtgtttgcacagaagagtgcccagtgaagagacctactccttggatcgctttgcgcaaaatccaccccttttccctcctccctcccttccagcctccgaatcccgcatggcccacgctcccctcctgcagcggtgcggggcagccaggactggtttctgtaagaaacagcaggagctgtggcagcggcgaaaggaagcggctgaggcgcttggaacccgaaaagtctcggtgctcctggctacctcgcacagcggtgcccgcccggccgtcagtaccatggacagcagcgctgcccccacgaacgccagcaattgcactgatgccttggcgtactcaagttgctccccagcacccagccccggttcctgggtcaacttgtcccacttagatggcaacctgtccgacccatgcggtccgaaccgcaccgacctgggcgggagagacagcctgtgccctccgaccggcagtccctccatgatcacggccatcacgatcatggccctctactccatcgtgtgcgtggtggggctcttcggaaacttcctggtcatgtatgtgattgtcagatacaccaagatgaagactgccaccaacatctacattttcaaccttgctctggcagatgccttagccaccagtaccctgcccttccagagtgtgaattacctaatgggaacatggccatttggaaccatcctttgcaagatagtgatctccatagattactataacatgttcaccagcatattcaccctctgcaccatgagtgttgatcgatacattgcagtctgccaccctgtcaaggccttagatttccgtactccccgaaatgccaaaattatcaatgtctgcaactggatcctctcttcagccattggtcttcctgtaatgttcatggctacaacaaaatacaggcaaggttccatagattgtacactaacattctctcatccaacctggtactgggaaaacctgctgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaccaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcagctagaaaatctggaagcagaaactgctccgttgccctaacagggtctcatgccattccgaccttcaccaagc

SEQ ID NO: 21098 - DNA, 2217 bp, Homo sapiens
cggtgctcctggctacctcgcacagcggtgcccgcccggccgtcagtaccatggacagcagcgctgcccccacgaacgccagcaattgcactgatgccttggcgtactcaagttgctccccagcacccagccccggttcctgggtcaacttgtcccacttagatggcaacctgtccgacccatgcggtccgaaccgcaccgacctgggcgggagagacagcctgtgccctccgaccggcagtccctccatgatcacggccatcacgatcatggccctctactccatcgtgtgcgtggtggggctcttcggaaacttcctggtcatgtatgtgattgtcagatacaccaagatgaagactgccaccaacatctacattttcaaccttgctctggcagatgccttagccaccagtaccctgcccttccagagtgtgaattacctaatgggaacatggccatttggaaccatcctttgcaagatagtgatctccatagattactataacatgttcaccagcatattcaccctctgcaccatgagtgttgatcgatacattgcagtctgccaccctgtcaaggccttagatttccgtactccccgaaatgccaaaattatcaatgtctgcaactggatcctctcttcagccattggtcttcctgtaatgttcatggctacaacaaaatacaggcaaggttccatagattgtacactaacattctctcatccaacctggtactgggaaaacctgctgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaccaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcagagagaaagaagacagaaatctgactggtaagaaattgttacccttttgccagcatgccaggcttctgggttccctttccctgagcggccctagtgatccggcttgcggcaccatcgcctacgggccaagctgcatcataaaggaaatttttttttttcattctggccagagcaaaacacatgtgataaaacataggcattagctactctgcttagcaccaaatatcagactagcttaaatttgcccccagatgggttccatcatctttaatccgacctctgacttgcagtttcaacacgtgctctctgggcaaaacagttgccctgagtaacagaaaagataggaaaggaaaaggagagagagaaaaacgtgccagtggaagggtggggaaggtgaaatgatcaaggaggccagagaaagactcacctattgcagcaacactgtagaagttcaggcagctgcttctcggtagcaaaaggatcttttccagcaatcctattagctctcaagtttccccttttagggaggaaaaagctccccatgtcccgcgatcctgtacatgtccaaccctgccatccacagccatcagcaaagagtgcaagacagattaatccaaagagaatagcaattaatatcccatagcatcaaagctgttcttagccaagagggactttaacgagaggggtctctaacaccctaaatcttagaagagactctaaccatcctaagtagggcctctaaccccgctttataaacttttaattgactcccatcttaacagttgcaatccatggaggaatgcttgataacctcggtgataagataaaaaaccaagcatactagaagtgttctctaaaattaaaaatacagtagttactagagaaaaattttagtccaaaaatccaactatagaaacatagaatgtgagaggtagcacataagaaataagtcatggggattttatttcatggaccagcaatatgatgataaaagccatctaacc

SEQ ID NO: 21099 - DNA, 1352 bp, Homo sapiens
gaaaggaagcggctgaggcgcttggaacccgaaaagtctcggtgctcctggctacctcgcacagcggtgcccgcccggccgtcagtaccatggacagcagcgctgcccccacgaacgccagcaattgcactgatgccttggcgtactcaagttgctccccagcacccagccccggttcctgggtcaacttgtcccacttagatggcaacctgtccgacccatgcggtccgaaccgcaccgacctgggcgggagagacagcctgtgccctccgaccggcagtccctccatgatcacggccatcacgatcatggccctctactccatcgtgtgcgtggtggggctcttcggaaacttcctggtcatgtatgtgattgtcagatacaccaagatgaagactgccaccaacatctacattttcaaccttgctctggcagatgccttagccaccagtaccctgcccttccagagtgtgaattacctaatgggaacatggccatttggaaccatcctttgcaagatagtgatctccatagattactataacatgttcaccagcatattcaccctctgcaccatgagtgttgatcgatacattgcagtctgccaccctgtcaaggccttagatttccgtactccccgaaatgccaaaattatcaatgtctgcaactggatcctctcttcagccattggtcttcctgtaatgttcatggctacaacaaaatacaggcaaggttccatagattgtacactaacattctctcatccaacctggtactgggaaaacctgctgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaccaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcagaaaatagatttatttcaaaagtcatctttactcaactgtgagcataccaagggctaataattacaatattttcccgtgaaagaatataagattggaagc

SEQ ID NO: 21100 - DNA, 1060 bp, Homo sapiens
cctgtaaagaaaatgatgagggctaaatccatcagcaccaaagctgggaagccctccagatacaccaagatgaagactgccaccaacatctacattttcaaccttgctctggcagatgccttagccaccagtaccctgcccttccagagtgtgaattacctaatgggaacatggccatttggaaccatcctttgcaagatagtgatctccatagattactataacatgttcaccagcatattcaccctctgcaccatgagtgttgatcgatacattgcagtctgccaccctgtcaaggccttagatttccgtactccccgaaatgccaaaattatcaatgtctgcaactggatcctctcttcagccattggtcttcctgtaatgttcatggctacaacaaaatacaggcaaggttccatagattgtacactaacattctctcatccaacctggtactgggaaaacctgctgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaccaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcagctagaaaatctggaagcagaaactgctccgttgccctaacagggtctcatgccattccgaccttcaccaagcttagaagccaccatgtatgtggaagcaggttgcttcaagaatgtgtaggaggctc

SEQ ID NO: 21101 - DNA, 2594 bp, Homo sapiens
cggtgctcctggctacctcgcacagcggtgcccgcccggccgtcagtaccatggacagcagcgctgcccccacgaacgccagcaattgcactgatgccttggcgtactcaagttgctccccagcacccagccccggttcctgggtcaacttgtcccacttagatggcaacctgtccgacccatgcggtccgaaccgcaccgacctgggcgggagagacagcctgtgccctccgaccggcagtccctccatgatcacggccatcacgatcatggccctctactccatcgtgtgcgtggtggggctcttcggaaacttcctggtcatgtatgtgattgtcagatacaccaagatgaagactgccaccaacatctacattttcaaccttgctctggcagatgccttagccaccagtaccctgcccttccagagtgtgaattacctaatgggaacatggccatttggaaccatcctttgcaagatagtgatctccatagattactataacatgttcaccagcatattcaccctctgcaccatgagtgttgatcgatacattgcagtctgccaccctgtcaaggccttagatttccgtactccccgaaatgccaaaattatcaatgtctgcaactggatcctctcttcagccattggtcttcctgtaatgttcatggctacaacaaaatacaggcaaggttccatagattgtacactaacattctctcatccaacctggtactgggaaaacctgctgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaccaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcagatcagagatccaatatcaaaccttcccagggtgtctgtattctgacaactgtccactgaggcaatttccatacagcgcaaagtggagtggcgatttggcagttatcaagggacctccagccaagtttgttgctgaccaacttgccgggtcgtcttgaaaagggggcttacaggtgttccaagcccgtgttttatcctgaagtatccctcaacacagaaaaacgacctcataacacaaaatacaccagcttaaaaatagcctttgaattatttttcacattaatcaaaactttacagaggagataaacactgatttttttattttattttattttattttattttattttattgccattcattcaaccgtttgcacagagagaaagaagacagaaatctgactggtaagaaattgttacccttttgccagcatgccaggcttctgggttccctttccctgagcggccctagtgatccggcttgcggcaccatcgcctacgggccaagctgcatcataaaggaaatttttttttttcattctggccagagcaaaacacatgtgataaaacataggcattagctactctgcttagcaccaaatatcagactagcttaaatttgcccccagatgggttccatcatctttaatccgacctctgacttgcagtttcaacacgtgctctctgggcaaaacagttgccctgagtaacagaaaagataggaaaggaaaaggagagagagaaaaacgtgccagtggaagggtggggaaggtgaaatgatcaaggaggccagagaaagactcacctattgcagcaacactgtagaagttcaggcagctgcttctcggtagcaaaaggatcttttccagcaatcctattagctctcaagtttccccttttagggaggaaaaagctccccatgtcccgcgatcctgtacatgtccaaccctgccatccacagccatcagcaaagagtgcaagacagattaatccaaagagaatagcaattaatatcccatagcatcaaagctgttcttagccaagagggactttaacgagaggggtctctaacaccctaaatcttagaagagactctaaccatcctaagtagggcctctaaccccgctttataaacttttaattgactcccatcttaacagttgcaatccatggaggaatgcttgataacctcggtgataagataaaaaaccaagcatactagaagtgttctctaaaattaaaaatacagtagttactagagaaaaattttagtccaaaaatccaactatagaaacatagaatgtgagaggtagcacataagaaataagtcatggggattttatttcatggaccagcaatatgatgataaaagccatctaacc

SEQ ID NO: 21102 - DNA, 1001 bp, Homo sapiens
gtcttcctgtaaagaaaatgatgagggctaaatccatcagcaccaaagctgggaagccctccaggttcatttggaagaaaatactcctctgagctcaaaggaagtgtgatctgtcacaatattgtatgcctgcactaagtttgcatcctgaaaactcactggaagataggaaagcaagcatgaaaaagcagccgggtcagacaggcttctggattcagtgtgtggacatgactttgcctgcatgaattgcccctttctcctacaaacaagagaattcggtcaagtggatgtggcagaactgggctgctctgagatgatagaaaagggctcctgcttttcctgtaattgcagccccttgttcttgtggttgctacatgcaataaatgtaattctatgagaaggaccagcccttacatcccatcaaaatgtttcctggaaacctggagcacagaactctgatatcctctcacactgtggcaggagaagcagcacaaggcacaatgctgaaatagcatggtccaggccaggactggtttctgtaagaaacagcaggagctgtggcagcggcgaaaggaagcggctgaggcgcttggaacccgaaaagtctcggtgctcctggctacctcgcacagcggtgcccgcccggccgtcagtaccatggacagcagcgctgcccccacgaacgccagcaattgcactgatgccttggcgtactcaagttgctccccagcacccagccccggttcctgggtcaacttgtcccacttagatggcaacctgtccgacccatgcggtccgaaccgcaccgacctgggcgggagagacagcctgtgccctccgaccggcagtccctccatgatcacggccatcacgatcatggccctctactccatcgtgtgcgtggtggggctcttcggaaacttcctggtcatgtatgtgattgtcagatacaccaagatgaagactgccaccaacatctacattttcaaccttgctctggc

SEQ ID NO: 21103 - DNA, 1519 bp, Homo sapiens
cctgtaaagaaaatgatgagggctaaatccatcagcaccaaagctgggaagccctccaggttcatttggaagaaaatactcctctgagctcaaaggaagtgtgatctgtcacaatattgtatgcctgcactaagtttgcatcctgaaaactcactggaagataggaaagcaagcatgaaaaagcagccgggtcagacaggcttctggattcagtgtgtggacatgactttgcctgcatgaattgcccctttctcctacaaacaagagaattcggtcaagtggatgtggcagaactgggctgctctgagatgatagaaaagggctcctgcttttcctgtaattgcagccccttgttcttgtggttgctacatgcaataaatgtaattctatgagaaggaccagcccttacatcccatcaaaatgtttcctggaaacctggagcacagaactctgatatcctctcacactgtggcaggagaagcagcacaaggcacaatgctgaaatagcatggtccaggatacaccaagatgaagactgccaccaacatctacattttcaaccttgctctggcagatgccttagccaccagtaccctgcccttccagagtgtgaattacctaatgggaacatggccatttggaaccatcctttgcaagatagtgatctccatagattactataacatgttcaccagcatattcaccctctgcaccatgagtgttgatcgatacattgcagtctgccaccctgtcaaggccttagatttccgtactccccgaaatgccaaaattatcaatgtctgcaactggatcctctcttcagccattggtcttcctgtaatgttcatggctacaacaaaatacaggcaaggttccatagattgtacactaacattctctcatccaacctggtactgggaaaacctgctgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaccaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcagctagaaaatctggaagcagaaactgctccgttgccctaacagggtctcatgccattccgaccttcaccaagcttagaagccaccatgtatgtggaagcaggttgcttcaagaatgtgtaggaggctc

SEQ ID NO: 21104 - DNA, 2459 bp, Homo sapiens
ggctagcatgctaattaactatgcataaccacgtttcctttcaccatgttgaaccctgacataatttttttttccacaaacacctcactctggagaaggaaatgattttttttaattaaaataaacatacattggaaatacttagtgctaaaataagcctgaaggaaaggttggaagtatgatgagtcagaaaactgactgtaaagaaaccaattacttaacataaaacaccattaaagataagccacgaaatgtaaggtctgctgggtaggaaagtggcaaatgcaatgaagcatgtctttagatcatgcaggtctataaccaacggtgaatctagcaaaagttattttctcttttggggagaaacttcttcttattaaaaaaataaaaaatgtttcaacttcttgagcaccaaggtcaattattctaaatcttaaaaccacagttttaattttgcttttttgttggtttttgtactttggagtatttgtctacattatcctttttatatttgccatatttaaagtccaaactaaaagcaaattattttctctcctcaagttaaatggctctatctttttctttaaaatccattaagaaagtgaaactcccaaagtaagtccaaaaaaaagcccccaagtctgaaaatgtggagcttttctggcagtaatgcagcttctgcaagtattgcagaccagatcaggtatcagaattttaaagcttcagtaacaaagctgtcctattgaccctgaggagatttatgaaatcactttcctgatgttattgaaaccaaaacactttcctggacactgaattcagtcctaaacaaagggcctccaaccaacagctgtcttgggctgaatgagttagactcaacctcgtgtgacggaaaaacagtaaacacaagctaacatttaaaaggaattgatggcaccgtgtaaatcagaagcccaaggagggcctggcttcaggtgtggggttctctctcacgctctcaaatccacatcctccggattaggtccattttcagacaagctcctccagcaactacataccatgcgtcttctcaggtgtgggtcctgcaggaaaactaatacactctttgtccataagtctcaaaataaactctcactggctctggttggaacatgagagcatccttgccattcaccatggccccggtcactaaacgtcttcacgccctggactggtaatacagcctatcccaaagcacctggactgagaacgggaaatgagtggttcccagagtgaaactgaggtactattactaaattaagatacaccaagatgaagactgccaccaacatctacattttcaaccttgctctggcagatgccttagccaccagtaccctgcccttccagagtgtgaattacctaatgggaacatggccatttggaaccatcctttgcaagatagtgatctccatagattactataacatgttcaccagcatattcaccctctgcaccatgagtgttgatcgatacattgcagtctgccaccctgtcaaggccttagatttccgtactccccgaaatgccaaaattatcaatgtctgcaactggatcctctcttcagccattggtcttcctgtaatgttcatggctacaacaaaatacaggcaaggttccatagattgtacactaacattctctcatccaacctggtactgggaaaacctgctgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaccaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcagctagaaaatctggaagcagaaactgctccgttgccctaacagggtctcatgccattccgaccttcaccaagcttagaagccaccatgtatgtggaagcaggttgcttcaagaatgtgtaggaggctctaattctctaggaaagtgcctgcttttaggtcatccaacctctttcctctctggccactctgctctgcacattagagggacagccaaaagtaagtggagcatttggaaggaaaggaatataccacaccgaggagtccagtttgtgcaagacacccagtgg

SEQ ID NO: 21105 - DNA, 2440 bp, Homo sapiens
ggctagcatgctaattaactatgcataaccacgtttcctttcaccatgttgaaccctgacataatttttttttccacaaacacctcactctggagaaggaaatgattttttttaattaaaataaacatacattggaaatacttagtgctaaaataagcctgaaggaaaggttggaagtatgatgagtcagaaaactgactgtaaagaaaccaattacttaacataaaacaccattaaagataagccacgaaatgtaaggtctgctgggtaggaaagtggcaaatgcaatgaagcatgtctttagatcatgcaggtctataaccaacggtgaatctagcaaaagttattttctcttttggggagaaacttcttcttattaaaaaaataaaaaatgtttcaacttcttgagcaccaaggtcaattattctaaatcttaaaaccacagttttaattttgcttttttgttggtttttgtactttggagtatttgtctacattatcctttttatatttgccatatttaaagtccaaactaaaagcaaattattttctctcctcaagttaaatggctctatctttttctttaaaatccattaagaaagtgaaactcccaaagtaagtccaaaaaaaagcccccaagtctgaaaatgtggagcttttctggcagtaatgcagcttctgcaagtattgcagaccagatcaggtatcagaattttaaagcttcagtaacaaagctgtcctattgaccctgaggagatttatgaaatcactttcctgatgttattgaaaccaaaacactttcctggacactgaattcagtcctaaacaaagggcctccaaccaacagctgtcttgggctgaatgagttagactcaacctcgtgtgacggaaaaacagtaaacacaagctaacatttaaaaggaattgatggcaccgtgtaaatcagaagcccaaggagggcctggcttcaggtgtggggttctctctcacgctctcaaatccacatcctccggattaggtccattttcagacaagctcctccagcaactacataccatgcgtcttctcaggtgtgggtcctgcaggaaaactaatacactctttgtccataagtctcaaaataaactctcactggctctggttggaacatgagagcatccttgccattcaccatggccccggtcactaaacgtcttcacgccctggactggtaatacagcctatcccaaagcacctggactgagaacgggaaatgagtggttcccagagtgaaactgagatacaccaagatgaagactgccaccaacatctacattttcaaccttgctctggcagatgccttagccaccagtaccctgcccttccagagtgtgaattacctaatgggaacatggccatttggaaccatcctttgcaagatagtgatctccatagattactataacatgttcaccagcatattcaccctctgcaccatgagtgttgatcgatacattgcagtctgccaccctgtcaaggccttagatttccgtactccccgaaatgccaaaattatcaatgtctgcaactggatcctctcttcagccattggtcttcctgtaatgttcatggctacaacaaaatacaggcaaggttccatagattgtacactaacattctctcatccaacctggtactgggaaaacctgctgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaccaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcagctagaaaatctggaagcagaaactgctccgttgccctaacagggtctcatgccattccgaccttcaccaagcttagaagccaccatgtatgtggaagcaggttgcttcaagaatgtgtaggaggctctaattctctaggaaagtgcctgcttttaggtcatccaacctctttcctctctggccactctgctctgcacattagagggacagccaaaagtaagtggagcatttggaaggaaaggaatataccacaccgaggagtccagtttgtgcaagacacccagtgg

SEQ ID NO: 21106 - DNA, 1468 bp, Homo sapiens
gcttggaacccgaaaagtctcggtgctcctggctacctcgcacagcggtgcccgcccggccgtcagtaccatggacagcagcgctgcccccacgaacgccagcaattgcactgatgccttggcgtactcaagttgctccccagcacccagccccggttcctgggtcaacttgtcccacttagatggcaacctgtccgacccatgcggtccgaaccgcaccgacctgggcgggagagacagcctgtgccctccgaccggcagtccctccatgatcacggccatcacgatcatggccctctactccatcgtgtgcgtggtggggctcttcggaaacttcctggtcatgtatgtgattgtcagatacaccaagatgaagactgccaccaacatctacattttcaaccttgctctggcagatgccttagccaccagtaccctgcccttccagagtgtgaattacctaatgggaacatggccatttggaaccatcctttgcaagatagtgatctccatagattactataacatgttcaccagcatattcaccctctgcaccatgagtgttgatcgatacattgcagtctgccaccctgtcaaggccttagatttccgtactccccgaaatgccaaaattatcaatgtctgcaactggatcctctcttcagccattggtcttcctgtaatgttcatggctacaacaaaatacaggcaaggttccatagattgtacactaacattctctcatccaacctggtactgggaaaacctgctgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaccaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcagatcagagatccaatatcaaaccttcccagggtgtctgtattctgacaactgtccactgaggcaatttccatacagcgcaaagtggagtggcgatttggcagttatcaagctagaaaatctggaagcagaaactgctccgttgccctaacagggtctcatgccattccgaccttcaccaagcttagaagccaccatgtatgtggaagcaggttgcttcaagaatgtgtaggaggc

SEQ ID NO: 21107 - DNA, 1017 bp, Homo sapiens
ggaacccgaaaagtctcggtgctcctggctacctcgcacagcggtgcccgcccggccgtcagtaccatggacagcagcgctgcccccacgaacgccagcaattgcactgatgccttggcgtactcaagttgctccccagcacccagccccggttcctgggtcaacttgtcccacttagatggcaacctgtccgacccatgcggtccgaaccgcaccgacctgggcgggagagacagcctgtgccctccgaccggcagtccctccatgatcacggccatcacgatcatggccctctactccatcgtgtgcgtggtggggctcttcggaaacttcctggtcatgtatgtgattgtcaggttccatagattgtacactaacattctctcatccaacctggtactgggaaaacctgctgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaccaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcagccacccttggcagtcagcatggcccagatctttacacgatatcctcctccgactcatcgtgagaaaacctgcaatgattacatgaagagggtaaagtattatcctgatttatgtgacagagtgaaaggcaacttttaatt

SEQ ID NO: 21108 - DNA, 1251 bp, Homo sapiens
cggtgctcctggctacctcgcacagcggtgcccgcccggccgtcagtaccatggacagcagcgctgcccccacgaacgccagcaattgcactgatgccttggcgtactcaagttgctccccagcacccagccccggttcctgggtcaacttgtcccacttagatggcaacctgtccgacccatgcggtccgaaccgcaccgacctgggcgggagagacagcctgtgccctccgaccggcagtccctccatgatcacggccatcacgatcatggccctctactccatcgtgtgcgtggtggggctcttcggaaacttcctggtcatgtatgtgattgtcagatacaccaagatgaagactgccaccaacatctacattttcaaccttgctctggcagatgccttagccaccagtaccctgcccttccagagtgtgaattacctaatgggaacatggccatttggaaccatcctttgcaagatagtgatctccatagattactataacatgttcaccagcatattcaccctctgcaccatgagtgttgatcgatacattgcagtctgccaccctgtcaaggccttagatttccgtactccccgaaatgccaaaattatcaatgtctgcaactggatcctctcttcagccattggtcttcctgtaatgttcatggctacaacaaaatacaggcaaggttccatagattgtacactaacattctctcatccaacctggtactgggaaaacctgctgaagatctgtgttttcatcttcgccttcattatgccagtgctcatcattaccgtgtgctatggactgatgatcttgcgcctcaagagtgtccgcatgctctctggctccaaagaaaaggacaggaatcttcgaaggatcaccaggatggtgctggtggtggtggctgtgttcatcgtctgctggactcccattcacatttacgtcatcattaaagccttggttacaatcccagaaactacgttccagactgtttcttggcacttctgcattgctctaggttacacaaacagctgcctcaacccagtcctttatgcatttctggatgaaaacttcaaacgatgcttcagagagttctgtatcccaacctcttccaacattgagcaacaaaactccactcgaattcgtcagaacactagagaccacccctccacggccaatacagtggatagaactaatcatcagagctgactatgacatgaaccctaaaattcctgttccc

SEQ ID NO: 21109 - DNA, 1261 bp, Homo sapiens
cgtgaccctcaggtgatgcgccagggccggctgccgtcggggacagggctttccatagccatggcccagcagtggagcctccaaaggctcgcaggccgccatccgcaggacagctatgaggacagcacccagtccagcatcttcacctacaccaacagcaactccaccagaggccccttcgaaggcccgaattaccacatcgctcccagatgggtgtaccacctcaccagtgtctggatgatctttgtggtcactgcatccgtcttcacaaatgggcttgtgctggcggccaccatgaagttcaagaagctgcgccacccgctgaactggatcctggtgaacctggcggtcgctgacctagcagagaccgtcatcgccagcactatcagcattgtgaaccaggtctctggctacttcgtgctgggccaccctatgtgtgtcctggagggctacaccgtctccctgtgtgggatcacaggtctctggtctctggccatcatttcctgggagaggtggctggtggtgtgcaagccctttggcaatgtgagatttgatgccaagctggccatcgtgggcattgccttctcctggatctggtctgctgtgtggacagccccgcccatctttggttggagcaggtactggccccacggcctgaagacttcatgcggcccagacgtgttcagcggcagctcgtaccccggggtgcagtcttacatgattgtcctcatggtcacctgctgcatcatcccactcgctatcatcatgctctgctacctccaagtgtggctggccatccgagcggtggcaaagcagcagaaagagtctgaatccacccagaaggcagagaaggaagtgacgcgcatggtggtggtgatgatctttgcgtactgcgtctgctggggaccctacaccttcttcgcatgctttgctgctgccaaccctggttacgccttccaccctttgatggctgccctgccggcctactttgccaaaagtgccactatctacaaccccgttatctatgtctttatgaaccggcagtttcgaaactgcatcttgcagcttttcgggaagaaggttgacgatggctctgaactctccagcgcctccaaaacggaggtctcatctgtgtcctcggtatcgcctgcatgaggtctgcctcctacccatcccgcccaccggggctttggccacctctcctttccccctccttctccatccctgtaaaataaatgtaatttatctttgccaaaaccaa

SEQ ID NO: 21110 - DNA, 1257 bp, Homo sapiens
cgtgaccctcaggtgacgcaccagggccggctgccgtcggggacagggctttccatagccatggcccagcagtggagcctccaaaggctcgcaggccgccatccgcaggacagctatgaggacagcacccagtccagcatcttcacctacaccaacagcaactccaccagaggccccttcgaaggcccgaattaccacatcgctcccagatgggtgtaccacctcaccagtgtctggatgatctttgtggtcattgcatccgtcttcacaaatgggcttgtgctggcggccaccatgaagttcaagaagctgcgccacccgctgaactggatcctggtgaacctggcggtcgctgacctggcagagaccgtcatcgccagcactatcagcgttgtgaaccaggtctatggctacttcgtgctgggccaccctatgtgtgtcctggagggctacaccgtctccctgtgtgggatcacaggtctctggtctctggccatcatttcctgggagagatggatggtggtctgcaagccctttggcaatgtgagatttgatgccaagctggccatcgtgggcattgccttctcctggatctgggctgctgtgtggacagccccgcccatctttggttggagcaggtactggccccacggcctgaagacttcatgcggcccagacgtgttcagcggcagctcgtaccccggggtgcagtcttacatgattgtcctcatggtcacctgctgcatcaccccactcagcatcatcgtgctctgctacctccaagtgtggctggccatccgagcggtggcaaagcagcagaaagagtctgaatccacccagaaggcagagaaggaagtgacgcgcatggtggtggtgatggtcctggcattctgcttctgctggggaccatacgccttcttcgcatgctttgctgctgccaaccctggctaccccttccaccctttgatggctgccctgccggccttctttgccaaaagtgccactatctacaaccccgttatctatgtctttatgaaccggcagtttcgaaactgcatcttgcagcttttcgggaagaaggttgacgatggctctgaactctccagcgcctccaaaacggaggtctcatctgtgtcctcggtatcgcctgcatgaggtctgcctcctacccatcccgcccaccggggctttggccacctctcctttccccctccttctccatccctgtaaaataaatgtaatttatctttgccaaaa

SEQ ID NO: 21111 - DNA, 1096 bp, Homo sapiens
atgagaaaaatgtcggaggaagagttttatctgttcaaaaatatctcttcagtggggccgtgggatgggcctcagtaccacattgcccctgtctgggccttctacctccaggcagctttcatgggcactgtcttccttatagggttcccactcaatgccatggtgctggtggccacactgcgctacaaaaagttgcggcagcccctcaactacattctggtcaacgtgtccttcggaggcttcctcctctgcatcttctctgtcttccctgtcttcgtcgccagctgtaacggatacttcgtcttcggtcgccatgtttgtgctttggagggcttcctgggcactgtagcaggtctggttacaggatggtcactggccttcctggcctttgagcgctacattgtcatctgtaagcccttcggcaacttccgcttcagctccaagcatgcactgacggtggtcctggctacctggaccattggtattggcgtctccatcccacccttctttggctggagccggttcatccctgagggcctgcagtgttcctgtggccctgactggtacaccgtgggcaccaaataccgcagcgagtcctatacgtggttcctcttcatcttctgcttcattgtgcctctctccctcatctgcttctcctacactcagctgctgagggccctgaaagctgttgcagctcagcagcaggagtcagctacgacccagaaggctgaacgggaggtgagccgcatggtggttgtgatggtaggatccttctgtgtctgctacgtgccctacgcggccttcgccatgtacatggtcaacaaccgtaaccatgggctggacttacggcttgtcaccattccttcattcttctccaagagtgcttgcatctacaatcccatcatctactgcttcatgaataagcagttccaagcttgcatcatgaagatggtgtgtgggaaggccatgacagatgaatccgacacatgcagctcccagaaaacagaagtttctactgtctcgtctacccaagttggccccaactgaggacccaatattggcctgtttgcaacagctagaattaaattttactttt

SEQ ID NO: 21112 - DNA, 2395 bp, Homo sapiens
gggcccggcgcgcggtagcgcgggcccctcagtgcacaatggctagagcaggcggcggagccccaaccccacccagtgcggagcgcgccgcgagccccgccgcaagctgagcgcctccgcccgccaggcgcgccggcgccgggccatgtactcggggaaccgcagcggcggccacggctactgggacggcggcggggccgcgggcgctgaggggccggcgccggcggggacactgagccccgcgcccctcttcagccccggcacctacgagcgcctggcgctgctgctgggctccattgggctgctgggcgtcggcaacaacctgctggtgctcgtcctctactacaagttccagcggctccgcactcccactcacctcctcctggtcaacatcagcctcagcgacctgctggtgtccctcttcggggtcacctttaccttcgtgtcctgcctgaggaacggctgggtgtgggacaccgtgggctgcgtgtgggacgggtttagcggcagcctcttcggttggatcagccagcttcaggcagccactagggaagccagagcctccatgggtccagtgcagcaaggcactatctgcatgcagcttcgttgtgtggaagatcttcagacaattcaagtgatcaagattttaaaatatgaaaagaaactggccaaaatgtgctttttaatgatattcaccttcctggtctgttggatgccttatatcgtgatctgcttcttggtggttaatggtcatggtcacctggtcactccaacaatatctattgtttcgtacctctttgctaaatcgaacactgtatacaatccagtgatttatgtcttcatgatcagaaagtttcgaagatcccttttgcagcttctgtgcctccgactgctgaggtgccagaggcctgctaaagacctaccagcagctggaagtgaaatgcagatcagacccattgtgatgtcacagaaagatggggacaggccaaagaaaaaagtgactttcaactcttcttccatcatttttatcatcaccagtgatgaatcactgtcagttgacgacagcgacaaaaccaatgggtccaaagttgatgtaatccaagttcgtcctttgtaggaatgaagaatggcaacgaaagatggggccttaaattggatgccacttttggactttcatcataagaagtgtctggaatacccgttctatgtaatatcaacagaaccttgtggtccagcaggaaatccgaattgcccatatgctcttgggcctcaggaagaggttgaacaaaaacaaattcttttaattcaacgggtgctttacataatgaaaaaaccacttgtggcacacgatgggcatctaacatcatcatcttctaatgtgttggagattttcatttcaaatatattttttaaattactctattttccaaaacacgtaatgcatttttctcgaaaataccttactgtaaaaataactgtcgcgtacacatgtgtgaagtagctagaacatactgaattttttttgtactgttggactctattcagtgtcatgtcctatatctgatcaagttatcaaggagataattctagaatgaaaaagaaaatcctcttgttggaaacaaaagacgttttatatgtgcagtatgacaaagaggagtttcagagacaactttgaatccttgtcagcctggagaccagcaccagaggaatctacaaggcaaactcccatatatttgcttcccccaaattgctgcccctacagactcaaagctctttttctttgttttgttgtttctctaaaaatttactgttctttgtcgatgctatataagccagggagttctaagacgccagctctttgagatttgctcattcccctgtatttcccacatatatattacatatacccgctaataaatttatgtttgtttttctcttgtcaatctgtcttttgttataggggccccagccaaggaacctaaagtgggtagaaggaaaaattattttttctttccctacaaactgaacatggattattagaactcaaggttttcattgacaatatagaaaagaaacactgaatcattttattttattgcccaatttttatttcttatatgactctagtgtttcatcttcataattaatcatgtttgaaggatttctgagtgactcagcagcctgttaaagaaggatgaaccaaagaaaacatttcactaaatgtgcttttaaaaatcaagtgtattgctggttctgctgcagtatgtagtcgaagaataaattagtaaattgcttctgagggtctgaaattgaataaagtaatggctttgtatttctataaaagttgtctccccttgtttcctttccattctggcacatgtagacatttaattta

SEQ ID NO: 21113 - DNA, 2620 bp, Homo sapiens
atggctagagcaggcggcggagccccaaccccacccagtgcggagcgcgccgcgagccccgccgcaagctgagcgcctccgcccgccaggcgcgccggcgccgggccatgtactcggggaaccgcagcggcggccacggctactgggacggcggcggggccgcgggcgctgaggggccggcgccggcggggacactgagccccgcgcccctcttcagccccggcacctacgagcgcctggcgctgctgctgggctccattgggctgctgggcgtcggcaacaacctgctggtgctcgtcctctactacaagttccagcggctccgcactcccactcacctcctcctggtcaacatcagcctcagcgacctgctggtgtccctcttcggggtcacctttaccttcgtgtcctgcctgaggaacggctgggtgtgggacaccgtgggctgcgtgtgggacgggtttagcggcagcctcttcgggattgtttccattgccaccctaaccgtgctggcctatgaacgttacattcgcgtggtccatgccagagtgatcaatttttcctgggcctggagggccattacctacatctggctctactcactggcgtgggcaggagcacctctcctgggatggaacaggtacatcctggacgtacacggactaggctgcactgtggactggaaatccaaggatgccaacgattcctcctttgtgcttttcttatttcttggctgcctggtggtgcccctgggtgtcatagcccattgctatggccatattctatattccattcgaatgcttcgttgtgtggaagatcttcagacaattcaagtgatcaagattttaaaatatgaaaagaaactggccaaaatgtgctttttaatgatattcaccttcctggtctgttggatgccttatatcgtgatctgcttcttggtggttaatggtcatggtcacctggtcactccaacaatatctattgtttcgtacctctttgctaaatcgaacactgtatacaatccagtgatttatgtcttcatgatcagaaagtttcgaagatcccttttgcagcttctgtgcctccgactgctgaggtgccagaggcctgctaaagacctaccagcagctggaagtgaaatgcagatcagacccattgtgatgtcacagaaagatggggacaggccaaagaaaaaagtgactttcaactcttcttccatcatttttatcatcaccagtgatgaatcactgtcagttgacgacagcgacaaaaccaatgggtccaaagttgatgtaatccaagttcgtcctttgtaggaatgaagaatggcaacgaaagatggggccttaaattggatgccacttttggactttcatcataagaagtgtctggaatacccgttctatgtaatatcaacagaaccttgtggtccagcaggaaatccgaattgcccatatgctcttgggcctcaggaagaggttgaacaaaaacaaattcttttaattcaacgggtgctttacataatgaaaaaaccacttgtggcacacgatgggcatctaacatcatcatcttctaatgtgttggagattttcatttcaaatatattttttaaattactctattttccaaaacacgtaatgcatttttctcgaaaataccttactgtaaaaataactgtcgcgtacacatgtgtgaagtagctagaacatactgaattttttttgtactgttggactctattcagtgtcatgtcctatatctgatcaagttatcaaggagataattctagaatgaaaaagaaaatcctcttgttggaaacaaaagacgttttatatgtgcagtatgacaaagaggagtttcagagacaactttgaatccttgtcagcctggagaccagcaccagaggaatctacaaggcaaactcccatatatttgcttcccccaaattgctgcccctacagactcaaagctctttttctttgttttgttgtttctctaaaaatttactgttctttgtcgatgctatataagccagggagttctaagacgccagctctttgagatttgctcattcccctgtatttcccacatatatattacatatacccgctaataaatttatgtttgtttttctcttgtcaatctgtcttttgttataggggccccagccaaggaacctaaagtgggtagaaggaaaaattattttttctttccctacaaactgaacatggattattagaactcaaggttttcattgacaatatagaaaagaaacactgaatcattttattttattgcccaatttttatttcttatatgactctagtgtttcatcttcataattaatcatgtttgaaggatttctgagtgactcagcagcctgttaaagaaggatgaaccaaagaaaacatttcactaaatgtgcttttaaaaatcaagtgtattgctggttctgctgcagtatgtagtcgaagaataaattagtaaattgcttctgagggtctgaaattgaataaagtaatggctttgtatttctataaaagttgtctccccttgtttcctttccattctggcacatgtagacatttaatttatgaataaaaccctttcctgtccttca

SEQ ID NO: 21114 - DNA, 6330 bp, Homo sapiens
gtgctgcccgcctagaaagggtgaagtggttgtttccgtgacggactgagtacgggtgcctgtcaggctcttgcggaagtccatgcgccattgggagggcctcggccgcggctctgtgcccttgctgctgagggccacttcctgggtcattcctggaccgggagccgggctggggctcacacgggggctcccgcgtggccgtctcggcgcctgcgtgacctccccgccggcgggatgtggcgactacgtcgggccgctgtggcctgtgaggtctgccagtctttagtgaaacacagctctggaataaaaggaagtttaccactacaaaaactacatctggtttcacgaagcatttatcattcacatcatcctaccttaaagcttcaacgaccccaattaaggacatcctttcagcagttctcttctctgacaaaccttcctttacgtaaactgaaattctctccaattaaatatggctaccagcctcgcaggaatttttggccagcaagattagctacgagactcttaaaacttcgctatctcatactaggatcggctgttgggggtggctacacagccaaaaagacttttgatcagtggaaagatatgataccggaccttagtgaatataaatggattgtgcctgacattgtgtgggaaattgatgagtatatcgattttggttctccggaagaaacggcgtttagagcaacagatcgtggatctgaaagtgacaagcattttagaaagggtctgcttggtgagctcattctcttacaacaacaaattcaagagcatgaagaggaagcgcgcagagccgctggccaatatagcacgagctatgcccaacagaagcgcaaggtgtcagacaaagagaaaattgaccaacttcaggaagaacttctgcacactcagttgaagtatcagagaatcttggaacgattagaaaaggagaacaaagaattgagaaaattagtattgcagaaagatgacaaaggcattcatcatagaaagcttaagaaatctttgattgacatgtattctgaagttcttgatgttctctctgattatgatgccagttataatacgcaagatcatctgccacgggttgttgtggttggagatcagagtgctggaaagactagtgtgttggaaatgattgcccaagctcgaatattcccaagaggatctggggagatgatgacacgttctccagttaaggtgactctgagtgaaggtcctcaccatgtggccctatttaaagatagttctcgggagtttgatcttaccaaagaagaagatcttgcagcattaagacatgaaatagaacttcgaatgaggaaaaatgtgaaagaaggctgtaccgttagccctgagaccatatccttaaatgtaaaaggccctggactacagaggatggtgcttgttgacttaccaggtgtgattaatactgtgacatcaggcatggctcctgacacaaaggaaactattttcagtatcagcaaagcttacatgcagaatcctaatgccatcatactgtgtattcaagatggatctgtggatgctgaacgcagtattgttacagacttggtcagtcaaatggaccctcatggaaggagaaccatattcgttttgaccaaagtagacctggcagagaaaaatgtagccagtccaagcaggattcagcagataattgaaggaaagctcttcccaatgaaagctttaggttattttgctgttgtaacaggaaaagggaacagctctgaaagcattgaagctataagagaatatgaagaagagttttttcagaattcaaagctcctaaagacaagcatgctaaaggcacaccaagtgactacaagaaatttaagccttgcagtatcagactgcttttggaaaatggtacgagagtctgttgaacaacaggctgatagtttcaaagcaacacgttttaaccttgaaactgaatggaagaataactatcctcgcctgcgggaacttgaccggaatgaactatttgaaaaagctaaaaatgaaatccttgatgaagttatcagtctgagccaggttacaccaaaacattgggaggaaatccttcaacaatctttgtgggaaagagtatcaactcatgtgattgaaaacatctaccttccagctgcgcagaccatgaattcaggaacttttaacaccacagtggatatcaagcttaaacagtggactgataaacaacttcctaataaagcagtagaggttgcttgggagaccctacaagaagaattttcccgctttatgacagaaccgaaagggaaagagcatgatgacatatttgataaacttaaagaggctgttaaggaagaaagtattaaacgacacaagtggaatgactttgcggaggacagcttgagggttattcaacacaatgctttggaagaccgatccatatctgataaacagcaatgggatgcagctatttattttatggaagaggctctgcaggctcgtctcaaggatactgaaaatgcaattgaaaacatggtgggtccagactggaaaaagaggtggttatactggaagaatcggacccaagaacagtgtgttcacaatgaaaccaagaatgaattggagaagatgttgaaatgtaatgaggagcacccagcttatcttgcaagtgatgaaataaccacagtccggaagaaccttgaatcccgaggagtagaagtagatccaagcttgattaaggatacttggcatcaagtttatagaagacattttttaaaaacagctctaaaccattgtaacctttgtcgaagaggtttttattactaccaaaggcattttgtagattctgagttggaatgcaatgatgtggtcttgttttggcgtatacagcgcatgcttgctatcaccgcaaatactttaaggcaacaacttacaaatactgaagttaggcgattagagaaaaatgttaaagaggtattggaagattttgctgaagatggtgagaagaagattaaattgcttactggtaaacgcgttcaactggcggaagacctcaagaaagttagagaaattcaagaaaaacttgatgctttcattgaagctcttcatcaggagaaataaattaaaatcgtactcataatcagctctgcatacatctgaagaacaaaaacatcaacgtcttttgtccagcctctttttcttctgctgttccacctttctaaacatacaataaagtcatgggataaaaataatcgatgtatgttacgggcgctttaaccatcagctgcctctcgaatggaagaacagtggtaatggattaacatcctattttgttgtactaaagtgacaaatcggaataatataattggtatggccattaggttcagtccttgaagataagaaacttgttctctgtttgttgtcttatttgtggtggcactcgtttaatggattaactgaggttgctcaatgttcagtttcttttccagaaatacaatgctaggtgttttgaaataaaacttatatagcaattgtttaaagttatcaattgtatataaaatcacagtagcctgctaaatcattgtatgtgtctgtagtattctattcccagaaactatttgaccatgataattcagtttatattcaccacatgaaagaaaaatgggtaacagaagaacccttaaaacaggttaatttggattgtaacgttcagtgaaagaaatttcaacccttcatagccagcgaagaaatttgccttggaagccaagtcagtaccagcttacctatttgattcagttgctgttttctcactctctatatccatttgaaattgatttattttagatgttgtatacttacgttaggctttctgttaatagtggtttttctcctgttgacagagccaccggattatgacacaggatgaggaagattaaggataatcaattgactaatttcatttagaatattatcaaacatttcaactaggtatcagaaaaaggctttctttcataagactattttaaatagaaattatttcaacaattaaagtaatgttgaccatccccctctcagctgaataaagaaaaatttagttcaatttattgcaatttaattacaatactaccttcacaacattttcatgtgttttaaataaatattttttaattggctaaaggacattcaagcaaagaaatgctttctttacttaaaatgtctatctcatttgctgccttttcactaagcctttactttgttaataaaagtgtccattgtgtgatgtttttgattttacagtttgctaaatcttattttcttggagttgctttttggtaacagccccattgctactccccattttattgttttacatcaatgcatgcttcgttgtgatccctcaagatgtaacacttggtatgctcggttgaggatatgaaaaaatacttccgaaaccaggaattcaatgtatgtttgttttatactgtttgataagaaaagtaggtccagccttaagcagcacagatgcgctggtagatgcatagtcaggaactttttttatttcttttaggtctagggacaggagtgaatagaaagggaggagagctctattatgttctatacacagattaggagatgaccttactgggtacacccctctaaccagtgcttacaggttaatgcatgttaatgaatatttttgcagttgtaaagcataacaattacaactacacatctatttctaaagaataaaacaggaccatatttatttacttctgtcaactatagaaagaaagaccttcagctgtatttccacagatttctcccaaggaaaaggctaatattagtcactactgttatcacatccctttgtataagttttaaaaagagatggagggagatcttcatttctttgaggagatcagtattgtaacgtatgtgaatagatgataacaattaatattactaaaagtcccacatgagagtcctgacgccctctccatgccccacagtaatgtggcttctttcatgggtttttttttcttctttttagctgatctcatcctaagcatgctttatttttccttgaaagctaggtatttatcaactgcagatgttattgaaagaaaataaaattcagtctcaagagtaaaccctgtgtcttgtgtctgtagttcaaaagtcagaaatgattctaatttaaacaaaaagatactaaatatacagaagttaaattcgaactagccacagaatcatttgtttttatgtcagaatttgcaaagagtggagtggacaaagctctgtatggaagactgaacaactgtaaatagatgatatccaaacttaatttggctaggacttcaattttaaaaatcagtgtacctaggcagtgcacagcacgaaataagtggcccttgcagcttccccgtttaacccactgtgctatagttgcgggtggaacagtcaacctttctagtagtttatgatattgccctctttgtattcccattttctacagttttttccgcagacttctttctgcaaattattcagcctccaaatgcaaatgaatgatataaaaataagtagggaacatggcagagagtggtgcttcccagcctcacaatgtgggaatttgacataggatgagagtcagagtataggtttaaaagataaaatctttagttaataattttgtatttatttattctagatgtatgtatctgaggaaagaaatctggtatttttgctttccaataaaggggatcaaagtaatggtttttctctcagttctctaagctggtctatgttatagctctagcagtatggaaatgtgctttaaaatatgcttaccttttgaatgatcatggctatatgttgttgagatatttgaaacttaccttgttttcacttgtgcactgtgaatgaactttgtattatttttttaaaaccttcacattacgtgtagatattattgcaacttatattttgcctgagcttgatcaaaggtcatttgtgtagatgagtaattaaaaaatatttaaatcacattataattctattattggagagcatcttttaaatttttttctgttttaacgagggaaagagaaacctgtatacctagggtcattatttgaccccatagtataaccagattcatggtctaacaagctctcagtgtggcttttctctgaatgcttgaatttcacatgccttgcatttcacagttgtactccatggtcaaccggtgctttttttcacatcgtggtacttgtcaaaacattttgttattttccttggtaaaatatataaaaaaggttttctaatttc

SEQ ID NO: 21115 - DNA, 6492 bp, Homo sapiens
gtgctgcccgcctagaaagggtgaagtggttgtttccgtgacggactgagtacgggtgcctgtcaggctcttgcggaagtccatgcgccattgggagggcctcggccgcggctctgtgcccttgctgctgagggccacttcctgggtcattcctggaccgggagccgggctggggctcacacgggggctcccgcgtggccgtctcggcgcctgcgtgacctccccgccggcgggatgtggcgactacgtcgggccgctgtggcctgtgaggtctgccagtctttagtgaaacacagctctggaataaaaggaagtttaccactacaaaaactacatctggtttcacgaagcatttatcattcacatcatcctaccttaaagcttcaacgaccccaattaaggacatcctttcagcagttctcttctctgacaaaccttcctttacgtaaactgaaattctctccaattaaatatggctaccagcctcgcaggaatttttggccagcaagattagctacgagactcttaaaacttcgctatctcatactaggatcggctgttgggggtggctacacagccaaaaagacttttgatcagtggaaagatatgataccggaccttagtgaatataaatggattgtgcctgacattgtgtgggaaattgatgagtatatcgattttgagaaaattagaaaagcccttcctagttcagaagaccttgtaaagttagcaccagactttgacaagattgttgaaagccttagcttattgaaggacttttttacctcaggtcacaaattggttagtgaagtcataggagcttctgacctacttctcttgttaggttctccggaagaaacggcgtttagagcaacagatcgtggatctgaaagtgacaagcattttagaaagggtctgcttggtgagctcattctcttacaacaacaaattcaagagcatgaagaggaagcgcgcagagccgctggccaatatagcacgagctatgcccaacagaagcgcaaggtgtcagacaaagagaaaattgaccaacttcaggaagaacttctgcacactcagttgaagtatcagagaatcttggaacgattagaaaaggagaacaaagaattgagaaaattagtattgcagaaagatgacaaaggcattcatcatagaaagcttaagaaatctttgattgacatgtattctgaagttcttgatgttctctctgattatgatgccagttataatacgcaagatcatctgccacgggttgttgtggttggagatcagagtgctggaaagactagtgtgttggaaatgattgcccaagctcgaatattcccaagaggatctggggagatgatgacacgttctccagttaaggtgactctgagtgaaggtcctcaccatgtggccctatttaaagatagttctcgggagtttgatcttaccaaagaagaagatcttgcagcattaagacatgaaatagaacttcgaatgaggaaaaatgtgaaagaaggctgtaccgttagccctgagaccatatccttaaatgtaaaaggccctggactacagaggatggtgcttgttgacttaccaggtgtgattaatactgtgacatcaggcatggctcctgacacaaaggaaactattttcagtatcagcaaagcttacatgcagaatcctaatgccatcatactgtgtattcaagatggatctgtggatgctgaacgcagtattgttacagacttggtcagtcaaatggaccctcatggaaggagaaccatattcgttttgaccaaagtagacctggcagagaaaaatgtagccagtccaagcaggattcagcagataattgaaggaaagctcttcccaatgaaagctttaggttattttgctgttgtaacaggaaaagggaacagctctgaaagcattgaagctataagagaatatgaagaagagttttttcagaattcaaagctcctaaagacaagcatgctaaaggcacaccaagtgactacaagaaatttaagccttgcagtatcagactgcttttggaaaatggtacgagagtctgttgaacaacaggctgatagtttcaaagcaacacgttttaaccttgaaactgaatggaagaataactatcctcgcctgcgggaacttgaccggaatgaactatttgaaaaagctaaaaatgaaatccttgatgaagttatcagtctgagccaggttacaccaaaacattgggaggaaatccttcaacaatctttgtgggaaagagtatcaactcatgtgattgaaaacatctaccttccagctgcgcagaccatgaattcaggaacttttaacaccacagtggatatcaagcttaaacagtggactgataaacaacttcctaataaagcagtagaggttgcttgggagaccctacaagaagaattttcccgctttatgacagaaccgaaagggaaagagcatgatgacatatttgataaacttaaagaggctgttaaggaagaaagtattaaacgacacaagtggaatgactttgcggaggacagcttgagggttattcaacacaatgctttggaagaccgatccatatctgataaacagcaatgggatgcagctatttattttatggaagaggctctgcaggctcgtctcaaggatactgaaaatgcaattgaaaacatggtgggtccagactggaaaaagaggtggttatactggaagaatcggacccaagaacagtgtgttcacaatgaaaccaagaatgaattggagaagatgttgaaatgtaatgaggagcacccagcttatcttgcaagtgatgaaataaccacagtccggaagaaccttgaatcccgaggagtagaagtagatccaagcttgattaaggatacttggcatcaagtttatagaagacattttttaaaaacagctctaaaccattgtaacctttgtcgaagaggtttttattactaccaaaggcattttgtagattctgagttggaatgcaatgatgtggtcttgttttggcgtatacagcgcatgcttgctatcaccgcaaatactttaaggcaacaacttacaaatactgaagttaggcgattagagaaaaatgttaaagaggtattggaagattttgctgaagatggtgagaagaagattaaattgcttactggtaaacgcgttcaactggcggaagacctcaagaaagttagagaaattcaagaaaaacttgatgctttcattgaagctcttcatcaggagaaataaattaaaatcgtactcataatcagctctgcatacatctgaagaacaaaaacatcaacgtcttttgtccagcctctttttcttctgctgttccacctttctaaacatacaataaagtcatgggataaaaataatcgatgtatgttacgggcgctttaaccatcagctgcctctcgaatggaagaacagtggtaatggattaacatcctattttgttgtactaaagtgacaaatcggaataatataattggtatggccattaggttcagtccttgaagataagaaacttgttctctgtttgttgtcttatttgtggtggcactcgtttaatggattaactgaggttgctcaatgttcagtttcttttccagaaatacaatgctaggtgttttgaaataaaacttatatagcaattgtttaaagttatcaattgtatataaaatcacagtagcctgctaaatcattgtatgtgtctgtagtattctattcccagaaactatttgaccatgataattcagtttatattcaccacatgaaagaaaaatgggtaacagaagaacccttaaaacaggttaatttggattgtaacgttcagtgaaagaaatttcaacccttcatagccagcgaagaaatttgccttggaagccaagtcagtaccagcttacctatttgattcagttgctgttttctcactctctatatccatttgaaattgatttattttagatgttgtatacttacgttaggctttctgttaatagtggtttttctcctgttgacagagccaccggattatgacacaggatgaggaagattaaggataatcaattgactaatttcatttagaatattatcaaacatttcaactaggtatcagaaaaaggctttctttcataagactattttaaatagaaattatttcaacaattaaagtaatgttgaccatccccctctcagctgaataaagaaaaatttagttcaatttattgcaatttaattacaatactaccttcacaacattttcatgtgttttaaataaatattttttaattggctaaaggacattcaagcaaagaaatgctttctttacttaaaatgtctatctcatttgctgccttttcactaagcctttactttgttaataaaagtgtccattgtgtgatgtttttgattttacagtttgctaaatcttattttcttggagttgctttttggtaacagccccattgctactccccattttattgttttacatcaatgcatgcttcgttgtgatccctcaagatgtaacacttggtatgctcggttgaggatatgaaaaaatacttccgaaaccaggaattcaatgtatgtttgttttatactgtttgataagaaaagtaggtccagccttaagcagcacagatgcgctggtagatgcatagtcaggaactttttttatttcttttaggtctagggacaggagtgaatagaaagggaggagagctctattatgttctatacacagattaggagatgaccttactgggtacacccctctaaccagtgcttacaggttaatgcatgttaatgaatatttttgcagttgtaaagcataacaattacaactacacatctatttctaaagaataaaacaggaccatatttatttacttctgtcaactatagaaagaaagaccttcagctgtatttccacagatttctcccaaggaaaaggctaatattagtcactactgttatcacatccctttgtataagttttaaaaagagatggagggagatcttcatttctttgaggagatcagtattgtaacgtatgtgaatagatgataacaattaatattactaaaagtcccacatgagagtcctgacgccctctccatgccccacagtaatgtggcttctttcatgggtttttttttcttctttttagctgatctcatcctaagcatgctttatttttccttgaaagctaggtatttatcaactgcagatgttattgaaagaaaataaaattcagtctcaagagtaaaccctgtgtcttgtgtctgtagttcaaaagtcagaaatgattctaatttaaacaaaaagatactaaatatacagaagttaaattcgaactagccacagaatcatttgtttttatgtcagaatttgcaaagagtggagtggacaaagctctgtatggaagactgaacaactgtaaatagatgatatccaaacttaatttggctaggacttcaattttaaaaatcagtgtacctaggcagtgcacagcacgaaataagtggcccttgcagcttccccgtttaacccactgtgctatagttgcgggtggaacagtcaacctttctagtagtttatgatattgccctctttgtattcccattttctacagttttttccgcagacttctttctgcaaattattcagcctccaaatgcaaatgaatgatataaaaataagtagggaacatggcagagagtggtgcttcccagcctcacaatgtgggaatttgacataggatgagagtcagagtataggtttaaaagataaaatctttagttaataattttgtatttatttattctagatgtatgtatctgaggaaagaaatctggtatttttgctttccaataaaggggatcaaagtaatggtttttctctcagttctctaagctggtctatgttatagctctagcagtatggaaatgtgctttaaaatatgcttaccttttgaatgatcatggctatatgttgttgagatatttgaaacttaccttgttttcacttgtgcactgtgaatgaactttgtattatttttttaaaaccttcacattacgtgtagatattattgcaacttatattttgcctgagcttgatcaaaggtcatttgtgtagatgagtaattaaaaaatatttaaatcacattataattctattattggagagcatcttttaaatttttttctgttttaacgagggaaagagaaacctgtatacctagggtcattatttgaccccatagtataaccagattcatggtctaacaagctctcagtgtggcttttctctgaatgcttgaatttcacatgccttgcatttcacagttgtactccatggtcaaccggtgctttttttcacatcgtggtacttgtcaaaacattttgttattttccttggtaaaatatataaaaaaggttttctaatttc

SEQ ID NO: 21116 - DNA, 6384 bp, Homo sapiens
gtgctgcccgcctagaaagggtgaagtggttgtttccgtgacggactgagtacgggtgcctgtcaggctcttgcggaagtccatgcgccattgggagggcctcggccgcggctctgtgcccttgctgctgagggccacttcctgggtcattcctggaccgggagccgggctggggctcacacgggggctcccgcgtggccgtctcggcgcctgcgtgacctccccgccggcgggatgtggcgactacgtcgggccgctgtggcctgtgaggtctgccagtctttagtgaaacacagctctggaataaaaggaagtttaccactacaaaaactacatctggtttcacgaagcatttatcattcacatcatcctaccttaaagcttcaacgaccccaattaaggacatcctttcagcagttctcttctctgacaaaccttcctttacgtaaactgaaattctctccaattaaatatggctaccagcctcgcaggaatttttggccagcaagattagctacgagactcttaaaacttcgctatctcatactaggatcggctgttgggggtggctacacagccaaaaagacttttgatcagtggaaagatatgataccggaccttagtgaatataaatggattgtgcctgacattgtgtgggaaattgatgagtatatcgattttggtcacaaattggttagtgaagtcataggagcttctgacctacttctcttgttaggttctccggaagaaacggcgtttagagcaacagatcgtggatctgaaagtgacaagcattttagaaagggtctgcttggtgagctcattctcttacaacaacaaattcaagagcatgaagaggaagcgcgcagagccgctggccaatatagcacgagctatgcccaacagaagcgcaaggtgtcagacaaagagaaaattgaccaacttcaggaagaacttctgcacactcagttgaagtatcagagaatcttggaacgattagaaaaggagaacaaagaattgagaaaattagtattgcagaaagatgacaaaggcattcatcatagaaagcttaagaaatctttgattgacatgtattctgaagttcttgatgttctctctgattatgatgccagttataatacgcaagatcatctgccacgggttgttgtggttggagatcagagtgctggaaagactagtgtgttggaaatgattgcccaagctcgaatattcccaagaggatctggggagatgatgacacgttctccagttaaggtgactctgagtgaaggtcctcaccatgtggccctatttaaagatagttctcgggagtttgatcttaccaaagaagaagatcttgcagcattaagacatgaaatagaacttcgaatgaggaaaaatgtgaaagaaggctgtaccgttagccctgagaccatatccttaaatgtaaaaggccctggactacagaggatggtgcttgttgacttaccaggtgtgattaatactgtgacatcaggcatggctcctgacacaaaggaaactattttcagtatcagcaaagcttacatgcagaatcctaatgccatcatactgtgtattcaagatggatctgtggatgctgaacgcagtattgttacagacttggtcagtcaaatggaccctcatggaaggagaaccatattcgttttgaccaaagtagacctggcagagaaaaatgtagccagtccaagcaggattcagcagataattgaaggaaagctcttcccaatgaaagctttaggttattttgctgttgtaacaggaaaagggaacagctctgaaagcattgaagctataagagaatatgaagaagagttttttcagaattcaaagctcctaaagacaagcatgctaaaggcacaccaagtgactacaagaaatttaagccttgcagtatcagactgcttttggaaaatggtacgagagtctgttgaacaacaggctgatagtttcaaagcaacacgttttaaccttgaaactgaatggaagaataactatcctcgcctgcgggaacttgaccggaatgaactatttgaaaaagctaaaaatgaaatccttgatgaagttatcagtctgagccaggttacaccaaaacattgggaggaaatccttcaacaatctttgtgggaaagagtatcaactcatgtgattgaaaacatctaccttccagctgcgcagaccatgaattcaggaacttttaacaccacagtggatatcaagcttaaacagtggactgataaacaacttcctaataaagcagtagaggttgcttgggagaccctacaagaagaattttcccgctttatgacagaaccgaaagggaaagagcatgatgacatatttgataaacttaaagaggctgttaaggaagaaagtattaaacgacacaagtggaatgactttgcggaggacagcttgagggttattcaacacaatgctttggaagaccgatccatatctgataaacagcaatgggatgcagctatttattttatggaagaggctctgcaggctcgtctcaaggatactgaaaatgcaattgaaaacatggtgggtccagactggaaaaagaggtggttatactggaagaatcggacccaagaacagtgtgttcacaatgaaaccaagaatgaattggagaagatgttgaaatgtaatgaggagcacccagcttatcttgcaagtgatgaaataaccacagtccggaagaaccttgaatcccgaggagtagaagtagatccaagcttgattaaggatacttggcatcaagtttatagaagacattttttaaaaacagctctaaaccattgtaacctttgtcgaagaggtttttattactaccaaaggcattttgtagattctgagttggaatgcaatgatgtggtcttgttttggcgtatacagcgcatgcttgctatcaccgcaaatactttaaggcaacaacttacaaatactgaagttaggcgattagagaaaaatgttaaagaggtattggaagattttgctgaagatggtgagaagaagattaaattgcttactggtaaacgcgttcaactggcggaagacctcaagaaagttagagaaattcaagaaaaacttgatgctttcattgaagctcttcatcaggagaaataaattaaaatcgtactcataatcagctctgcatacatctgaagaacaaaaacatcaacgtcttttgtccagcctctttttcttctgctgttccacctttctaaacatacaataaagtcatgggataaaaataatcgatgtatgttacgggcgctttaaccatcagctgcctctcgaatggaagaacagtggtaatggattaacatcctattttgttgtactaaagtgacaaatcggaataatataattggtatggccattaggttcagtccttgaagataagaaacttgttctctgtttgttgtcttatttgtggtggcactcgtttaatggattaactgaggttgctcaatgttcagtttcttttccagaaatacaatgctaggtgttttgaaataaaacttatatagcaattgtttaaagttatcaattgtatataaaatcacagtagcctgctaaatcattgtatgtgtctgtagtattctattcccagaaactatttgaccatgataattcagtttatattcaccacatgaaagaaaaatgggtaacagaagaacccttaaaacaggttaatttggattgtaacgttcagtgaaagaaatttcaacccttcatagccagcgaagaaatttgccttggaagccaagtcagtaccagcttacctatttgattcagttgctgttttctcactctctatatccatttgaaattgatttattttagatgttgtatacttacgttaggctttctgttaatagtggtttttctcctgttgacagagccaccggattatgacacaggatgaggaagattaaggataatcaattgactaatttcatttagaatattatcaaacatttcaactaggtatcagaaaaaggctttctttcataagactattttaaatagaaattatttcaacaattaaagtaatgttgaccatccccctctcagctgaataaagaaaaatttagttcaatttattgcaatttaattacaatactaccttcacaacattttcatgtgttttaaataaatattttttaattggctaaaggacattcaagcaaagaaatgctttctttacttaaaatgtctatctcatttgctgccttttcactaagcctttactttgttaataaaagtgtccattgtgtgatgtttttgattttacagtttgctaaatcttattttcttggagttgctttttggtaacagccccattgctactccccattttattgttttacatcaatgcatgcttcgttgtgatccctcaagatgtaacacttggtatgctcggttgaggatatgaaaaaatacttccgaaaccaggaattcaatgtatgtttgttttatactgtttgataagaaaagtaggtccagccttaagcagcacagatgcgctggtagatgcatagtcaggaactttttttatttcttttaggtctagggacaggagtgaatagaaagggaggagagctctattatgttctatacacagattaggagatgaccttactgggtacacccctctaaccagtgcttacaggttaatgcatgttaatgaatatttttgcagttgtaaagcataacaattacaactacacatctatttctaaagaataaaacaggaccatatttatttacttctgtcaactatagaaagaaagaccttcagctgtatttccacagatttctcccaaggaaaaggctaatattagtcactactgttatcacatccctttgtataagttttaaaaagagatggagggagatcttcatttctttgaggagatcagtattgtaacgtatgtgaatagatgataacaattaatattactaaaagtcccacatgagagtcctgacgccctctccatgccccacagtaatgtggcttctttcatgggtttttttttcttctttttagctgatctcatcctaagcatgctttatttttccttgaaagctaggtatttatcaactgcagatgttattgaaagaaaataaaattcagtctcaagagtaaaccctgtgtcttgtgtctgtagttcaaaagtcagaaatgattctaatttaaacaaaaagatactaaatatacagaagttaaattcgaactagccacagaatcatttgtttttatgtcagaatttgcaaagagtggagtggacaaagctctgtatggaagactgaacaactgtaaatagatgatatccaaacttaatttggctaggacttcaattttaaaaatcagtgtacctaggcagtgcacagcacgaaataagtggcccttgcagcttccccgtttaacccactgtgctatagttgcgggtggaacagtcaacctttctagtagtttatgatattgccctctttgtattcccattttctacagttttttccgcagacttctttctgcaaattattcagcctccaaatgcaaatgaatgatataaaaataagtagggaacatggcagagagtggtgcttcccagcctcacaatgtgggaatttgacataggatgagagtcagagtataggtttaaaagataaaatctttagttaataattttgtatttatttattctagatgtatgtatctgaggaaagaaatctggtatttttgctttccaataaaggggatcaaagtaatggtttttctctcagttctctaagctggtctatgttatagctctagcagtatggaaatgtgctttaaaatatgcttaccttttgaatgatcatggctatatgttgttgagatatttgaaacttaccttgttttcacttgtgcactgtgaatgaactttgtattatttttttaaaaccttcacattacgtgtagatattattgcaacttatattttgcctgagcttgatcaaaggtcatttgtgtagatgagtaattaaaaaatatttaaatcacattataattctattattggagagcatcttttaaatttttttctgttttaacgagggaaagagaaacctgtatacctagggtcattatttgaccccatagtataaccagattcatggtctaacaagctctcagtgtggcttttctctgaatgcttgaatttcacatgccttgcatttcacagttgtactccatggtcaaccggtgctttttttcacatcgtggtacttgtcaaaacattttgttattttccttggtaaaatatataaaaaaggttttctaatttc

SEQ ID NO: 21117 - DNA, 6381 bp, Homo sapiens
gtgctgcccgcctagaaagggtgaagtggttgtttccgtgacggactgagtacgggtgcctgtcaggctcttgcggaagtccatgcgccattgggagggcctcggccgcggctctgtgcccttgctgctgagggccacttcctgggtcattcctggaccgggagccgggctggggctcacacgggggctcccgcgtggccgtctcggcgcctgcgtgacctccccgccggcgggatgtggcgactacgtcgggccgctgtggcctgtgaggtctgccagtctttagtgaaacacagctctggaataaaaggaagtttaccactacaaaaactacatctggtttcacgaagcatttatcattcacatcatcctaccttaaagcttcaacgaccccaattaaggacatcctttcagcagttctcttctctgacaaaccttcctttacgtaaactgaaattctctccaattaaatatggctaccagcctcgcaggaatttttggccagcaagattagctacgagactcttaaaacttcgctatctcatactaggatcggctgttgggggtggctacacagccaaaaagacttttgatcagtggaaagatatgataccggaccttagtgaatataaatggattgtgcctgacattgtgtgggaaattgatgagtatatcgattttgagaaaattagaaaagcccttcctagttcagaagaccttgtaaagttagcaccagactttgacaagattgttgaaagccttagcttattgaaggacttttttacctcaggtcacaaattggttagtgaagtcataggagcttctgacctacttctcttgttaggttctccggaagaaacggcgtttagagcaacagatcgtggatctgaaagtgacaagcattttagaaaggtgtcagacaaagagaaaattgaccaacttcaggaagaacttctgcacactcagttgaagtatcagagaatcttggaacgattagaaaaggagaacaaagaattgagaaaattagtattgcagaaagatgacaaaggcattcatcatagaaagcttaagaaatctttgattgacatgtattctgaagttcttgatgttctctctgattatgatgccagttataatacgcaagatcatctgccacgggttgttgtggttggagatcagagtgctggaaagactagtgtgttggaaatgattgcccaagctcgaatattcccaagaggatctggggagatgatgacacgttctccagttaaggtgactctgagtgaaggtcctcaccatgtggccctatttaaagatagttctcgggagtttgatcttaccaaagaagaagatcttgcagcattaagacatgaaatagaacttcgaatgaggaaaaatgtgaaagaaggctgtaccgttagccctgagaccatatccttaaatgtaaaaggccctggactacagaggatggtgcttgttgacttaccaggtgtgattaatactgtgacatcaggcatggctcctgacacaaaggaaactattttcagtatcagcaaagcttacatgcagaatcctaatgccatcatactgtgtattcaagatggatctgtggatgctgaacgcagtattgttacagacttggtcagtcaaatggaccctcatggaaggagaaccatattcgttttgaccaaagtagacctggcagagaaaaatgtagccagtccaagcaggattcagcagataattgaaggaaagctcttcccaatgaaagctttaggttattttgctgttgtaacaggaaaagggaacagctctgaaagcattgaagctataagagaatatgaagaagagttttttcagaattcaaagctcctaaagacaagcatgctaaaggcacaccaagtgactacaagaaatttaagccttgcagtatcagactgcttttggaaaatggtacgagagtctgttgaacaacaggctgatagtttcaaagcaacacgttttaaccttgaaactgaatggaagaataactatcctcgcctgcgggaacttgaccggaatgaactatttgaaaaagctaaaaatgaaatccttgatgaagttatcagtctgagccaggttacaccaaaacattgggaggaaatccttcaacaatctttgtgggaaagagtatcaactcatgtgattgaaaacatctaccttccagctgcgcagaccatgaattcaggaacttttaacaccacagtggatatcaagcttaaacagtggactgataaacaacttcctaataaagcagtagaggttgcttgggagaccctacaagaagaattttcccgctttatgacagaaccgaaagggaaagagcatgatgacatatttgataaacttaaagaggctgttaaggaagaaagtattaaacgacacaagtggaatgactttgcggaggacagcttgagggttattcaacacaatgctttggaagaccgatccatatctgataaacagcaatgggatgcagctatttattttatggaagaggctctgcaggctcgtctcaaggatactgaaaatgcaattgaaaacatggtgggtccagactggaaaaagaggtggttatactggaagaatcggacccaagaacagtgtgttcacaatgaaaccaagaatgaattggagaagatgttgaaatgtaatgaggagcacccagcttatcttgcaagtgatgaaataaccacagtccggaagaaccttgaatcccgaggagtagaagtagatccaagcttgattaaggatacttggcatcaagtttatagaagacattttttaaaaacagctctaaaccattgtaacctttgtcgaagaggtttttattactaccaaaggcattttgtagattctgagttggaatgcaatgatgtggtcttgttttggcgtatacagcgcatgcttgctatcaccgcaaatactttaaggcaacaacttacaaatactgaagttaggcgattagagaaaaatgttaaagaggtattggaagattttgctgaagatggtgagaagaagattaaattgcttactggtaaacgcgttcaactggcggaagacctcaagaaagttagagaaattcaagaaaaacttgatgctttcattgaagctcttcatcaggagaaataaattaaaatcgtactcataatcagctctgcatacatctgaagaacaaaaacatcaacgtcttttgtccagcctctttttcttctgctgttccacctttctaaacatacaataaagtcatgggataaaaataatcgatgtatgttacgggcgctttaaccatcagctgcctctcgaatggaagaacagtggtaatggattaacatcctattttgttgtactaaagtgacaaatcggaataatataattggtatggccattaggttcagtccttgaagataagaaacttgttctctgtttgttgtcttatttgtggtggcactcgtttaatggattaactgaggttgctcaatgttcagtttcttttccagaaatacaatgctaggtgttttgaaataaaacttatatagcaattgtttaaagttatcaattgtatataaaatcacagtagcctgctaaatcattgtatgtgtctgtagtattctattcccagaaactatttgaccatgataattcagtttatattcaccacatgaaagaaaaatgggtaacagaagaacccttaaaacaggttaatttggattgtaacgttcagtgaaagaaatttcaacccttcatagccagcgaagaaatttgccttggaagccaagtcagtaccagcttacctatttgattcagttgctgttttctcactctctatatccatttgaaattgatttattttagatgttgtatacttacgttaggctttctgttaatagtggtttttctcctgttgacagagccaccggattatgacacaggatgaggaagattaaggataatcaattgactaatttcatttagaatattatcaaacatttcaactaggtatcagaaaaaggctttctttcataagactattttaaatagaaattatttcaacaattaaagtaatgttgaccatccccctctcagctgaataaagaaaaatttagttcaatttattgcaatttaattacaatactaccttcacaacattttcatgtgttttaaataaatattttttaattggctaaaggacattcaagcaaagaaatgctttctttacttaaaatgtctatctcatttgctgccttttcactaagcctttactttgttaataaaagtgtccattgtgtgatgtttttgattttacagtttgctaaatcttattttcttggagttgctttttggtaacagccccattgctactccccattttattgttttacatcaatgcatgcttcgttgtgatccctcaagatgtaacacttggtatgctcggttgaggatatgaaaaaatacttccgaaaccaggaattcaatgtatgtttgttttatactgtttgataagaaaagtaggtccagccttaagcagcacagatgcgctggtagatgcatagtcaggaactttttttatttcttttaggtctagggacaggagtgaatagaaagggaggagagctctattatgttctatacacagattaggagatgaccttactgggtacacccctctaaccagtgcttacaggttaatgcatgttaatgaatatttttgcagttgtaaagcataacaattacaactacacatctatttctaaagaataaaacaggaccatatttatttacttctgtcaactatagaaagaaagaccttcagctgtatttccacagatttctcccaaggaaaaggctaatattagtcactactgttatcacatccctttgtataagttttaaaaagagatggagggagatcttcatttctttgaggagatcagtattgtaacgtatgtgaatagatgataacaattaatattactaaaagtcccacatgagagtcctgacgccctctccatgccccacagtaatgtggcttctttcatgggtttttttttcttctttttagctgatctcatcctaagcatgctttatttttccttgaaagctaggtatttatcaactgcagatgttattgaaagaaaataaaattcagtctcaagagtaaaccctgtgtcttgtgtctgtagttcaaaagtcagaaatgattctaatttaaacaaaaagatactaaatatacagaagttaaattcgaactagccacagaatcatttgtttttatgtcagaatttgcaaagagtggagtggacaaagctctgtatggaagactgaacaactgtaaatagatgatatccaaacttaatttggctaggacttcaattttaaaaatcagtgtacctaggcagtgcacagcacgaaataagtggcccttgcagcttccccgtttaacccactgtgctatagttgcgggtggaacagtcaacctttctagtagtttatgatattgccctctttgtattcccattttctacagttttttccgcagacttctttctgcaaattattcagcctccaaatgcaaatgaatgatataaaaataagtagggaacatggcagagagtggtgcttcccagcctcacaatgtgggaatttgacataggatgagagtcagagtataggtttaaaagataaaatctttagttaataattttgtatttatttattctagatgtatgtatctgaggaaagaaatctggtatttttgctttccaataaaggggatcaaagtaatggtttttctctcagttctctaagctggtctatgttatagctctagcagtatggaaatgtgctttaaaatatgcttaccttttgaatgatcatggctatatgttgttgagatatttgaaacttaccttgttttcacttgtgcactgtgaatgaactttgtattatttttttaaaaccttcacattacgtgtagatattattgcaacttatattttgcctgagcttgatcaaaggtcatttgtgtagatgagtaattaaaaaatatttaaatcacattataattctattattggagagcatcttttaaatttttttctgttttaacgagggaaagagaaacctgtatacctagggtcattatttgaccccatagtataaccagattcatggtctaacaagctctcagtgtggcttttctctgaatgcttgaatttcacatgccttgcatttcacagttgtactccatggtcaaccggtgctttttttcacatcgtggtacttgtcaaaacattttgttattttccttggtaaaatatataaaaaaggttttctaatttc

SEQ ID NO: 21118 - DNA, 6439 bp, Homo sapiens
gtgctgcccgcctagaaagggtgaagtggttgtttccgtgacggactgagtacgggtgcctgtcaggctcttgcggaagtccatgcgccattgggagggcctcggccgcggctctgtgcccttgctgctgagggccacttcctgggtcattcctggaccgggagccgggctggggctcacacgggggctcccgcgtggccgtctcggcgcctgcgtgacctccccgccggcgggatgtggcgactacgtcgggccgctgtggcctgtgaggtctgccagtctttagtgaaacacagctctggaataaaaggaagtttaccactacaaaaactacatctggtttcacgaagcatttatcattcacatcatcctaccttaaagcttcaacgaccccaattaaggacatcctttcagcagttctcttctctgacaaaccttcctttacgtaaactgaaattctctccaattaaatatggctaccagcctcgcaggaatttttggccagcaagattagctacgagactcttaaaacttcgctatctcatactaggatcggctgttgggggtggctacacagccaaaaagacttttgatcagtggaaagatatgataccggaccttagtgaatataaatggattgtgcctgacattgtgtgggaaattgatgagtatatcgattttgagaaaattagaaaagcccttcctagttcagaagaccttgtaaagttagcaccagactttgacaagattgttgaaagccttagcttattgaaggacttttttacctcaggttctccggaagaaacggcgtttagagcaacagatcgtggatctgaaagtgacaagcattttagaaagggtctgcttggtgagctcattctcttacaacaacaaattcaagagcatgaagaggaagcgcgcagagccgctggccaatatagcacgagctatgcccaacagaagcgcaaggtgtcagacaaagagaaaattgaccaacttcaggaagaacttctgcacactcagttgaagtatcagagaatcttggaacgattagaaaaggagaacaaagaattgagaaaattagtattgcagaaagatgacaaaggcattcatcatagaaagcttaagaaatctttgattgacatgtattctgaagttcttgatgttctctctgattatgatgccagttataatacgcaagatcatctgccacgggttgttgtggttggagatcagagtgctggaaagactagtgtgttggaaatgattgcccaagctcgaatattcccaagaggatctggggagatgatgacacgttctccagttaaggtgactctgagtgaaggtcctcaccatgtggccctatttaaagatagttctcgggagtttgatcttaccaaagaagaagatcttgcagcattaagacatgaaatagaacttcgaatgaggaaaaatgtgaaagaaggctgtaccgttagccctgagaccatatccttaaatgtaaaaggccctggactacagaggatggtgcttgttgacttaccaggtgtgattaatactgtgacatcaggcatggctcctgacacaaaggaaactattttcagtatcagcaaagcttacatgcagaatcctaatgccatcatactgtgtattcaagatggatctgtggatgctgaacgcagtattgttacagacttggtcagtcaaatggaccctcatggaaggagaaccatattcgttttgaccaaagtagacctggcagagaaaaatgtagccagtccaagcaggattcagcagataattgaaggaaagctcttcccaatgaaagctttaggttattttgctgttgtaacaggaaaagggaacagctctgaaagcattgaagctataagagaatatgaagaagagttttttcagaattcaaagctcctaaagacaagcatgctaaaggcacaccaagtgactacaagaaatttaagccttgcagtatcagactgcttttggaaaatggtacgagagtctgttgaacaacaggctgatagtttcaaagcaacacgttttaaccttgaaactgaatggaagaataactatcctcgcctgcgggaacttgaccggaatgaactatttgaaaaagctaaaaatgaaatccttgatgaagttatcagtctgagccaggttacaccaaaacattgggaggaaatccttcaacaatctttgtgggaaagagtatcaactcatgtgattgaaaacatctaccttccagctgcgcagaccatgaattcaggaacttttaacaccacagtggatatcaagcttaaacagtggactgataaacaacttcctaataaagcagtagaggttgcttgggagaccctacaagaagaattttcccgctttatgacagaaccgaaagggaaagagcatgatgacatatttgataaacttaaagaggctgttaaggaagaaagtattaaacgacacaagtggaatgactttgcggaggacagcttgagggttattcaacacaatgctttggaagaccgatccatatctgataaacagcaatgggatgcagctatttattttatggaagaggctctgcaggctcgtctcaaggatactgaaaatgcaattgaaaacatggtgggtccagactggaaaaagaggtggttatactggaagaatcggacccaagaacagtgtgttcacaatgaaaccaagaatgaattggagaagatgttgaaatgtaatgaggagcacccagcttatcttgcaagtgatgaaataaccacagtccggaagaaccttgaatcccgaggagtagaagtagatccaagcttgattaaggatacttggcatcaagtttatagaagacattttttaaaaacagctctaaaccattgtaacctttgtcgaagaggtttttattactaccaaaggcattttgtagattctgagttggaatgcaatgatgtggtcttgttttggcgtatacagcgcatgcttgctatcaccgcaaatactttaaggcaacaacttacaaatactgaagttaggcgattagagaaaaatgttaaagaggtattggaagattttgctgaagatggtgagaagaagattaaattgcttactggtaaacgcgttcaactggcggaagacctcaagaaagttagagaaattcaagaaaaacttgatgctttcattgaagctcttcatcaggagaaataaattaaaatcgtactcataatcagctctgcatacatctgaagaacaaaaacatcaacgtcttttgtccagcctctttttcttctgctgttccacctttctaaacatacaataaagtcatgggataaaaataatcgatgtatgttacgggcgctttaaccatcagctgcctctcgaatggaagaacagtggtaatggattaacatcctattttgttgtactaaagtgacaaatcggaataatataattggtatggccattaggttcagtccttgaagataagaaacttgttctctgtttgttgtcttatttgtggtggcactcgtttaatggattaactgaggttgctcaatgttcagtttcttttccagaaatacaatgctaggtgttttgaaataaaacttatatagcaattgtttaaagttatcaattgtatataaaatcacagtagcctgctaaatcattgtatgtgtctgtagtattctattcccagaaactatttgaccatgataattcagtttatattcaccacatgaaagaaaaatgggtaacagaagaacccttaaaacaggttaatttggattgtaacgttcagtgaaagaaatttcaacccttcatagccagcgaagaaatttgccttggaagccaagtcagtaccagcttacctatttgattcagttgctgttttctcactctctatatccatttgaaattgatttattttagatgttgtatacttacgttaggctttctgttaatagtggtttttctcctgttgacagagccaccggattatgacacaggatgaggaagattaaggataatcaattgactaatttcatttagaatattatcaaacatttcaactaggtatcagaaaaaggctttctttcataagactattttaaatagaaattatttcaacaattaaagtaatgttgaccatccccctctcagctgaataaagaaaaatttagttcaatttattgcaatttaattacaatactaccttcacaacattttcatgtgttttaaataaatattttttaattggctaaaggacattcaagcaaagaaatgctttctttacttaaaatgtctatctcatttgctgccttttcactaagcctttactttgttaataaaagtgtccattgtgtgatgtttttgattttacagtttgctaaatcttattttcttggagttgctttttggtaacagccccattgctactccccattttattgttttacatcaatgcatgcttcgttgtgatccctcaagatgtaacacttggtatgctcggttgaggatatgaaaaaatacttccgaaaccaggaattcaatgtatgtttgttttatactgtttgataagaaaagtaggtccagccttaagcagcacagatgcgctggtagatgcatagtcaggaactttttttatttcttttaggtctagggacaggagtgaatagaaagggaggagagctctattatgttctatacacagattaggagatgaccttactgggtacacccctctaaccagtgcttacaggttaatgcatgttaatgaatatttttgcagttgtaaagcataacaattacaactacacatctatttctaaagaataaaacaggaccatatttatttacttctgtcaactatagaaagaaagaccttcagctgtatttccacagatttctcccaaggaaaaggctaatattagtcactactgttatcacatccctttgtataagttttaaaaagagatggagggagatcttcatttctttgaggagatcagtattgtaacgtatgtgaatagatgataacaattaatattactaaaagtcccacatgagagtcctgacgccctctccatgccccacagtaatgtggcttctttcatgggtttttttttcttctttttagctgatctcatcctaagcatgctttatttttccttgaaagctaggtatttatcaactgcagatgttattgaaagaaaataaaattcagtctcaagagtaaaccctgtgtcttgtgtctgtagttcaaaagtcagaaatgattctaatttaaacaaaaagatactaaatatacagaagttaaattcgaactagccacagaatcatttgtttttatgtcagaatttgcaaagagtggagtggacaaagctctgtatggaagactgaacaactgtaaatagatgatatccaaacttaatttggctaggacttcaattttaaaaatcagtgtacctaggcagtgcacagcacgaaataagtggcccttgcagcttccccgtttaacccactgtgctatagttgcgggtggaacagtcaacctttctagtagtttatgatattgccctctttgtattcccattttctacagttttttccgcagacttctttctgcaaattattcagcctccaaatgcaaatgaatgatataaaaataagtagggaacatggcagagagtggtgcttcccagcctcacaatgtgggaatttgacataggatgagagtcagagtataggtttaaaagataaaatctttagttaataattttgtatttatttattctagatgtatgtatctgaggaaagaaatctggtatttttgctttccaataaaggggatcaaagtaatggtttttctctcagttctctaagctggtctatgttatagctctagcagtatggaaatgtgctttaaaatatgcttaccttttgaatgatcatggctatatgttgttgagatatttgaaacttaccttgttttcacttgtgcactgtgaatgaactttgtattatttttttaaaaccttcacattacgtgtagatattattgcaacttatattttgcctgagcttgatcaaaggtcatttgtgtagatgagtaattaaaaaatatttaaatcacattataattctattattggagagcatcttttaaatttttttctgttttaacgagggaaagagaaacctgtatacctagggtcattatttgaccccatagtataaccagattcatggtctaacaagctctcagtgtggcttttctctgaatgcttgaatttcacatgccttgcatttcacagttgtactccatggtcaaccggtgctttttttcacatcgtggtacttgtcaaaacattttgttattttccttggtaaaatatataaaaaaggttttctaatttca

SEQ ID NO: 21119 - DNA, 631 bp, Homo sapiens
ggccgcggctctgtgcccttgctgctgagggccacttcctgggtcattcctggaccgggagccgggctggggctcacacgggggctcccgcgtggccgtctcggcgcctgcgtgacctccccgccggcgggatgtggcgactacgtcgggccgctgtggcctgtgaggtctgccagtctttagtgaaacacagctctggaataaaaggaagtttaccactacaaaaactacatctggtttcacgaagcatttatcattcacatcatcctaccttaaagcttcaacgaccccaattaaggacatcctttcagcagttctcttctctgacaaaccttcctttacgtaaactgaaattctctccaattaaatatggctaccagcctcgcaggaatttttggccagcaagattagctacgagactcttaaaacttcgctatctcatactaggatcggctgttgggggtggctacacagccaaaaagacttttgatcagtggaaagatatgataccggaccttagtgaatataaatggattgtgcctgacattgtgtgggaaattgatgagtatatcgattttggttctccggaagaaacggcgtttagagcaacagatcgtggatctgaaagtga

SEQ ID NO: 21120 - DNA, 6340 bp, Homo sapiens
gtgctgcccgcctagaaagggtgaagtggttgtttccgtgacggactgagtacgggtgcctgtcaggctcttgcggaagtccatgcgccattgggagggcctcggccgcggctctgtgcccttgctgctgagggccacttcctgggtcattcctggaccgggagccgggctggggctcacacgggggctcccgcgtggccgtctcggcgcctgcgtgacctccccgccggcgggatgtggcgactacgtcgggccgctgtggcctgtgaggtctgccagtctttagtgaaacacagctctggaataaaaggaagtttaccactacaaaaactacatctggtttcacgaagcatttatcattcacatcatcctaccttaaagcttcaacgaccccaattaaggacatcctttcagcagttctcttctctgacaaaccttcctttacgtaaactgaaattctctccaattaaatatggctaccagcctcgcaggaatttttggccagcaagattagctacgagactcttaaaacttcgctatctcatactaggatcggctgttgggggtggctacacagccaaaaagacttttgatcagtggaaagatatgataccggaccttagtgaatataaatggattgtgcctgacattgtgtgggaaattgatgagtatatcgattttgagaaaattagaaaagcccttcctagttcagaagaccttgtaaagttagcaccagactttgacaagattgttgaaagccttagcttattgaaggacttttttacctcaggttctccggaagaaacggcgtttagagcaacagatcgtggatctgaaagtgacaagcattttagaaaggtgtcagacaaagagaaaattgaccaacttcaggaagaacttctgcacactcagttgaagtatcagagaatcttggaacgattagaaaaggagaacaaagaattgagaaaattagtattgcagaaagatgacaaaggcattcatcatagaaagcttaagaaatctttgattgacatgtattctgaagttcttgatgttctctctgattatgatgccagttataatacgcaagatcatctgccacgggttgttgtggttggagatcagagtgctggaaagactagtgtgttggaaatgattgcccaagctcgaatattcccaagaggatctggggagatgatgacacgttctccagttaaggtgactctgagtgaaggtcctcaccatgtggccctatttaaagatagttctcgggagtttgatcttaccaaagaagaagatcttgcagcattaagacatgaaatagaacttcgaatgaggaaaaatgtgaaagaaggctgtaccgttagccctgagaccatatccttaaatgtaaaaggccctggactacagaggatggtgcttgttgacttaccaggtgtgattaatactgtgacatcaggcatggctcctgacacaaaggaaactattttcagtatcagcaaagcttacatgcagaatcctaatgccatcatactgtgtattcaagatggatctgtggatgctgaacgcagtattgttacagacttggtcagtcaaatggaccctcatggaaggagaaccatattcgttttgaccaaagtagacctggcagagaaaaatgtagccagtccaagcaggattcagcagataattgaaggaaagctcttcccaatgaaagctttaggttattttgctgttgtaacaggaaaagggaacagctctgaaagcattgaagctataagagaatatgaagaagagttttttcagaattcaaagctcctaaagacaagcatgctaaaggcacaccaagtgactacaagaaatttaagccttgcagtatcagactgcttttggaaaatggtacgagagtctgttgaacaacaggctgatagtttcaaagcaacacgttttaaccttgaaactgaatggaagaataactatcctcgcctgcgggaacttgaccggaatgaactatttgaaaaagctaaaaatgaaatccttgatgaagttatcagtctgagccaggttacaccaaaacattgggaggaaatccttcaacaatctttgtgggaaagagtatcaactcatgtgattgaaaacatctaccttccagctgcgcagaccatgaattcaggaacttttaacaccacagtggatatcaagcttaaacagtggactgataaacaacttcctaataaagcagtagaggttgcttgggagaccctacaagaagaattttcccgctttatgacagaaccgaaagggaaagagcatgatgacatatttgataaacttaaagaggctgttaaggaagaaagtattaaacgacacaagtggaatgactttgcggaggacagcttgagggttattcaacacaatgctttggaagaccgatccatatctgataaacagcaatgggatgcagctatttattttatggaagaggctctgcaggctcgtctcaaggatactgaaaatgcaattgaaaacatggtgggtccagactggaaaaagaggtggttatactggaagaatcggacccaagaacagtgtgttcacaatgaaaccaagaatgaattggagaagatgttgaaatgtaatgaggagcacccagcttatcttgcaagtgatgaaataaccacagtccggaagaaccttgaatcccgaggagtagaagtagatccaagcttgattaaggatacttggcatcaagtttatagaagacattttttaaaaacagctctaaaccattgtaacctttgtcgaagaggtttttattactaccaaaggcattttgtagattctgagttggaatgcaatgatgtggtcttgttttggcgtatacagcgcatgcttgctatcaccgcaaatactttaaggcaacaacttacaaatactgaagttaggcgattagagaaaaatgttaaagaggtattggaagattttgctgaagatggtgagaagaagattaaattgcttactggtaaacgcgttcaactggcggaagacctcaagaaagttagagaaattcaagaaaaacttgatgctttcattgaagctcttcatcaggagaaataaattaaaatcgtactcataatcagctctgcatacatctgaagaacaaaaacatcaacgtcttttgtccagcctctttttcttctgctgttccacctttctaaacatacaataaagtcatgggataaaaataatcgatgtatgttacgggcgctttaaccatcagctgcctctcgaatggaagaacagtggtaatggattaacatcctattttgttgtactaaagtgacaaatcggaataatataattggtatggccattaggttcagtccttgaagataagaaacttgttctctgtttgttgtcttatttgtggtggcactcgtttaatggattaactgaggttgctcaatgttcagtttcttttccagaaatacaatgctaggtgttttgaaataaaacttatatagcaattgtttaaagttatcaattgtatataaaatcacagtagcctgctaaatcattgtatgtgtctgtagtattctattcccagaaactatttgaccatgataattcagtttatattcaccacatgaaagaaaaatgggtaacagaagaacccttaaaacaggttaatttggattgtaacgttcagtgaaagaaatttcaacccttcatagccagcgaagaaatttgccttggaagccaagtcagtaccagcttacctatttgattcagttgctgttttctcactctctatatccatttgaaattgatttattttagatgttgtatacttacgttaggctttctgttaatagtggtttttctcctgttgacagagccaccggattatgacacaggatgaggaagattaaggataatcaattgactaatttcatttagaatattatcaaacatttcaactaggtatcagaaaaaggctttctttcataagactattttaaatagaaattatttcaacaattaaagtaatgttgaccatccccctctcagctgaataaagaaaaatttagttcaatttattgcaatttaattacaatactaccttcacaacattttcatgtgttttaaataaatattttttaattggctaaaggacattcaagcaaagaaatgctttctttacttaaaatgtctatctcatttgctgccttttcactaagcctttactttgttaataaaagtgtccattgtgtgatgtttttgattttacagtttgctaaatcttattttcttggagttgctttttggtaacagccccattgctactccccattttattgttttacatcaatgcatgcttcgttgtgatccctcaagatgtaacacttggtatgctcggttgaggatatgaaaaaatacttccgaaaccaggaattcaatgtatgtttgttttatactgtttgataagaaaagtaggtccagccttaagcagcacagatgcgctggtagatgcatagtcaggaactttttttatttcttttaggtctagggacaggagtgaatagaaagggaggagagctctattatgttctatacacagattaggagatgaccttactgggtacacccctctaaccagtgcttacaggttaatgcatgttaatgaatatttttgcagttgtaaagcataacaattacaactacacatctatttctaaagaataaaacaggaccatatttatttacttctgtcaactatagaaagaaagaccttcagctgtatttccacagatttctcccaaggaaaaggctaatattagtcactactgttatcacatccctttgtataagttttaaaaagagatggagggagatcttcatttctttgaggagatcagtattgtaacgtatgtgaatagatgataacaattaatattactaaaagtcccacatgagagtcctgacgccctctccatgccccacagtaatgtggcttctttcatgggtttttttttcttctttttagctgatctcatcctaagcatgctttatttttccttgaaagctaggtatttatcaactgcagatgttattgaaagaaaataaaattcagtctcaagagtaaaccctgtgtcttgtgtctgtagttcaaaagtcagaaatgattctaatttaaacaaaaagatactaaatatacagaagttaaattcgaactagccacagaatcatttgtttttatgtcagaatttgcaaagagtggagtggacaaagctctgtatggaagactgaacaactgtaaatagatgatatccaaacttaatttggctaggacttcaattttaaaaatcagtgtacctaggcagtgcacagcacgaaataagtggcccttgcagcttccccgtttaacccactgtgctatagttgcgggtggaacagtcaacctttctagtagtttatgatattgccctctttgtattcccattttctacagttttttccgcagacttctttctgcaaattattcagcctccaaatgcaaatgaatgatataaaaataagtagggaacatggcagagagtggtgcttcccagcctcacaatgtgggaatttgacataggatgagagtcagagtataggtttaaaagataaaatctttagttaataattttgtatttatttattctagatgtatgtatctgaggaaagaaatctggtatttttgctttccaataaaggggatcaaagtaatggtttttctctcagttctctaagctggtctatgttatagctctagcagtatggaaatgtgctttaaaatatgcttaccttttgaatgatcatggctatatgttgttgagatatttgaaacttaccttgttttcacttgtgcactgtgaatgaactttgtattatttttttaaaaccttcacattacgtgtagatattattgcaacttatattttgcctgagcttgatcaaaggtcatttgtgtagatgagtaattaaaaaatatttaaatcacattataattctattattggagagcatcttttaaatttttttctgttttaacgagggaaagagaaacctgtatacctagggtcattatttgaccccatagtataaccagattcatggtctaacaagctctcagtgtggcttttctctgaatgcttgaatttcacatgccttgcatttcacagttgtactccatggtcaaccggtgctttttttcacatcgtggtacttgtcaaaacattttgttattttccttggtaaaatatataaaaaaggttttctaatttcactttgctgccaa

SEQ ID NO: 21121 - DNA, 554 bp, Homo sapiens
gctatctcatactaggatcggctgttgggggtggctacacagccaaaaagacttttgatcagtggaaagatatgataccggaccttagtgaatataaatggattgtgcctgacattgtgtgggaaattgatgagtatatcgattttgagaaaattagaaaagcccttcctagttcagaagaccttgtaaagttagcaccagactttgacaagattgttgaaagccttagcttattgaaggacttttttacctcaggtcacaaattggttagtgaagtcataggagcttctgacctacttctcttgttaggttctccggaagaaacggcgtttagagcaacagatcgtggatctgaaagtgacaagcattttagaaaggtgtcagacaaagagaaaattgaccaacttcaggaagaacttctgcacactcagttgaagtatcagagaatcttggaacgattagaaaaggagaacaaagaattgagaaaattagtattgcagaaagatgacaaaggcattcatcatagaaagcttaagaaatctttgattgacatg

SEQ ID NO: 21122 - DNA, 7871 bp, Homo sapiens
actgacgcacgcatggccacgagagggcgggggaggagtgaagaggttgaggcgccccgcccagtcagcaaggttgcgcgtgccctgtgagaccgccaagatggtggtgggcgcgttccctatggcgaagctgctatacttgggcatccggcaggtcagcaagccgcttgccaaccgtattaaggaggccgcccgccgaagcgagttcttcaagacctatatctgcctcccgccggctcaactgtatcactgggtggagatgcggaccaagatgcgcatcatgggcttccggggcacggtcatcaagccgctgaacgaggaggcggcagctgagctgggcgcagagctgctgggcgaagccaccatcttcatcgtgggcggcggctgcctagtgctggagtactggcgccaccaggcgcagcagcgccacaaggaggaggagcagcgtgctgcctggaacgcgctgcgggacgaggtgggccacctggcgctggcgctggaagcgctgcaggcgcaggtgcaggcggcgccgccacagggcgccctggaggaactgcgcacagagctgcaagaggtgcgcgcccagctctgcaatcccggccggtccgcttcccacgcagtgcctgcgtccaagaaataggagcttgctggatggaacctgaatttggacatggcctatgtacctaacgtggccttcttcccgcaccacccttgcctgcgctggcccagtggaaaccaccaggatcttgatgcaacttggcatttggttacccctgctgataagagcagccgttacctgccactgggaccagcaggtgaagcgttgcaacatagccccctccatcatccttcacctcctatcccccactccaaaccaggacgacctgcaaggtcccagccagcaggacaccgtgggcactctggcaaatgaaaaaatggaacctggtcttgagctgaatcaatgtgttattgttacccccacccccggtttacctgatcagtgttaacctttactgggacactcatctgttacactggaacaccttcttctttttgtcaatcggcacagaccactgtaaggaaatgcagtgtgttgcagtggccttttctccccctcaccttctaaggtcagctctagctgagcatcagtgctctcttaaggaggaaaaaaacggtgcggctgggagcggtggctcacgcctgtaatcctagcaccttgggaggccgaggcgggcggatcacttgaggtcaggagttccagaccagcctggccaacatggtgaaactccgtctctactaaaaatacaaaaattagccgggtgtggtggggtgcgcttgtaatcccagctactcgggaggctgaggcaggagaattgcttgaacccatgaggtggaggttgcggtgagccaagatggcaccattgcaccctagcctgggcaacagagcaagacaccgtcttaaaaccaaaagttaaccgggcgtggtggtgggtgcctgtaatcctagctacttgggaggctgaggcaggagaattgcttgaacttgggaggtggaggccaagattgtaccactgtattccagcccgggtgacagagcaagactgtgtctcaaaaaaaaaaaaaaaatcctggctgggcacggtggctcacacctgcaatcccagcactttggaaggtcgaggtgggcgggtcatttgaagtcgggaggtcgggagatcgggagctcgagaccagcctgaccaatatgatgaaaccccgtctctactaaaaatacataaattagctgggcatggtggcatgcacctgtaatcccagctacttgggaggctgagacaggagaattgcttgaacccgggaggcagaggttgcagtgagccgagattgcgcaattgcatgccagcctgggtaacgagcaaaactccatcttaaaaaaacccacaaaaggtcctggcctgcagtcaatccctggaatcattgtaccttcccttgagacccgaagtggactattccaacagaaccccctcatccttgagtctatggcacaacccactggaatggcactacaggatcttttctgtgaatgtcctccaacccccctttccgtggtgggaaatttgatcctaactagggctaatccagcctgtccttcagcctcagccccctattttcctgtcctcagagtccctggagcttgtactgtgtggcatgtcctttcttgccttccccaccttgctcagtagcatttctcagggacccagtcgaatccaagcccatggattcaattgtcacatccttcatcttccatccgtgtctcctaatctgtgtgctcttgctttctttcctcggagctctggactgacccgacagcctgtcttcatgtagcagtaccctcctgcctccatagcccccggtcccacccccatcctaccaattaggccagcagttggccttaactgcttgattaatttccttggactgccataacagatcaccattgggtggtgaacttgatggcttaagtccaacaggaatttaattcacacagttctggagtccagaagtctgaaaccaaggtgctgacagggacacgctccctcttccagctcctggtgattccaggccttccttggctctgcctgcagcttcacatggccttttccctcttctattttgtctcttacaagaacacctgtcattgcatttagggcccatcttaagttcaggatgatcccacctcaagacccttaattacatctgaaaaaacactttttccaaataaactgtcataagcacaggtcctgggggttagtatgtggacttgtctgttgggggcacaccattcaagccattcagcccactattcctcctcaccccaagagtacgctggcgtccaggtgcagtggctcacacctgtaatcccagcactttgggagaccagggcaggagggatctctttgagcccaggagctgaagaccagcctgggcaacatagtgagaccccatctctacaaaagtaaaataaaaaattagccaggtgcggtgatgcatgcctgtagtcccagctacttgggaggctgaggcaggaggatcacctgagccctggaggtcgaggctgcagcgagccgtgatcgcgccactacactccagcctggatgacagagtgagaccctttctcagaaaaaaagtaccctgggactcctgccaaccccgcgggccatttggccttcctgctagctgagaggaacagtctaggaaccacccttttctactgggtttctcttccaggatctgccactgaagcgggagggggtgggtcccagtagcctgcagtctgtccttccgactgtagctctctcattagaggagctgcaaggtgatgaaggcatcctgaggctgtacctgaaccaccatgtggatctccacaatgggtacagagcttattaaaatcaggagggaaactgggagggttctgatggggagaggcccaagagtcaccctatgagctggggaaactaaggccaggggtaagcaaagggacttgccagagatgccacagccagtgaggggctgactgcccagggtggtgaagtagtaggggcagagtgagaggcttggattaccccagctgcagagtgaggagggagaggcgatggctgagcagaggctgggagggtgacgatctctacacagaggcccagaccatcccagaggtggcgttgatagtgggagaccctctctatcccctctcagagcagccccagatcacaccagagatcatagcattgtgtaaactgggtgaccattccacctgggcccgcttttgggaagctgcaggtgaaagtgggagggccgggctttccccgacttccatcctcacctcccttctctaaagaggtaaaactggcctggaccaagatctgcccagatagaaagccaagaaacaggttctgaaacttttcttttcttcttttctcttcttttttcttttcttttctttcggagacagtctagctccgtcaccctgacggagtgcagtggtgcaatctcggctcactgcaacttctacctcccaggctcaaccaatgatcctgcctcagcttccgaagtagctgggattacatgtgcccaccacccacgcctggctaatttttgtattttagtggagacggggtttctccaagttgcccaggctgatcttgaactcctgacctcaggtaatccgcccgcctcggcctcccaaagtgctgggattacaggcgtgagccaccgcgcctggcctgaaacagcatttcagttccttctggaagagggggagaagctggagcagagggaactgaccgagtgggtcctgagtgggctgtgtttaaaactgggagtgacccaggccagctcacgcctgtcatcccagcactttgagaggccaaggtggactgatcacatgatgttaggagatcgagaccagcctggccaacatggcaaaaccccgtctctactaaaaatacaaaaattagccgggcatgttggcacattcctgaatcccagctactcgggaggctgaggcacgagaattgcttgaacccaggaggtggaggttgcagtgagctgagatcgcgccactgcactccagcctgggtgacagagtgagactcaactcaaaaaaaaaaaacagaggtgggagtgtgaacacaggcaggagctccaattcctgaccccagcgctgtcctgacccagatggagtgctgctctcacatctcagagacttcgcactcagccctgccctgccctgccctgacaggcagccagtcatcgtgggcagcagggccatctacttcccccactgcggcgtcaggggtggccagagtgtgtggaagtggaaagaacgtcctctcaaaatgcaagaggccagaggatggttcactgctcgtgtgttctgctagctagaattctgtgtaccttgtaatttggggagaggggttagaataaatttgtaaatgaagctgattatcttcaagttgatgcattcttttttcatatttaaaaagtccttgggactgggcgcagtggctcacacctgtaatcctagcactttgggaggccagggtgggtggatcacctgaggtcaggagttcaagaccaacctgatcaacatggtgaaacctcgtctctactaaaaatacaaaaattagctgggcatggtggttgtgcacctgtaatcccacctactcgggaggctgaggcaggagaatctcttggacccgggaggcggaggttgcagtgagccgagatcatgccattatactccagcctgggtgacagagcgagacttcatctctaaataaataaataaataaataaataaataaggtccatgtcaaccttaggaaaaatatcctttatttattctttcactcaaaaaactcactgaggtggtcccgcaccgggacatggacccagtgtccttggtagggcgtctcccgcaaaaaaaaaaaaaataaaaaaaataaaacacaaaactcactgagttacccactctctgccccaccctatgctggggtcacagtggtgacagagacagccccagccctgccgtcaccgggtcttacagatgctcacacgtacatttcttttccagtgttccctgccccaccccatagttgtttaggaagcaggggctgggctgaatccggaatcctccctctggagtgactcaggactataaacccattcatcccagctcacaaaaccctgggaggtgccctgagggctgtgcccctcccatctcctggcaggccctgctgtccctcttgttggtttctctgtagggcaggccattgcctggagggaggcaaaatggctgagagccaccccaggagaaaatgggctttacataagccccaacctgatctattggctcacggagctactcctgggctggtcgctgtgttgctgagtggcaggcttgggtcccccagtggcaatggcttgtagctggagtcggtgtggacagagagaggagaagcatggcaactctgagtgtactgaggatcaactgcaccaggctccattctagtagctgggagccagttgggagcaagcagaggccctcactggagctgacattctagtgccagagaccggcaataaagaaggaaagagtggccaggcgtggtggctcacacctgtaatctcagcactttgggaggccgaggcgggccaatcccctgaggtcgggagttcgagaccagcctgaccgacatggagaaaccccatctctactaaaaatacaaaattagcagggcatggtggtgcatgcctgtaatcccagccactcaggaggctgtggcaggagaatcgcttgaacccgggaggcggaggttgcggtgagccaatattgcaccattgcactccagcctgggcaacaagaacgagactccatctcaaaaaaaaaaggaaaaagctaatccagcatagggtgatgaggactgagaggaatggaggcagggtaggagttccggacttacgggcaccgctgatctagacaggtgggcagggaggaggcagcgcttcagatggagggagataggaagagggctgtgagtatctgtgaaagtcctaggacagatgtggccttggcctgttcctggaacagcaagagtttctggctgtcagaatagagcagaggctcgctgaccaaggcctttgggccaaatcaaggggacccttgcttcctgtctttgtaaataaagacttattggaacccaggcgctcattcgtttgcatattttccacagttgcttttgcagtacagtgacagagctgagtatttgcacagagatcctagggctctcgtactctctggccctttacagaaaaagtttaccatcccctggaatagagtaagcgaggggagaagttaggtgagggggccaggcaagcaaaggctgccccttgccttgattggcacaactgtggaggtcatcccagctctggagccccaacaggatcactcaggcctctgcttccaccacatctggcttcagcttccccctctgtggagtcctccctccctccctccttccccataggaaatgaccccagtgctcagcagtaacccccactgcgcgcagatctcagaacctccacctcaatctacagccacgtgccacaataagaagcagagttttaggccaggcgcggtggctcacgcctgtaatctcagtactttggaagaccaaggtgggaggatcacttgaagtcaggagttcgagaccagcctgcccaacatggtgaagccccgtctctaataaaaagaatacaaaaattagccgggtgtggtggtgcacatctgtaatcccagctacatgagaggctgacataggagaattgcttgagcccaggaggtggacgttgcagtgagccaagattgcactactgcattccagcctaggtgccagagtgagacttggtctcaaaacaaaacaaaacaaaaaattagccaggcatggtggcacacacctgtagtcccagctacttggggggctgaggcaggaggatcgcttgaacccgggtgtttaaggctgcagtgaactgagatcaggccacagcacctcaacctgggagacaaagtgagaccctgtctcaaaaaaaaaaaaaagcagagtttatgtaatccatcgtgtgcatatttatacaataatttacaattctatgtattttaaaagtgtataattcatatattatgtgacacaatatataatggaatataaaatatatattttatgtcatgtgtaacataacatcatctattatatgtagtgtatgtgcttatgtacatatcattggaatgaaagtttcattaaataattaccctt

SEQ ID NO: 21123 - DNA, 2250 bp, Homo sapiens
gagggcgggggaggagtgaagaggttgaggcgccccgcccagtcagcaaggttgcgcgtgccctgtgagaccgccaagatggtggtgggcgcgttccctatggcgaagctgctatacttgggcatccggcaggtcagcaagccgcttgccaaccgtattaaggaggccgcccgccgaagcgagttcttcaagacctatatctgcctcccgccggctcaactgtaccactggctggagatgcggaccaaaatgcgcatcatgggtttcaatgccgctgccatcaagccgctgaacgagggtgcagccgccgagctgggcgcggagctgctgggcgagggcatcatcttcatcaccgcctgcagctgcctgatgctggagtattggcgccaccagttgcagcagcgccgcaaggaaaaggagcgacgtgttgccagggaggcgctgcggggcgaggtgggccacttggggctggcgctcgaggagttgcaggcgcaggtgcaggcgacgtcgacgcagctcgccctggaggagctgcgcgctcagctgcaggaggtgcgagcccacctctgcctccgagacccgccgcctgcacccccagttgcgccggcgtccgagaaataggaggtctcggggccctggtcttggaggtgactgctgtctggactgcgaagtctctgtcttggcctattctccgcactgtcccatcctggaccggcccagctgacaccacccagtccttcgggggcgccggagagatcctgggctggagctgatcgaacctccctactaacctgcccagtggtaccttccactgggactctccgcctcctgcaggtggaacgttccaagaaggaccccgccctatcccaccccgcccctgccagcgcatttgttgagcactttggaaagacagcgtcttttatcagaccccacctccctaccgctaggtaggccagcaggacgtccacctcttttggcaaaacaaaattctgcacccggatttagccacctctcattctgtcacccgcaccctcactcacctgagtggacccttcccctaggacgctcatcctttgcaccgaacaccacctacctcctcctcattggtacagaccattgtaaagatgcacaaagttcctacggacttcccgacccgcccccttccatctacctcagtcttagggggaaaggtgggggtgaatcctggactgcgttagctccaatgagtcaccaccctgcggctcctgaccttaatccatcttagtacctgtcattgacatcctcccctccctgagtggatcgatccaacataacccccctcttcttccacctatggcgcaccccactggcatggctatgctgggtcttccagggaaacgcctcccagcccggcattctgtggtctgttccagcaggacgtggccttttgggaggaaaaaccggtcttgaccagggctagtccattctggctttcaggctcagtcacttggtcaccagtccccagtcctggacctactgctactgtccttttatccggtcctccctcgctgtcctcttcagttgcctttgctagggaccggcctgtccctttactacctaagtcatcgtcagttcgcccaacttccctccaaatctgcccctcacggtacgcagggatcgcccttccttcctgcctttggactggtccaggtcctcctccgccctccttcacgcaaaggcctcctccagggggactacctgtccctcagcccagaggtccccctgtccaagcggggtattccaccaggccatatgacctacccacccgacaactgaagggggcgtggatgagctctgtgactctgaatgctactttataaatcgactgtcagcgttttctaattaaaggagctctggggtaaagatcttaagaacgtgtctgagaaccataatgtgcgtctgcaaaatgtcattgaaattaggaaagaaggccggacacagtggctcacgcctgtaattccagcactttaagaggccaaagcaggaggactgctggaggccaggagttagagaccaacctaggcaacacagcaagaccgcatctctacgaaaaatgaaaatattagctaggcgtcataccaaacgcctgtagttccagctacttgggaggctgaggcaggaggatcccttgagcccaggagttcaaggctgcagtgagctgtgatcctgccactacactccagactgggtgaaagagcaagactccaactc

SEQ ID NO: 21124 - DNA, 1146 bp, Homo sapiens
agccgctgttctgccccgcgggggcatccgctgggtccccgcgccgttgtcaagaccggggacctggacgcagcggagagaggtgccgccgcccgccccgtccagtcgccgcgcgcagtgtatcactgggtggagatgcggaccaagatgcgcatcatgggcttccggggcacggtcatcaagccgctgaacgaggaggcggcagctgagctgggcgcagagctgctgggcgaagccaccatcttcatcgtgggcggcggctgcctagtgctggagtactggcgccaccaggcgcagcagcgccacaaggaggaggagcagcgtgctgcctggaacgcgctgcgggacgaggtgggccacctggcgctggcgctggaagcgctgcaggcgcaggtgcaggcggcgccgccacagggcgccctggaggaactgcgcacagagctgcaagaggtgcgcgcccagctctgcaatcccggccggtccgcttcccacgcagtgcctgcgtccaagaaataggagcttgctggatggaacctgaatttggacatggcctatgtacctaacgtggccttcttcccgcaccacccttgcctgcgctggcccagtggaaaccaccaggatcttgatgcaacttggcatttggttacccctgctgataagagcagccgttacctgccactgggaccagcaggtgaagcgttgcaacatagccccctccatcatccttcacctcctatcccccactccaaaccaggacgacctgcaaggtcccagccagcaggacaccgtgggcactctggcaaatgaaaaaatggaacctggtcttgagctgaatcaatgtgttattgttacccccacccccggtttacctgatcagtgttaacctttactgggacactcatctgttacactggaacaccttcttctttttgtcaatcggcacagaccactgtaaggaaatgcagtgtgttgcagtggccttttctccccctcaccttctaaggtcagctctagctgagcatcagtgctctcttaaggaggaaaaaaacggtgcggctgggagcggtggctcacgcctgtaatcctagcaccttgggaggccgaggcgggcggatcacttgaggtcaggagttccagaccagcctg

SEQ ID NO: 21125 - DNA, 3832 bp, Homo sapiens
atccctgcagcgctacccgggtactctggatgcacatagggcggctctcgctcctaccttgtcatcctgctgtctaatccgggggcagcttccctcctccacaccagcagaggctattcttcagcaacaagaatagccgagcctattcgtccgcaacaagagcccaagaagcatcctgcaggctttctgctttttgagtgtattttaaagcaaaaacgagtggaaagctatgtatgctcagttaactatgtctagatgttaaccttttttcaaaaaacacagatggaggcctccctccgaggatgcctggcattctcctctttctgtgggcggcagcgaccccctgcggctccagcctccactacgggatctgcgggaagacacggggaagacgaactccgcacactgcatttgattaatgatttattttgattaacgccgtcacagtgacgccttagagcagtccctgttcacccgggtcccagcctcgaccccgcacggacagcgagggtgtggctttgatagctggtggtgccacttcctggccttggatgagccgtacgcctctgtaaacccaacttcctcacctttgaaacagctgcctggttcagcattaatgaagattagtcagtgacaggcctggtgtgctgagtccgcacatagaacttctgcaatgtcccatcaacctctcagctgcctcactgaaaaggaggacagccccagtgaaagcacaggaaatggacccccccacctggcccacccaaacctggacacgtttaccccggaggagctgctgcagcagatgaaagagctcctgaccgagaaccaccagctgaaagaagccatgaagctaaataatcaagccatgaaagggagatttgaggagctttcggcctggacagagaaacagaaggaagaacgccagttttttgagatacagagcaaagaagcaaaagagcgtctaatggccttgagtcatgagaatgagaaattgaaggaagagcttggaaaactaaaagggaaatcagaaaggtcatctgaggaccccactgatgactccaggcttcccagggccgaagcggagcaggaaaaggaccagctcaggacccaggtggtgaggctacaagcagagaaggcagacctgttgggcatcgtgtctgaactgcagctcaagctgaactccagcggctcctcagaagattcctttgttgaaattaggatggctgaaggagaagcagaagggtcagtaaaagaaatcaagcatagtcctgggcccacgagaacagtctccactggcacggcattgtctaaatataggagcagatctgcagatggggccaagaattacttcgaacatgaggagttaactgtgagccagctcctgctgtgcctaagggaagggaatcagaaggtggagagacttgaagttgcactcaaggaggccaaagaaagagtttcagattttgaaaagaaaacaagtaatcgttctgagattgaaacccagacagaggggagcacagagaaagagaatgatgaagagaaaggcccggagactgttggaagcgaagtggaagcactgaacctccaggtgacatctctgtttaaggagcttcaagaggctcatacaaaactcagcaaagctgagctaatgaagaagagacttcaagaaaagtgtcaggcccttgaaaggaaaaattctgcaattccatcagagttgaatgaaaagcaagagcttgtttatactaacaaaaagttagagctacaagtggaaagcatgctatcagaaatcaaaatggaacaggctaaaacagaggatgaaaagtccaaattaactgtgctacagatgacacacaacaagcttcttcaagaacataataatgcattgaaaacaattgaggaactaacaagaaaagagtcagaaaaagtggacagggcagtgctgaaggaactgagtgaaaaactggaactggcagagaaggctctggcttccaaacagctgcaaatggatgaaatgaagcaaaccattgccaagcaggaagaggacctggaaaccatgaccatcctcagggctcagatggaagtttactgttctgattttcatgctgaaagagcagcgagagagaaaattcatgaggaaaaggagcaactggcattgcagctggcagttctgctgaaagagaatgatgctttcgaagacggaggcaggcagtccttgatggagatgcagagtcgtcatggggcgagaacaagtgactctgaccagcaggcttaccttgttcaaagaggagctgaggacagggactggcggcaacagcggaatattccgattcattcctgccccaagtgtggagaggttctgcctgacatagacacgttacagattcacgtgatggattgcatcatttaagtgttgatgtatcacctccccaaaactgttggtaaatgtcagattttttcctccaagagttgtgcttttgtgttatttgttttcactcaaatattttgcctcattattcttgttttaaaagaaagaaaacaggccgggcacagtggctcatgcctgtaatcccagcactttgggaggtcgaggtgggtggatcacttggggtcagggtttgagaccagcctggccaacatggcggaaccctgtctctaccaaaattacaaaaattagccgagcatggtggcgcatgcctgtagtcgcagctactcgcgaggttgaggcaggagaattgcttgaacccaggaagtggcagttgcagtgagccgagacgacaccactgcactccagcctgggtgacagagggagactctgtctcgaaagaaagaaagaaaaaaaggaaggaaggagaaggaaggaaggagaagaaaaggtacctgttctacgtagaacacctttggtggagttccatcaactcgcaaagtagaatccttacctactactcttctgataataattttaatattttttatgtttggttgatgcgagcagctgcactgctcatgcagttagctagcatgtgacatcatgtgacaaagttcatgtaattagatggaagaaacctcactgattaattttaagaaccttttagggatgcaggaacaatgaagtggccacagtatgtgctgtttttgaagcatttttaaaaacgaattgtagttgtttttcttcatttaaaatggatctgttggaggttatgtgtgtatgttgtagttttattgcagccacaataattttaccaaagttttcacataggcagttagcctttacttaatatcaagacaagtgaaaaaatattggcatcgatgaaaccgataacattggcctcattggatttctttacccattcacagtgtaaagaagttaccttcatgctttcattgtacctgcaggcctgtgggcttgtacagtagataattaatttctaaaaagaacagctgcctattttcttcctaggttaggttatatcttcataatcacaagaattagtgatggcaaaataaaattttgcttatgaatcttttacattgtttatatatgattaatatcatcatatatattttctgtattaagctcatttggcttcatttaagctgtatacttagtcatatatctttcattagttctatggatatgagcagatccctttactggagcccagtatgtgctgtgtgagttagaagtcattcttgctgagaaggtgaataggtagggatttgccttgttttgtaagtctacaatttgccaagagtaaataacactggaccagctgtaaaagtaaacagtgtgtttatgcattgagatactaaagcatttaagaaaaaattaaaa

SEQ ID NO: 21126 - DNA, 3400 bp, Homo sapiens
atcccggtcgggagttctctccaggcggcacgatgccgaggaaacagtgaccctgagcgaagccaagccgggcggcaggtgtggctttgatagctggtggtgccacttcctggccttggatgagccgtacgcctctgtaaacccaacttcctcacctttgaaacagctgcctggttcagcattaatgaagattagtcagtgacaggcctggtgtgctgagtccgcacatagaacttctgcaatgtcccatcaacctctcagctgcctcactgaaaaggaggacagccccagtgaaagcacaggaaatggacccccccacctggcccacccaaacctggacacgtttaccccggaggagctgctgcagcagatgaaagagctcctgaccgagaaccaccagctgaaagaagccatgaagctaaataatcaagccatgaaagggagatttgaggagctttcggcctggacagagaaacagaaggaagaacgccagttttttgagatacagagcaaagaagcaaaagagcgtctaatggccttgagtcatgagaatgagaaattgaaggaagagcttggaaaactaaaagggaaatcagaaaggtcatctgaggaccccactgatgactccaggcttcccagggccgaagcggagcaggaaaaggaccagctcaggacccaggtggtgaggctacaagcagagaaggcagacctgttgggcatcgtgtctgaactgcagctcaagctgaactccagcggctcctcagaagattcctttgttgaaattaggatggctgaaggagaagcagaagggtcagtaaaagaaatcaagcatagtcctgggcccacgagaacagtctccactggcacggcattgtctaaatataggagcagatctgcagatggggccaagaattacttcgaacatgaggagttaactgtgagccagctcctgctgtgcctaagggaagggaatcagaaggtggagagacttgaagttgcactcaaggaggccaaagaaagagtttcagattttgaaaagaaaacaagtaatcgttctgagattgaaacccagacagaggggagcacagagaaagagaatgatgaagagaaaggcccggagactgttggaagcgaagtggaagcactgaacctccaggtgacatctctgtttaaggagcttcaagaggctcatacaaaactcagcaaagctgagctaatgaagaagagacttcaagaaaagtgtcaggcccttgaaaggaaaaattctgcaattccatcagagttgaatgaaaagcaagagcttgtttatactaacaaaaagttagagctacaagtggaaagcatgctatcagaaatcaaaatggaacaggctaaaacagaggatgaaaagtccaaattaactgtgctacagatgacacacaacaagcttcttcaagaacataataatgcattgaaaacaattgaggaactaacaagaaaagagtcagaaaaagtggacagggcagtgctgaaggaactgagtgaaaaactggaactggcagagaaggctctggcttccaaacagctgcaaatggatgaaatgaagcaaaccattgccaagcaggaagaggacctggaaaccatgaccatcctcagggctcagatggaagtttactgttctgattttcatgctgaaagagcagcgagagagaaaattcatgaggaaaaggagcaactggcattgcagctggcagttctgctgaaagagaatgatgctttcgaagacggaggcaggcagtccttgatggagatgcagagtcgtcatggggcgagaacaagtgactctgaccagcaggcttaccttgttcaaagaggagctgaggacagggactggcggcaacagcggaatattccgattcattcctgccccaagtgtggagaggttctgcctgacatagacacgttacagattcacgtgatggattgcatcatttaagtgttgatgtatcacctccccaaaactgttggtaaatgtcagattttttcctccaagagttgtgcttttgtgttatttgttttcactcaaatattttgcctcattattcttgttttaaaagaaagaaaacaggccgggcacagtggctcatgcctgtaatcccagcactttgggaggtcgaggtgggtggatcacttggggtcagggtttgagaccagcctggccaacatggcggaaccctgtctctaccaaaattacaaaaattagccgagcatggtggcgcatgcctgtagtcgcagctactcgcgaggttgaggcaggagaattgcttgaacccaggaagtggcagttgcagtgagccgagacgacaccactgcactccagcctgggtgacagagggagactctgtctcgaaagaaagaaagaaaaaaaggaaggaaggagaaggaaggaaggagaagaaaaggtacctgttctacgtagaacacctttggtggagttccatcaactcgcaaagtagaatccttacctactactcttctgataataattttaatattttttatgtttggttgatgcgagcagctgcactgctcatgcagttagctagcatgtgacatcatgtgacaaagttcatgtaattagatggaagaaacctcactgattaattttaagaaccttttagggatgcaggaacaatgaagtggccacagtatgtgctgtttttgaagcatttttaaaaacgaattgtagttgtttttcttcatttaaaatggatctgttggaggttatgtgtgtatgttgtagttttattgcagccacaataattttaccaaagttttcacataggcagttagcctttacttaatatcaagacaagtgaaaaaatattggcatcgatgaaaccgataacattggcctcattggatttctttacccattcacagtgtaaagaagttaccttcatgctttcattgtacctgcaggcctgtgggcttgtacagtagataattaatttctaaaaagaacagctgcctattttcttcctaggttaggttatatcttcataatcacaagaattagtgatggcaaaataaaattttgcttatgaatcttttacattgtttatatatgattaatatcatcatatatattttctgtattaagctcatttggcttcatttaagctgtatacttagtcatatatctttcattagttctatggatatgagcagatccctttactggagcccagtatgtgctgtgtgagttagaagtcattcttgctgagaaggtgaataggtagggatttgccttgttttgtaagtctacaatttgccaagagtaaataacactggaccagctgtaaaagtaaacagtgtgtttatgcattgagatactaaagcatttaagaaaaaattaaaa

SEQ ID NO: 21127 - DNA, 3521 bp, Homo sapiens
gccccctccgccaccgccgccgcccgccggcaggttccctggtcagcgtcccatcccggtcgggagttctctccaggcggcacgatgccgaggaaacagtgaccctgagcgaagccaagccgggcggcaggtgtggctttgatagctggtggtgccacttcctggccttggatgagccgtacgcctctgtaaacccaacttcctcacctttgaaacagctgcctggttcagcattaatgaagattagtcagtgacaggcctggtgtgctgagtccgcacatagaagaatcaaaaatgtccaaaatgtaactggagagaaagtgggcaacttttggagtgacttttccacaggaacttctgcaatgtcccatcaacctctcagctgcctcactgaaaaggaggacagccccagtgaaagcacaggaaatggacccccccacctggcccacccaaacctggacacgtttaccccggaggagctgctgcagcagatgaaagagctcctgaccgagaaccaccagctgaaagaagccatgaagctaaataatcaagccatgaaagggagatttgaggagctttcggcctggacagagaaacagaaggaagaacgccagttttttgagatacagagcaaagaagcaaaagagcgtctaatggccttgagtcatgagaatgagaaattgaaggaagagcttggaaaactaaaagggaaatcagaaaggtcatctgaggaccccactgatgactccaggcttcccagggccgaagcggagcaggaaaaggaccagctcaggacccaggtggtgaggctacaagcagagaaggcagacctgttgggcatcgtgtctgaactgcagctcaagctgaactccagcggctcctcagaagattcctttgttgaaattaggatggctgaaggagaagcagaagggtcagtaaaagaaatcaagcatagtcctgggcccacgagaacagtctccactggcacggcattgtctaaatataggagcagatctgcagatggggccaagaattacttcgaacatgaggagttaactgtgagccagctcctgctgtgcctaagggaagggaatcagaaggtggagagacttgaagttgcactcaaggaggccaaagaaagagtttcagattttgaaaagaaaacaagtaatcgttctgagattgaaacccagacagaggggagcacagagaaagagaatgatgaagagaaaggcccggagactgttggaagcgaagtggaagcactgaacctccaggtgacatctctgtttaaggagcttcaagaggctcatacaaaactcagcaaagctgagctaatgaagaagagacttcaagaaaagtgtcaggcccttgaaaggaaaaattctgcaattccatcagagttgaatgaaaagcaagagcttgtttatactaacaaaaagttagagctacaagtggaaagcatgctatcagaaatcaaaatggaacaggctaaaacagaggatgaaaagtccaaattaactgtgctacagatgacacacaacaagcttcttcaagaacataataatgcattgaaaacaattgaggaactaacaagaaaagagtcagaaaaagtggacagggcagtgctgaaggaactgagtgaaaaactggaactggcagagaaggctctggcttccaaacagctgcaaatggatgaaatgaagcaaaccattgccaagcaggaagaggacctggaaaccatgaccatcctcagggctcagatggaagtttactgttctgattttcatgctgaaagagcagcgagagagaaaattcatgaggaaaaggagcaactggcattgcagctggcagttctgctgaaagagaatgatgctttcgaagacggaggcaggcagtccttgatggagatgcagagtcgtcatggggcgagaacaagtgactctgaccagcaggcttaccttgttcaaagaggagctgaggacagggactggcggcaacagcggaatattccgattcattcctgccccaagtgtggagaggttctgcctgacatagacacgttacagattcacgtgatggattgcatcatttaagtgttgatgtatcacctccccaaaactgttggtaaatgtcagattttttcctccaagagttgtgcttttgtgttatttgttttcactcaaatattttgcctcattattcttgttttaaaagaaagaaaacaggccgggcacagtggctcatgcctgtaatcccagcactttgggaggtcgaggtgggtggatcacttggggtcagggtttgagaccagcctggccaacatggcggaaccctgtctctaccaaaattacaaaaattagccgagcatggtggcgcatgcctgtagtcgcagctactcgcgaggttgaggcaggagaattgcttgaacccaggaagtggcagttgcagtgagccgagacgacaccactgcactccagcctgggtgacagagggagactctgtctcgaaagaaagaaagaaaaaaaggaaggaaggagaaggaaggaaggagaagaaaaggtacctgttctacgtagaacacctttggtggagttccatcaactcgcaaagtagaatccttacctactactcttctgataataattttaatattttttatgtttggttgatgcgagcagctgcactgctcatgcagttagctagcatgtgacatcatgtgacaaagttcatgtaattagatggaagaaacctcactgattaattttaagaaccttttagggatgcaggaacaatgaagtggccacagtatgtgctgtttttgaagcatttttaaaaacgaattgtagttgtttttcttcatttaaaatggatctgttggaggttatgtgtgtatgttgtagttttattgcagccacaataattttaccaaagttttcacataggcagttagcctttacttaatatcaagacaagtgaaaaaatattggcatcgatgaaaccgataacattggcctcattggatttctttacccattcacagtgtaaagaagttaccttcatgctttcattgtacctgcaggcctgtgggcttgtacagtagataattaatttctaaaaagaacagctgcctattttcttcctaggttaggttatatcttcataatcacaagaattagtgatggcaaaataaaattttgcttatgaatcttttacattgtttatatatgattaatatcatcatatatattttctgtattaagctcatttggcttcatttaagctgtatacttagtcatatatctttcattagttctatggatatgagcagatccctttactggagcccagtatgtgctgtgtgagttagaagtcattcttgctgagaaggtgaataggtagggatttgccttgttttgtaagtctacaatttgccaagagtaaataacactggaccagctgtaaaagtaaacagtgtgtttatgcattgagatactaaagcatttaagaaaaaattaaaa

SEQ ID NO: 21128 - DNA, 3488 bp, Homo sapiens
gccccctccgccaccgccgccgcccgccggcaggttccctggtcagcgtcccatcccggtcgggagttctctccaggcggcacgatgccgaggaaacagtgaccctgagcgaagccaagccgggcggcaggtgtggctttgatagctggtggtgccacttcctggccttggatgagccgtacgcctctgtaaacccaacttcctcacctttgaaacagctgcctggttcagcattaatgaagattagtcagtgacaggcctggtgtgctgagtccgcacatagaagaatcaaaaatgtccaaaatgtaactggagagaaagtgggcaacttttggagaacttctgcaatgtcccatcaacctctcagctgcctcactgaaaaggaggacagccccagtgaaagcacaggaaatggacccccccacctggcccacccaaacctggacacgtttaccccggaggagctgctgcagcagatgaaagagctcctgaccgagaaccaccagctgaaagaagccatgaagctaaataatcaagccatgaaagggagatttgaggagctttcggcctggacagagaaacagaaggaagaacgccagttttttgagatacagagcaaagaagcaaaagagcgtctaatggccttgagtcatgagaatgagaaattgaaggaagagcttggaaaactaaaagggaaatcagaaaggtcatctgaggaccccactgatgactccaggcttcccagggccgaagcggagcaggaaaaggaccagctcaggacccaggtggtgaggctacaagcagagaaggcagacctgttgggcatcgtgtctgaactgcagctcaagctgaactccagcggctcctcagaagattcctttgttgaaattaggatggctgaaggagaagcagaagggtcagtaaaagaaatcaagcatagtcctgggcccacgagaacagtctccactggcacgagcagatctgcagatggggccaagaattacttcgaacatgaggagttaactgtgagccagctcctgctgtgcctaagggaagggaatcagaaggtggagagacttgaagttgcactcaaggaggccaaagaaagagtttcagattttgaaaagaaaacaagtaatcgttctgagattgaaacccagacagaggggagcacagagaaagagaatgatgaagagaaaggcccggagactgttggaagcgaagtggaagcactgaacctccaggtgacatctctgtttaaggagcttcaagaggctcatacaaaactcagcaaagctgagctaatgaagaagagacttcaagaaaagtgtcaggcccttgaaaggaaaaattctgcaattccatcagagttgaatgaaaagcaagagcttgtttatactaacaaaaagttagagctacaagtggaaagcatgctatcagaaatcaaaatggaacaggctaaaacagaggatgaaaagtccaaattaactgtgctacagatgacacacaacaagcttcttcaagaacataataatgcattgaaaacaattgaggaactaacaagaaaagagtcagaaaaagtggacagggcagtgctgaaggaactgagtgaaaaactggaactggcagagaaggctctggcttccaaacagctgcaaatggatgaaatgaagcaaaccattgccaagcaggaagaggacctggaaaccatgaccatcctcagggctcagatggaagtttactgttctgattttcatgctgaaagagcagcgagagagaaaattcatgaggaaaaggagcaactggcattgcagctggcagttctgctgaaagagaatgatgctttcgaagacggaggcaggcagtccttgatggagatgcagagtcgtcatggggcgagaacaagtgactctgaccagcaggcttaccttgttcaaagaggagctgaggacagggactggcggcaacagcggaatattccgattcattcctgccccaagtgtggagaggttctgcctgacatagacacgttacagattcacgtgatggattgcatcatttaagtgttgatgtatcacctccccaaaactgttggtaaatgtcagattttttcctccaagagttgtgcttttgtgttatttgttttcactcaaatattttgcctcattattcttgttttaaaagaaagaaaacaggccgggcacagtggctcatgcctgtaatcccagcactttgggaggtcgaggtgggtggatcacttggggtcagggtttgagaccagcctggccaacatggcggaaccctgtctctaccaaaattacaaaaattagccgagcatggtggcgcatgcctgtagtcgcagctactcgcgaggttgaggcaggagaattgcttgaacccaggaagtggcagttgcagtgagccgagacgacaccactgcactccagcctgggtgacagagggagactctgtctcgaaagaaagaaagaaaaaaaggaaggaaggagaaggaaggaaggagaagaaaaggtacctgttctacgtagaacacctttggtggagttccatcaactcgcaaagtagaatccttacctactactcttctgataataattttaatattttttatgtttggttgatgcgagcagctgcactgctcatgcagttagctagcatgtgacatcatgtgacaaagttcatgtaattagatggaagaaacctcactgattaattttaagaaccttttagggatgcaggaacaatgaagtggccacagtatgtgctgtttttgaagcatttttaaaaacgaattgtagttgtttttcttcatttaaaatggatctgttggaggttatgtgtgtatgttgtagttttattgcagccacaataattttaccaaagttttcacataggcagttagcctttacttaatatcaagacaagtgaaaaaatattggcatcgatgaaaccgataacattggcctcattggatttctttacccattcacagtgtaaagaagttaccttcatgctttcattgtacctgcaggcctgtgggcttgtacagtagataattaatttctaaaaagaacagctgcctattttcttcctaggttaggttatatcttcataatcacaagaattagtgatggcaaaataaaattttgcttatgaatcttttacattgtttatatatgattaatatcatcatatatattttctgtattaagctcatttggcttcatttaagctgtatacttagtcatatatctttcattagttctatggatatgagcagatccctttactggagcccagtatgtgctgtgtgagttagaagtcattcttgctgagaaggtgaataggtagggatttgccttgttttgtaagtctacaatttgccaagagtaaataacactggaccagctgtaaaagtaaacagtgtgtttatgcattgagatactaaagcatttaagaaaaaattaaaa

SEQ ID NO: 21129 - DNA, 3304 bp, Homo sapiens
ggctgccccctccgccaccgccgccgcccgccggcaggttccctggtcagcgtcccatcccggtcgggagttctctccaggcggcacgatgccgaggaaacagtgaccctgagcgaagccaagccgggcggcaggaacttctgcaatgtcccatcaacctctcagctgcctcactgaaaaggaggacagccccagtgaaagcacaggaaatggacccccccacctggcccacccaaacctggacacgtttaccccggaggagctgctgcagcagatgaaagagctcctgaccgagaaccaccagctgaaagaagccatgaagctaaataatcaagccatgaaagggagatttgaggagctttcggcctggacagagaaacagaaggaagaacgccagttttttgagatacagagcaaagaagcaaaagagcgtctaatggccttgagtcatgagaatgagaaattgaaggaagagcttggaaaactaaaagggaaatcagaaaggtcatctgaggaccccactgatgactccaggcttcccagggccgaagcggagcaggaaaaggaccagctcaggacccaggtggtgaggctacaagcagagaaggcagacctgttgggcatcgtgtctgaactgcagctcaagctgaactccagcggctcctcagaagattcctttgttgaaattaggatggctgaaggagaagcagaagggtcagtaaaagaaatcaagcatagtcctgggcccacgagaacagtctccactggcacggcattgtctaaatataggagcagatctgcagatggggccaagaattacttcgaacatgaggagttaactgtgagccagctcctgctgtgcctaagggaagggaatcagaaggtggagagacttgaagttgcactcaaggaggccaaagaaagagtttcagattttgaaaagaaaacaagtaatcgttctgagattgaaacccagacagaggggagcacagagaaagagaatgatgaagagaaaggcccggagactgttggaagcgaagtggaagcactgaacctccaggtgacatctctgtttaaggagcttcaagaggctcatacaaaactcagcaaagctgagctaatgaagaagagacttcaagaaaagtgtcaggcccttgaaaggaaaaattctgcaattccatcagagttgaatgaaaagcaagagcttgtttatactaacaaaaagttagagctacaagtggaaagcatgctatcagaaatcaaaatggaacaggctaaaacagaggatgaaaagtccaaattaactgtgctacagatgacacacaacaagcttcttcaagaacataataatgcattgaaaacaattgaggaactaacaagaaaagagtcagaaaaagtggacagggcagtgctgaaggaactgagtgaaaaactggaactggcagagaaggctctggcttccaaacagctgcaaatggatgaaatgaagcaaaccattgccaagcaggaagaggacctggaaaccatgaccatcctcagggctcagatggaagtttactgttctgattttcatgctgaaagagcagcgagagagaaaattcatgaggaaaaggagcaactggcattgcagctggcagttctgctgaaagagaatgatgctttcgaagacggaggcaggcagtccttgatggagatgcagagtcgtcatggggcgagaacaagtgactctgaccagcaggcttaccttgttcaaagaggagctgaggacagggactggcggcaacagcggaatattccgattcattcctgccccaagtgtggagaggttctgcctgacatagacacgttacagattcacgtgatggattgcatcatttaagtgttgatgtatcacctccccaaaactgttggtaaatgtcagattttttcctccaagagttgtgcttttgtgttatttgttttcactcaaatattttgcctcattattcttgttttaaaagaaagaaaacaggccgggcacagtggctcatgcctgtaatcccagcactttgggaggtcgaggtgggtggatcacttggggtcagggtttgagaccagcctggccaacatggcggaaccctgtctctaccaaaattacaaaaattagccgagcatggtggcgcatgcctgtagtcgcagctactcgcgaggttgaggcaggagaattgcttgaacccaggaagtggcagttgcagtgagccgagacgacaccactgcactccagcctgggtgacagagggagactctgtctcgaaagaaagaaagaaaaaaaggaaggaaggagaaggaaggaaggagaagaaaaggtacctgttctacgtagaacacctttggtggagttccatcaactcgcaaagtagaatccttacctactactcttctgataataattttaatattttttatgtttggttgatgcgagcagctgcactgctcatgcagttagctagcatgtgacatcatgtgacaaagttcatgtaattagatggaagaaacctcactgattaattttaagaaccttttagggatgcaggaacaatgaagtggccacagtatgtgctgtttttgaagcatttttaaaaacgaattgtagttgtttttcttcatttaaaatggatctgttggaggttatgtgtgtatgttgtagttttattgcagccacaataattttaccaaagttttcacataggcagttagcctttacttaatatcaagacaagtgaaaaaatattggcatcgatgaaaccgataacattggcctcattggatttctttacccattcacagtgtaaagaagttaccttcatgctttcattgtacctgcaggcctgtgggcttgtacagtagataattaatttctaaaaagaacagctgcctattttcttcctaggttaggttatatcttcataatcacaagaattagtgatggcaaaataaaattttgcttatgaatcttttacattgtttatatatgattaatatcatcatatatattttctgtattaagctcatttggcttcatttaagctgtatacttagtcatatatctttcattagttctatggatatgagcagatccctttactggagcccagtatgtgctgtgtgagttagaagtcattcttgctgagaaggtgaataggtagggatttgccttgttttgtaagtctacaatttgccaagagtaaataacactggaccagctgtaaaagtaaacagtgtgtttatgcattgagatactaaagcatttaagaaaaaattaaaa

SEQ ID NO: 21130 - DNA, 3681 bp, Homo sapiens
tagccgagcctattcgtccgcaacaagagcccaagaagcatcctgcaggctttctgctttttgagtgtattttaaagcaaaaacgagtggaaagctatgtatgctcagttaactatgtctagatgttaaccttttttcaaaaaacacagatggaggcctccctccgaggatgcctggcattctcctctttctgtgggcggcagcgaccccctgcggctccagcctccactacgggatctgcgggaagacacggggaagacgaactccgcacactgcatttgattaatgatttattttgattaacgccgtcacagtgacgccttagagcagtccctgttcacccgggtcccagcctcgaccccgcacggacagcgagggtgtggctttgatagctggtggtgccacttcctggccttggatgagccgtacgcctctgtaaacccaacttcctcacctttgaaacagctgcctggttcagcattaatgaagattagtcagtgacaggcctggtgtgctgagtccgcacatagaacttctgcaatgtcccatcaacctctcagctgcctcactgaaaaggaggacagccccagtgaaagcacaggaaatggacccccccacctggcccacccaaacctggacacgtttaccccggaggagctgctgcagcagatgaaagagctcctgaccgagaaccaccagctgaaagaagccatgaagctaaataatcaagccatgaaagggagatttgaggagctttcggcctggacagagaaacagaaggaagaacgccagttttttgagatacagagcaaagaagcaaaagagcgtctaatggccttgagtcatgagaatgagaaattgaaggaagagcttggaaaactaaaagggaaatcagaaaggtcatctgaggaccccactgatgactccaggcttcccagggccgaagcggagcaggaaaaggaccagctcaggacccaggtggtgaggctacaagcagagaaggcagacctgttgggcatcgtgtctgaactgcagctcaagctgaactccagcggctcctcagaagattcctttgttgaaattaggatggctgaaggagaagcagaagggtcagtaaaagaaatcaagcatagtcctgggcccacgagaacagtctccactggcacgagcagatctgcagatggggccaagaattacttcgaacatgaggagttaactgtgagccagctcctgctgtgcctaagggaagggaatcagaaggtggagagacttgaagttgcactcaaggaggccaaagaaagagtttcagattttgaaaagaaaacaagtaatcgttctgagattgaaacccagacagaggggagcacagagaaagagaatgatgaagagaaaggcccggagactgttggaagcgaagtggaagcactgaacctccaggtgacatctctgtttaaggagcttcaagaggctcatacaaaactcagcaaagctgagctaatgaagaagagacttcaagaaaagtgtcaggcccttgaaaggaaaaattctgcaattccatcagagttgaatgaaaagcaagagcttgtttatactaacaaaaagttagagctacaagtggaaagcatgctatcagaaatcaaaatggaacaggctaaaacagaggatgaaaagtccaaattaactgtgctacagatgacacacaacaagcttcttcaagaacataataatgcattgaaaacaattgaggaactaacaagaaaagagtcagaaaaagtggacagggcagtgctgaaggaactgagtgaaaaactggaactggcagagaaggctctggcttccaaacagctgcaaatggatgaaatgaagcaaaccattgccaagcaggaagaggacctggaaaccatgaccatcctcagggctcagatggaagtttactgttctgattttcatgctgaaagagcagcgagagagaaaattcatgaggaaaaggagcaactggcattgcagctggcagttctgctgaaagagaatgatgctttcgaagacggaggcaggcagtccttgatggagatgcagagtcgtcatggggcgagaacaagtgactctgaccagcaggcttaccttgttcaaagaggagctgaggacagggactggcggcaacagcggaatattccgattcattcctgccccaagtgtggagaggttctgcctgacatagacacgttacagattcacgtgatggattgcatcatttaagtgttgatgtatcacctccccaaaactgttggtaaatgtcagattttttcctccaagagttgtgcttttgtgttatttgttttcactcaaatattttgcctcattattcttgttttaaaagaaagaaaacaggccgggcacagtggctcatgcctgtaatcccagcactttgggaggtcgaggtgggtggatcacttggggtcagggtttgagaccagcctggccaacatggcggaaccctgtctctaccaaaattacaaaaattagccgagcatggtggcgcatgcctgtagtcgcagctactcgcgaggttgaggcaggagaattgcttgaacccaggaagtggcagttgcagtgagccgagacgacaccactgcactccagcctgggtgacagagggagactctgtctcgaaagaaagaaagaaaaaaaggaaggaaggagaaggaaggaaggagaagaaaaggtacctgttctacgtagaacacctttggtggagttccatcaactcgcaaagtagaatccttacctactactcttctgataataattttaatattttttatgtttggttgatgcgagcagctgcactgctcatgcagttagctagcatgtgacatcatgtgacaaagttcatgtaattagatggaagaaacctcactgattaattttaagaaccttttagggatgcaggaacaatgaagtggccacagtatgtgctgtttttgaagcatttttaaaaacgaattgtagttgtttttcttcatttaaaatggatctgttggaggttatgtgtgtatgttgtagttttattgcagccacaataattttaccaaagttttcacataggcagttagcctttacttaatatcaagacaagtgaaaaaatattggcatcgatgaaaccgataacattggcctcattggatttctttacccattcacagtgtaaagaagttaccttcatgctttcattgtacctgcaggcctgtgggcttgtacagtagataattaatttctaaaaagaacagctgcctattttcttcctaggttaggttatatcttcataatcacaagaattagtgatggcaaaataaaattttgcttatgaatcttttacattgtttatatatgattaatatcatcatatatattttctgtattaagctcatttggcttcatttaagctgtatacttagtcatatatctttcattagttctatggatatgagcagatccctttactggagcccagtatgtgctgtgtgagttagaagtcattcttgctgagaaggtgaataggtagggatttgccttgttttgtaagtctacaatttgccaagagtaaataacactggaccagctgtaaaagtaaacagtgtgtttatgcattgagatactaaagcatttaagaaaaaattaaaa

SEQ ID NO: 21131 - DNA, 664 bp, Homo sapiens
aaggagaagcagaagggtcagtaaaagaaatcaagcatagtcctgggcccacgagaacagtctccactggcacggcattgtctaaatataggagcagatctgcagatggggccaagaattacttcgaacatgaggagttaactgtgagccagctcctgctgtgcctaagggaagggaatcagaaggtggagagacttgaagttgcactcaaggaggccaaagaaagagtttcagattttgaaaagaaaacaagtaatcgttctgagattgaaacccagacagaggggagcacagagaaagagaatgatgaagagaaaggcccggagactacagggtttcaccatgttggccaggatggtcttgatctcttgacctcgtgatcctcccacctcggcctcccagagtgctgggattacagatatgagccactgcgcccagctgcaagatgtatttctatcagtattctacaaaacgatttcctatgtctcttcttgactgatttcttctcctcggtccttcaatgaacaagcctactgtaggaaaaggaatgttgtccactttataatgagatcatttgaggatatgacttagaaacttgagggagaattgaaagatttgggttctatcccattactggtttgaataaagtagtttgaaaggaaaa

SEQ ID NO: 21132 - DNA, 848 bp, Homo sapiens
gccccctccgccaccgccgccgcccgccggcaggttccctggtcagcgtcccatcccggtcgggagttctctccaggcggcacgatgccgaggaaacagtgaccctgagcgaagccaagccgggcggcaggaacttctgcaatgtcccatcaacctctcagctgcctcactgaaaaggaggacagccccagtgaaagcacaggaaatggacccccccacctggcccacccaaacctggacacgtttaccccggaggagctgctgcagcagatgaaagagctcctgaccgagaaccaccagctgaaagagccatgtggtcaagtggactagagggagatttggttcatcagatcaagtccactttcctggtgtgtgactccatcactctgaacctcctgcagaagccatgaagctaaataatcaagccatgaaagggagatttgaggagctttcggcctggacagagaaacagaaggaagaacgccagttttttgagatacagagcaaagaagcaaaagagcgtctaatggccttgagtcatgagaatgagaaattgaaggaagagcttggaaaactaaaagggaaatcagaaaggtcatctgaggaccccactgatgactccaggcttcccagggccgaagcggagcaggaaaaggaccagctcaggacccaggtggtgaggctacaagcagagaaggcagacctgttgggcatcgtgtctgaactgcagctcaagctgaactccagcggctcctcagaagattcctttgttgaaattaggatggctgaaggagaagcagaagggtcagtaaaagaaatcaagcatagtcctgggcccacgagaacag

SEQ ID NO: 21133 - DNA, 2139 bp, Homo sapiens
gccgcccgggggcttttgccagcggcgccgcgggcctgcgtgctggggcagcgggcacttcttcgacctcgtcctcctcgtcctgtgcggccggccgggtgaggccgggcccgcgtagggggcagtcggcggctgcctccggcggaggtgcctcgcggcgcccgggccggcccgcgcctcggcggcgtgctccatgcatccggagcccgccccgcccccgagccgcagcagtcccgagcttcccccaagcggcggcagcaccaccagcggcagccgccggagccgccgccgcagcggggacggggagcccccgggggccccgccaccgccaccgccgccgtccgccgtcacctacccggactggatcggccagagttactccgaggtgatgagcctcaacgagcactccatgcaggcgctgtcctggcgcaagctctacttgagccgcgccaagcttaaagcctccagccggacctcggctctgctctccggcttcgccatggtggcaatggtggaggtgcagctggacgctgaccacgactacccaccggggctgctcatcgccttcagtgcctgcaccacagtgctggtggctgtgcacctgtttgcgctcatgatcagcacctgcatcctgcccaacatcgaggcggtgagcaacgtgcacaatctcaactcggtcaaggagtccccccatgagcgcatgcaccgccacatcgagctggcctgggccttctccaccgtcatcggcacgctgctcttcctagctgaggtggtgctgctctgctgggtcaagttcttgcccctcaagaagcagccaggccagccaaggcccaccagcaagccccccgccagtggcgcagcagccaacgtcagcaccagcggcatcaccccgggccaggcagctgccatcgcctcgaccaccatcatggtgcccttcggcctgatctttatcgtcttcgccgtccacttctaccgctcactggttagccataagactgaccgacagttccaggagctcaacgagctggcggagtttgcccgcttacaggaccagctggaccacagaggggaccaccccctgacgcccggcagccactatgcctaggcccatgtggtctgggcccttccagtgctttggccttacgcccttccccttgaccttgtcctgccccagcctcacggacagcctgcgcagggggctgggcttcagcaaggggcagagcatggagggaagaggatttttataagagaaatttctgcactttgaaactgtcctctaagagaataagcatttcctgttcttccagctccaggtccacctcctgttgggaggcggtggggggccaaagtggggccacacactcgctgtgtcccctctcctcccctgtgccagtgccacctgggtgcctcctcctgtcctgtccgtctcaacctccctcccgtccagcattgagtgtgtacatgtgtgtgtgacacataaatatactcataaggacacctccttcccgtgtcttgtatttgttgggcctgggctactgctcaccctggttaggtgagcctctaggaaaacttaaaacaaattttaagccaggtatggtggcacatacctgtggtctcagctattcaggaggccaaggcaggaggatctcttgagcccaggagtttgagaccccatctcaaacaaaaaatacaaaaattagccagccacggcgcctgcacttccagctcctttgagagactgaggcaggaagattgcctaagcccaggaggccaagtctgcagtgagctatggtaacaccactgcactccaacctgggcaacagagggagactctgtctctaaaaaaatagaaaaatttgccctgcatggtggctcacgcctgtaatcctagccctttggaaggccaaggcgggcagatcacttgaggtcgggagttcgagaccagcctgaccaacatggagaaaccccatctgtactaaaaatacaaaattagctgggtttggtggcgcatgcttgtaatcccagctactcgggaggctgaggcaggagaatcgcttgaacccaggaggcggaggttgcagtgagctgagatcgcgccattgcactccagcctgggcaacaacagtgaaactccgtctc

SEQ ID NO: 21134 - DNA, 10769 bp, Homo sapiens
gcggaaggagggagggggccgcgctcggcgccccggccgggccactgggccacaggccacgcggccacgcagtccgagcgggagccgagccgggcggggcgagggcagctccgggaaggaacgtcccagggatggaagtgcttggatgcggtgctgctggctgcggatgtgcgcaaggagatgggatggagagcctgagttggcattcgtataaatgacctgcctggctcccaccatgagtgctgagcttaacgtgcctatcgacccctctgctcctgcctgccctgagcccggccataagggcatggattaccgggactgggtccgccgcagctacctggaactggtcacctctaaccaccactcggtacaggccctgtcgtggcggaagctctacctgagcagggccaagctgaaggcctccagcaggacctccgccctcctctccggctttgccatggtggccatggtggaggtgcagctggagacgcagtaccagtacccgcggccgctgctgattgccttcagcgcctgcaccacggtgctggtggccgtgcacctgttcgccctcctcatcagcacctgcatcctgcccaatgtggaggccgtgagcaacatccacaacctgaactccatcagcgagtccccgcatgagcgcatgcacccctacatcgagctggcctggggcttctccaccgtgcttggcatcctactcttcctggccgaggtggtgctgctctgctggatcaagttcctccccgtggatgcccggcgccagcctggccccccacctggccctgggagtcacacgggctggcaggccgccctggtgtccaccatcatcatggtgcccgtgggcctcatcttcgtggtcttcaccatccacttctaccgctccctggtgcgccacaaaacggagcgccacaaccgcgagatcgaggagctccacaagctcaaggtccagctggacgggcatgagcgcagcctgcaggtcttgtgaggggccgagggccggggctgggagcggccctgtgcccgggagtccgcagaggcggggatttgtcagatgcagacattttgcaaggctgccgggtagttcaagaccaaagttttcctcttgtcttaataccataaggactggatgacttctcctgagatagaaccgtttggttcaatgagggactgtgttgctaagagcgttgggggcaaagccaggctggttccttggcctcggggtttcctgggtcggggacacggtgaagaggctccagcgggacctgcccatcagtcctgggccaggaggggctccaagcagcacccagcggtccgggggagtctcagacccggcatgcgtggctggcagacctgggagagccagggcagggttttgcgttcagagaaggattgccccagagacccgtggtggacttcatgggtgctgagtggcccgtgtgacagtgatgacacgaaggcttcggcgtttgagtgggtgcaggtgcacgccagggcttggtgcttccctgcctggccctggagggagctgggtggcctggcttcaggggaagacaggagccaggacacacgtcagcccagcaggtgtggggggtgctgcagccctcggcagtggggtcaggccctgggggatgtttccaatggtgggcagcctggccaggccggagaagacatgttcacgggcatctatcagatgcccccttgaggaggctgagttatttgagggctgctgcaaagtacgctaggctcaaattctcttttcccagccagagccctggccacacggactcagaggggccaccggggtggggaaaggacccctcccccaccccccgcagccactggcctccagctctcggccacagaatggcctctaaggctgactcagccactcccttgggctgtggcagcaggaggcgggggctctggctcaggccccggagcctgtgcagcttgcccatggccctaggcagcgaggggacagcctgggggacttcctgcctaggcaaggtcattggccgggcctggcctgtggatagtggggccaggggccggcccaggccaaatgagtgccctccttgttatgacaccaagtgactacaagggaggcaagacccctccaggcctctcagccgacactgggtcccaccacacacagtgactgtgccgtgcagtgcaggttctggccttttccttgaaggcatctggtagacccgaagccacgctctcgggccgcacatgcacgccgcagcaccagctgccctgagctgcttgtacaaccaaacacctttcccctcttctccagctgtaacctggagagtcagccatgccttgtcttttgttctcataaatagtcactggggccgggcgcagtgactcacgcctgtaatcccagcactttgggaggcctaggtgggcggatcacttgaggtcaggagttcgagaccagcctggccaacatggtgaaaccctgtctctactaaaaaaatacagaaaattagctgggcgtggtggcgggcgcctgtagccccagctacttgggaggctgaggcgggagaatggcaatggcgtgaacccgggaggcagagcttgcagtgagctgagatggcgccactgcactccagcctgggcgacagagccagactccatctcaaaaaaaaaaaaaaaattagccgggcgtgatggcgggcacctgtagtcccagctactcaggaggctgaggcaagagaatcacttgaacccaggaggcagaggttgcagtgagctgagatcacgccattgcactacagcctgggcaacaagagcgaaactttgtctaaaaaaaaaaaaaaatcactgggcttcttcatgctctgatcacatctctcgtaaaagcttaagctctctccggggtccgggttggccgtgccgtggaattctgggtggcctggctggggtctctggaaatgtggctgcagcagagaacagagaccctgacatgcagttttccgtgctgaggggccctaggggagtcacaccaagggtccccacgagaaagttgtggcatccccgggggccggagaagagccccgtgtcttctgaggggttcgtcctttgtgtcccctgcagacatttgtctgcgacctttgccctccagcatgtatgtactttcctgcagcctgtagaaacgcctcttacggtttaatatgtgttcgctttgctaaagaatatcaacatcggccaggcgaggtggggcacgcctgtcatcccagcactttgggaggctgaggtgggaggatcacttgggcccaggggtgcaagaccagcctgggcaacatagcgagaccccatgtctaaaaaaattattttaaattagccaggccgggtgcaatggctcgcgcccgtaatcttagcactctgggaggccgaggcaggcagatcacttgagatcaggactttaagaccagcctcggcaacaacatggtgaaaccatctctagcaaaaatacaaaaaattagccgggtatggtggcgggtacctgtaatcccagctactcaggaggctgaggcaagagaatcgcttgaacgcaggaggcagaggttgcagtgagctgagatcgtgccactgcactccagcctggacaacagagcaaaactctgtctcaaaaaataataaataaaaataaattagctgggcgtggtggtgcatgcctgtagttccagctacttgggaggctgaggtgggaggattgcttgagcctgggaagtagaggctgcagtgaactataactgtgctagtggccgggcgcagtggctcacgcctataatcccagcactttgggaggccaaagcaggtggatcacttgaggtcaggagttcgagaccagcctggccaacatggtgaaactctgtgtctactaaaaatacaaaaaattagctgggtgtggtggcgctcgcctgtagtcccagctacttgggaggctgaggcaggagaatcacttgaacccagaaggcagaggtagcagtgagccaagatggtgccactgcactccagcctgggcgacagagggtgactcctcaaaaaaaagaaaaatagctaaaatatgattgtaccactgcactccagcctgggtgacagagtgagaccctgtctctaaaaaaaaaaaaaagaaaataaagaaaaaagaatgtcagcatgtcagcgttcctccaaggagtggctttgggtcaagaagacaggctggctctcctaaacaaacggctccccacggctgggagaggcagcaggcccttactctggcctgagtcttttgggaggggccctgctgggccttctcctgccacctaccttcctggaccatctgtgcccctgcccacgcagtaccacactccccagactgtggaacgcatctccagtgccatctgggggccagttactgtacctggtccccaggcagagctcttggcctggcagcatccaggcaggtattaagtgcccagtgatggtggcacatgggtggggacggagccacatccaagtctagccctctgattaggaggatgacagtcttggaatttcttgttctctttctcctagggttctcgttctcccagctccagcctttctagtttcgaggcatgaggcaaaccattgctgtgggaatagcagtgaccattggtagggccatggtggccgggagaggaaacctcagggtcaccccagagcctgtggggagacggagggtgagctgttgttggagctgcagaaacgccttgaagggcagcatgggcgatgaggaatgccattgcagcctagaaattcggtttctggaggtttagcctgattttgaagagtatttaagaacagagggctccagaccaggtgtggtggctcacatctgtaatcccagcactttgggaggcagaggtgggcggatcgcctgagatcaggagttcgagaccagcctggcccacatggtgaaaccctgtctctactaaaaatacaaaaattagccgggcgtagtgacacacgcctgtaatcccagctgctcgggaggcagaggcaggagaatggcgtgaacccgggaggcggaggttgcagtgagccgagatcacgccactgcactccagcctgggtaacagagcaagactctgtctcaaaaaaaaaaaaaaaagaacaggggcctctgcctcagtttgcccgggagccagccagggcccatcctaatttggagcacagtcttcctggtgcctagacatgccaaggcccctcccacgtggtacaccctctccgtttagtacctgaccacctgtttcaaaacgcaggtgtttctggtttagaaacttggaaggcggaatgtgttttcgtgtcttctaggaagggtctgctgaggaccagaccacgtaagcctgagtggatcctgactcagctgcagcccttacctgcctcgtgctgatgatctatgcatggcgttatgtagatcacgtgcggcagagacagccactgtcctgtgtgcgggtttttaaaacagctgccctggatgaaacggaataaaccagtgatgctattcaaagtctttctgttcttgggggatgctgtgggcagaggggataaattgcagcccctggccctcccgtggcatctgctgactgggggacccacatcgtggcctgaaaaactcctggagcgccctctggcctcctgtcgctggtcactggccagtgtcctcccaggctgccccggcaagggggcgtggacatctctagaatggaggcagggtactcatgtccagacacgccgccatggggctccgccccgagagcgcagggtgcctctgcctggcgcttcccctcccagacagggccctctctttccagaaacaaaagaaggggcagccccagagggtggctgagcgacaacagagcccacctggacagggtcagcttggcgttccccccagtcccttgaggagaggagctaccagagcactggtcacctcaggacattctccagccccaagtccctgtggggcagcaggaacaggtgggtccctcctgcgggctggtggcactgctaaggaagcaccagacagccttttttttttttttgagacagagtcgctctgtcacccaagctggaatgcggtggcatgatcttggctcactgcaacctcctcctcccaggttcaagcgatcttgtgcctcagcctcccaagtagctgggattacaggcacgcaccaccatgcttggctaatttttgtatttttagtagagacgggggtttcaccatgttggccaggctggtctccaactcatgacctcgtgatctgcccacctcggcctcccaaagtgctgggattacaggtgtgagccagcttgcccagcttatgtttatagatttattttagagacagggttgggctctattgcccaggccagagctggagtgcagtggtgcaatcatagctctctgcaggctccagcttctgggcgcaagcaatcctcccacctcagtctcccaagtagctacacttgggagactacgggcgcacactaccatgcccagctaatgttttttttgtagagatgggatcttgctatgttgcccagtctggtcttgaacttctggcctcaagcgaccctcctgccttggcctcccaaagtgctgggattacaggtgcgagccaccatgcctggcccattctgttttttgtcggccactgaggtagaggccctcttctaggaaagaatttctgtttgttttgttttgttttgttttgtttttttgaaacagtctctctctgtctcccaggctggagtgcagtggcgtgatctcagctcgctgcaacctccacttcccaggttcaagcaattcttctgccaagctgggactacaggcatgcaccaccaccatgccctgctaatttttgttgttgtcgttggtttttgagatagagtttcgctcttgttgcccaggctggagtgcagtggcacgatctcagctcaccgcaacctccgcctcccaggttcaagcaattatcttgcctcagcctcccaagtagctgggattacaggcatgcgccaccacacctggcttatttttgtatttttagtagagatggggtttctccatgttagccaagctggtctcgaactcccgacctcagatgatccgcctgcctcagcctcccaaagtgctggggttacaggtgtgagccaccacacccagcctttctttttgcatttttaatagagactgagtttcatcacactggccaggctggtttcgaactcctggcctcaagtgatccgctggcctcagcctcctaaagtgctggattacaggcatgagccaccgtgccaggccttgttaatatttttaactctggcacttcaccctagaggctgctaggaatcaggtgtgccaagcaactggcaccactccatggaaagcgtctagggcagtgccttggttctgccaatcctgagaagccaggctgccccttgggctgggcagtggcctcagtaccgagccccaggccagcaagcccacaagcctcgagaaagactgcacttccggtggaggctgcagtttccttaaagggaaaatctgccccacccctgtcaagggcaggacacaagtcactggcattgaaggacccactccacacccagcagatcatcgacgcagactttttttttcccagatagagtctcactctgtcgtccaggctggactgcaatggtgtgatcttggctcactgtaacctccgcctcccgggctcaagtgattctcctgcctcagcctcctgagtagctaggattacaggcgcccaccatcacgcctggctaatttttgtatttttagtagagacggggttttgccatgttggccaggctggtcttgaactcctgacctcaagtgatcctcctgcctcagcctcccaaagtgctgggattataggcgtgagccacctcgtccggcccaagactttttgcctcagatgctgcagagccctggtggggcccaggagggcaaggcccacacaggagccgaaacccatgtagaacctgccaacctgtagctcacacctataatcccagcactttgggaggctgaggtgggcggatcgcttgagccaaggagttcgagaccagcctgggcaacattacgagaccctgtctctacaaaaatacaaaaattacccgggcttggtggctcgtgcctatagtcccagctactggggaggctgaggtgggagaatcatctgagcccagggaggttgagactgcagtgagccaagattgtgccactgcactccagcctgggtaaaatgagtgagaccacgtctcaacccctttcacagcccgtctgcggcccacccacccatgggtactgtgggatgggggacaggctggcttaacacaaatcgaggcaggaataaccccagagaatgggctttgcatggagcttggctcctgtccctgcctgtgagggaggaccagactcggcctcaccacctgccactctgagcaaacaggcaacggtgtttcctgaacatctttctgaagcggctgagggatgtcagctgagcccccgctgggcctgctctggagcgggatgtctccagaagccgcccttggagcgggcacttccctatttgggcgtgtcccagtcccatgcctcaccatccccttgcttgaagctccaagagcatgagagtgggcagcctggtctgctgaggaaagtgtctgatggatgcggaaatggccaccccaaacaccggtaagcagatgttaccctgcaggcggtggctcctggggcccagccctgcagaaacacatggggcaggctgggcagaggggctcacacccgttattcccagcgctttgggaggctgaggcgggaggatcgcttgagcccaggagtttgagaccagcctgggcaacatagcaagactctatctccactaaaaatcaaaacaaaacaattagctgggtatggtggcacacgcctgtagttccagctactggggaggctgagggggaggatcacttgagcccaggagttcaaggctgcagtgagccatgattgcgccactgcactccagcctgggcaacagagcaagaccctgccccgccgcctgaaagaaagaaaaaagaaagagaaaggaagagaaagaaaggaaaagaaaaaggaaacatacgaggctatggggccgtgtacgggggccaggctgtggcagaagcatcctggcgtggccttctccagccccatcctggttgggtaaggtgtcgccgtgggtcttcgtgtcacagcttcaaggacagacccaactctggtatcacaaacttaacaggtaatggagtttcctaaagtgtgctctgcaggagtgctggaagggccagcatggaaggaccccagggagggagatttctttgctccacagcatccccaagcctcacgaggcctctcccctccaagtctctatgtgcatcgttctccagatgttggagcatcctgcaggggccagcccagcctgtcaggggcagagaccctgcactggccccctcgagagtggacccctgggctggcttatctgctccagtgcagtgaggatcagctggagctccgacctgactcacatctggatgcgcagtgaggggcccgttggggccgtgatactgggaggaagccgggctctgtgctcttgctccaagtgagttgaccagggagccgaagttaaggtggcctgggagccacgtcctcccacctagcggctgggctctcacagccactagaaacccatcagcctttcccctgggtctatgcggggctcttcagccctcctgggagctcagtggctgggatgctgctttacagacagtgcacggctctgccatctgacagctcccagagggttctgggggtgactgtaaagagtggtgctggccccgaacctttcctgttcccctggatttagttcccagcaggtggtgaggaactgaacattttgtcccatagtggtgggagagagggctggccacatgggtccaggccaccccctcagcctccacagcctgccccgcacccagccacaggaacagcagagcagctcccccatccaggtaagcgcccccaccacagccccatcacaaaggaatagcctcctggtgtagtgggaggtgaggagctttttttgttttccttttatttattttagggacagggtcttgctctgttgccaagttaagtgcagtggtatgatcatgagctcactgcagccttgacatggtggtaaagccatcctcccgcctcagcctttcgagtagctgggactacaggtgtgtgccaccatgcccagacgcccagctaatgtttgtattttttgtagagatgggggtctcactatgttgcccaggctggcctcaagcaatcctcccacctgagccccgcaaagtactcggattacaggtgtgagtcaccgcgcctggccgggagctttaatttttcctacttgttaacagcgttatggggctggaaggaggctctcagatttccctgccctcctcacatcccccaaccctccctgggcgtgggggtgtcaagcatgagtcaggctgagcctgactctgaagctgttcccagctctttagtctaaacttcaaatcttcaaccctgttccctaatccaacacattccccaaatgaagggactggacagtgagatatcgggaaaccccatgaaaatagatgcataataaaggtgaaaatcattt

SEQ ID NO: 21135 - DNA, 2528 bp, Homo sapiens
gcgccccggccgggccactgggccacaggccacgcggccacgcagtccgagcgggagccgagccgggcggggcgagggcagctccgcctggctcccaccatgagtgctgagcttaacgtgcctatcgacccctctgctcctgcctgccctgagcccggccataagggcatggattaccgggactgggtccgccgcagctacctggaactggtcacctctaaccaccactcggtacaggccctgtcgtggcggaagctctacctgagcagggccaagctgaaggcctccagcaggacctccgccctcctctccggctttgccatggtggccatggtggaggtgcagctggagacgcagtaccagtacccgcggccgctgctgattgccttcagcgcctgcaccacggtgctggtggccgtgcacctgttcgccctcctcatcagcacctgcatcctgcccaatgtggaggccgtgagcaacatccacaacctgaactccatcagcgagtccccgcatgagcgcatgcacccctacatcgagctggcctggggcttctccaccgtgcttggcatcctactcttcctggccgaggtggtgctgctctgctggatcaagttcctccccgtggatgcccggcgccagcctggccccccacctggccctgggagtcacacgggctggcaggccgccctggtgtccaccatcatcatggtgcccgtgggcctcatcttcgtggtcttcaccatccacttctaccgctccctggtgcgccacaaaacggagcgccacaaccgcgagatcgaggagctccacaagctcaaggtccagctggacgggcatgagcgcagcctgcaggtcttgtgaggggccgagggccggggctgggagcggccctgtgcccgggagtccgcagaggcggggatttgtcagatgcagacattttgcaaggctgccgggtagttcaagaccaaagttttcctcttgtcttaataccataaggactggatgacttctcctgagatagaaccgtttggttcaatgagggactgtgttgctaagagcgttgggggcaaagccaggctggttccttggcctcggggtttcctgggtcggggacacggtgaagaggctccagcgggacctgcccatcagtcctgggccaggaggggctccaagcagcacccagcggtccgggggagtctcagacccggcatgcgtggctggcagacctgggagagccagggcagggttttgcgttcagagaaggattgccccagagacccgtggtggacttcatgggtgctgagtggcccgtgtgacagtgatgacacgaaggcttcggcgtttgagtgggtgcaggtgcacgccagggcttggtgcttccctgcctggccctggagggagctgggtggcctggcttcaggggaagacaggagccaggacacacgtcagcccagcaggtgtggggggtgctgcagccctcggcagtggggtcaggccctgggggatgtttccaatggtgggcagcctggccaggccggagaagacatgttcacgggcatctatcagatgcccccttgaggaggctgagttatttgagggctgctgcaaagtacgctaggctcaaattctcttttcccagccagagccctggccacacggactcagaggggccaccggggtggggaaaggacccctcccccaccccccgcagccactggcctccagctctcggccacagaatggcctctaaggctgactcagccactcccttgggctgtggcagcaggaggcgggggctctggctcaggccccggagcctgtgcagcttgcccatggccctaggcagcgaggggacagcctgggggacttcctgcctaggcaaggtcattggccgggcctggcctgtggatagtggggccaggggccggcccaggccaaatgagtgccctccttgttatgacaccaagtgactacaagggaggcaagacccctccaggcctctcagccgacactgggtcccaccacacacagtgactgtgccgtgcagtgcaggttctggccttttccttgaaggcatctggtagacccgaagccacgctctcgggccgcacatgcacgccgcagcaccagctgccctgagctgcttgtacaaccaaacacctttcccctcttctccagctgtaacctggagagtcagccatgccttgtcttttgttctcataaatagtcactggggccgggcgcagtgactcacgcctgtaatcccagcactttgggaggcctaggtgggcggatcacttgaggtcaggagttcgagaccagcctggccaacatggtgaaaccctgtctctactaaaaaaatacagaaaattagctgggcgtggtggcgggcgcctgtagccccagctacttgggaggctgaggcgggagaatggcaatggcgtgaacccgggaggcagagcttgcagtgagctgagatggcgccactgcactccagcctgggcgacagagccagactccatctc

SEQ ID NO: 21136 - DNA, 736 bp, Homo sapiens
gcgccccggccgggccactgggccacaggccacgcggccacgcagtccgagcgggagccgagccgggcggggcgagggcagctccgcctggctcccaccatgagtgctgagcttaacgtgcctatcgacccctctgctcctgcctgccctgagcccggccataagggcatggattaccgggactgggtccgccgcagctacctggaactggtcacctctaaccaccactcggtacaggccctgtcgtggcggaagctctacctgagcagggccaagctgaaggcctccagcaggacctccgccctcctctccggctttgccatggtggccatggtggaggtgcagctggagacgcagtaccagtacccgcggccgctgctgattgccttcagcgcctgcaccacggtgctggtggccgtgcacctgttcgccctcctcatcagcacctgcatcctgcccaatgtggaggccgtgagcaacatccacaacctgaactccatcagcgagtccccgcatgagcgcatgcacccctacatcgagctggcctggggcttctccaccgtgcttggcatcctactcttcctggccgaggtggtgctgctctgctggatcaagttcctccccgtggatgcccggcgccagcctggccccccacctggccctgggagtcacacgggctggcaggccgccctggtgtccaccatcatcatggtgcccgtgggcctcatcttcgtgg

SEQ ID NO: 21137 - DNA, 2493 bp, Homo sapiens
ggagagcctgagttggcattcgtataaatgacctgcctggctcccaccatgagtgctgagcttaacgtgcctatcgacccctctgctcctgcctgccctgagcccggccataagggcatggattaccgggactgggtccgccgcagctacctggaactggtcacctctaaccaccactcggtacaggccctgtcgtggcggaagctctacctgagcagggccaagctgaaggcctccagcaggacctccgccctcctctccggctttgccatggtggccatggtggaggtgcagctggagacgcagtaccagtacccgcggccgctgctgattgccttcagcgcctgcaccacggtgctggtggccgtgcacctgttcgccctcctcatcagcacctgcatcctgcccaatgtggaggccgtgagcaacatccacaacctgaactccatcagcgagtccccgcatgagcgcatgcacccctacatcgagctggcctggggcttctccaccgtgcttggcatcctactcttcctggccgaggtggtgctgctctgctggatcaagttcctccccgtggatgcccggcgccagcctggccccccacctggccctgggagtcacacgggctggcaggccgccctggtgtccaccatcatcatggtgcccgtgggcctcatcttcgtggtcttcaccatccacttctaccgctccctggtgcgccacaaaacggagcgccacaaccgcgagatcgaggagctccacaagctcaaggtccagctggacgggcatgagcgcagcctgcaggtcttgtgaggggccgagggccggggctgggagcggccctgtgcccgggagtccgcagaggcggggatttgtcagatgcagacattttgcaaggctgccgggtagttcaagaccaaagttttcctcttgtcttaataccataaggactggatgacttctcctgagatagaaccgtttggttcaatgagggactgtgttgctaagagcgttgggggcaaagccaggctggttccttggcctcggggtttcctgggtcggggacacggtgaagaggctccagcgggacctgcccatcagtcctgggccaggaggggctccaagcagcacccagcggtccgggggagtctcagacccggcatgcgtggctggcagacctgggagagccagggcagggttttgcgttcagagaaggattgccccagagacccgtggtggacttcatgggtgctgagtggcccgtgtgacagtgatgacacgaaggcttcggcgtttgagtgggtgcaggtgcacgccagggcttggtgcttccctgcctggccctggagggagctgggtggcctggcttcaggggaagacaggagccaggacacacgtcagcccagcaggtgtggggggtgctgcagccctcggcagtggggtcaggccctgggggatgtttccaatggtgggcagcctggccaggccggagaagacatgttcacgggcatctatcagatgcccccttgaggaggctgagttatttgagggctgctgcaaagtacgctaggctcaaattctcttttcccagccagagccctggccacacggactcagaggggccaccggggtggggaaaggacccctcccccaccccccgcagccactggcctccagctctcggccacagaatggcctctaaggctgactcagccactcccttgggctgtggcagcaggaggcgggggctctggctcaggccccggagcctgtgcagcttgcccatggccctaggcagcgaggggacagcctgggggacttcctgcctaggcaaggtcattggccgggcctggcctgtggatagtggggccaggggccggcccaggccaaatgagtgccctccttgttatgacaccaagtgactacaagggaggcaagacccctccaggcctctcagccgacactgggtcccaccacacacagtgactgtgccgtgcagtgcaggttctggccttttccttgaaggcatctggtagacccgaagccacgctctcgggccgcacatgcacgccgcagcaccagctgccctgagctgcttgtacaaccaaacacctttcccctcttctccagctgtaacctggagagtcagccatgccttgtcttttgttctcataaatagtcactggggccgggcgcagtgactcacgcctgtaatcccagcactttgggaggcctaggtgggcggatcacttgaggtcaggagttcgagaccagcctggccaacatggtgaaaccctgtctctactaaaaaaatacagaaaattagctgggcgtggtggcgggcgcctgtagccccagctacttgggaggctgaggcgggagaatggcaatggcgtgaacccgggaggcagagcttgcagtgagctgagatggcgccactgcactccagcctgggcgacagagccagactccatctcaaaaaaaaaaaaaaaa

SEQ ID NO: 21138 - DNA, 2638 bp, Homo sapiens
cgctcggcgccccggccgggccactgggccacaggccacgcggccacgcagtccgagcgggagccgagccgggcggggcgagggcagctccggaacgtcccagggatggaagtgcttggatgcggtgctgctggctgcggatgtgcgcaaggagatgggatggagagcctgagttggcattcgtataaatgacctgcctggctcccaccatgagtgctgagcttaacgtgcctatcgacccctctgctcctgcctgccctgagcccggccataagggcatggattaccgggactgggtccgccgcagctacctggaactggtcacctctaaccaccactcggtacaggccctgtcgtggcggaagctctacctgagcagggccaagctgaaggcctccagcaggacctccgccctcctctccggctttgccatggtggccatggtggaggtgcagctggagacgcagtaccagtacccgcggccgctgctgattgccttcagcgcctgcaccacggtgctggtggccgtgcacctgttcgccctcctcatcagcacctgcatcctgcccaatgtggaggccgtgagcaacatccacaacctgaactccatcagcgagtccccgcatgagcgcatgcacccctacatcgagctggcctggggcttctccaccgtgcttggcatcctactcttcctggccgaggtggtgctgctctgctggatcaagttcctccccgtggatgcccggcgccagcctggccccccacctggccctgggagtcacacgggctggcaggccgccctggtgtccaccatcatcatggtgcccgtgggcctcatcttcgtggtcttcaccatccacttctaccgctccctggtgcgccacaaaacggagcgccacaaccgcgagatcgaggagctccacaagctcaaggtccagctggacgggcatgagcgcagcctgcaggtcttgtgaggggccgagggccggggctgggagcggccctgtgcccgggagtccgcagaggcggggatttgtcagatgcagacattttgcaaggctgccgggtagttcaagaccaaagttttcctcttgtcttaataccataaggactggatgacttctcctgagatagaaccgtttggttcaatgagggactgtgttgctaagagcgttgggggcaaagccaggctggttccttggcctcggggtttcctgggtcggggacacggtgaagaggctccagcgggacctgcccatcagtcctgggccaggaggggctccaagcagcacccagcggtccgggggagtctcagacccggcatgcgtggctggcagacctgggagagccagggcagggttttgcgttcagagaaggattgccccagagacccgtggtggacttcatgggtgctgagtggcccgtgtgacagtgatgacacgaaggcttcggcgtttgagtgggtgcaggtgcacgccagggcttggtgcttccctgcctggccctggagggagctgggtggcctggcttcaggggaagacaggagccaggacacacgtcagcccagcaggtgtggggggtgctgcagccctcggcagtggggtcaggccctgggggatgtttccaatggtgggcagcctggccaggccggagaagacatgttcacgggcatctatcagatgcccccttgaggaggctgagttatttgagggctgctgcaaagtacgctaggctcaaattctcttttcccagccagagccctggccacacggactcagaggggccaccggggtggggaaaggacccctcccccaccccccgcagccactggcctccagctctcggccacagaatggcctctaaggctgactcagccactcccttgggctgtggcagcaggaggcgggggctctggctcaggccccggagcctgtgcagcttgcccatggccctaggcagcgaggggacagcctgggggacttcctgcctaggcaaggtcattggccgggcctggcctgtggatagtggggccaggggccggcccaggccaaatgagtgccctccttgttatgacaccaagtgactacaagggaggcaagacccctccaggcctctcagccgacactgggtcccaccacacacagtgactgtgccgtgcagtgcaggttctggccttttccttgaaggcatctggtagacccgaagccacgctctcgggccgcacatgcacgccgcagcaccagctgccctgagctgcttgtacaaccaaacacctttcccctcttctccagctgtaacctggagagtcagccatgccttgtcttttgttctcataaatagtcactggggccgggcgcagtgactcacgcctgtaatcccagcactttgggaggcctaggtgggcggatcacttgaggtcaggagttcgagaccagcctggccaacatggtgaaaccctgtctctactaaaaaaatacagaaaattagctgggcgtggtggcgggcgcctgtagccccagctacttgggaggctgaggcgggagaatggcaatggcgtgaacccgggaggcagagcttgcagtgagctgagatggcgccactgcactccagcctgggcgacagagccagactccatctc

SEQ ID NO: 21139 - DNA, 463 bp, Homo sapiens
aatgctgggcaccccccgaggctcaccctgccaagcctggggctccccttttgcgcccggacccaggggcagggaaagcccagctcgtggtctgtgggtagccggacccccgatggggcggtggggggcctcgccttgactcccagagctggggccggggacaggagctggggcaggagggatgcgcgcgggtcggggtcttcccacctcccctgctcctctccctcgcgcgatcccggggtggttccagggaaggaacgtcccagggatggaagtgcttggatgcggtgctgctggctgcggatgtgcgcaaggagatgggatggagagcctgagttggcattcgtataaatgacctgcctggctcccaccatgagtgctgagcttaacgtgcctatcgacccctctgctcctgcctgccctgagcccggccataagggcatggattaccgggactgggtcc

SEQ ID NO: 21140 - DNA, 937 bp, Homo sapiens
accccgcgcgaccggcggaaggagggagggggccgcgctcggcgccccggccgggccactgggccacaggccacgcggccacgcagtccgagcgggagccgagccgggcggggcgagggcagctccgggaaggaacgtcccagggatggaagtgcttggatgcggtgctgctggctgcggatgtgcgcaaggagatgggatggagagcctgagttggcattcgtataaatgacctgcctggctcccaccatgagtgctgagcttaacgtgcctatcgacccctctgctcctgcctgccctgagcccggccataagggcatggattaccgggactgggtccgccgcagctacctggaactggtcacctctaaccaccactcggtacaggccctgtcgtggcggaagctctacctgagcagggccaagctgaaggcctccagcaggacctccgccctcctctccggctttgccatggtggccatggtggaggtgcagctggagacgcagtaccagtacccgcggccgctgctgattgccttcagcgcctgcaccacggtgctggtggccgtgcacctgttcgccctcctcatcagcacctgcatcctgcccaatgtggaggccgtgagcaacatccacaacctgaactccatcagcgagtccccgcatgagcgcatgcacccctacatcgagctggcctggggcttctccaccgtgcttggcatcctactcttcctggccgaggtggtgctgctctgctggatcaagttcctccccgtggatgcccggcgccagcctggccccccacctggccctgggagtcacacgggctggcaggccgccctggtgtccaccatcatcatggtgcccgtgggcctcatcttcgtggtcttcaccatccacttctaccgctccctggtgcgccacaaaacggagcgcc

SEQ ID NO: 21141 - DNA, 479 bp, Homo sapiens
tacagcattttctattatgtggagctaacctacggattgcagcgtttctctgaattctccccaagggaaggaacgtcccagggatggaagtgcttggatgcggtgctgctggctgcggatgtgcgcaaggagatgggatggagagcctgagttggcattcgtataaatgacctgcctggctcccaccatgagtgctgagcttaacgtgcctatcgacccctctgctcctgcctgccctgagcccggccataagggcatggattaccgggactgggtccgccgcagctacctggaactggtcacctctaaccaccactcggtacaggccctgtcgtggcggaagctctacctgagcagggccaagctgaaggcctccagcaggacctccgccctcctctccggctttgccatggtggccatggtggaggtgcagctggagacgcagtaccagtacccgcggccgctgctgattgccttca

SEQ ID NO: 21142 - DNA, 2206 bp, Homo sapiens
ccagttcctgttttggcctccgctgtcccgctccggctcctggggctccccgcagacgctgcttttcttgctccactgggggtgcctcttcctgggcgcccgccgcctgcatcctgctcgtcctgtctgggaatggggccgcccccgggcttgggccggcccggctggggcccccgaggcgcttccgccccgtagtgaccgcctggtgccgccccccccccaggatgaagggcggcgagggggacgcgggcgagcaggccccgctgaaccctgagggcgagagccctgcaggctcggccacgtaccgggagttcgtgcaccgcggctacctggacctcatgggggccagtcagcactcgctgcgggcgctcagctggcgccgcctctacctcagccgggccaagctcaaagcttccagccgcacgtctgccttgctctcgggcttcgccatggtggccatggtggaggtgcagctggagagtgaccacgagtacccaccaggcctgctggtggccttcagtgcctgcaccaccgtgctggtggctgtgcacctctttgcactcatggtctccacgtgtctgctgccccacattgaagctgtgagcaacatccacaacctcaactctgtccaccagtcgccacaccagagactgcaccgctacgtggagctggcctggggcttctccactgccctgggcacctttctcttccttgctgaagttgtcctggttggttgggtcaagtttgtgcccattggggctcccttggacacaccgacccccatggtgcccacatcccgggtgcccgggactctggcaccagtggctacctcccttagtccagcttccaatctcccacggtcctctgcgtctgcagcaccgtcccaagctgagccagcctgcccaccccggcaagcctgtggtggtggtggggcccatgggccaggctggcaagcagccatggcctccacagccatcatggtacccgtggggctcgtgtttgtggcctttgccctgcatttctaccgctccttggtggcacacaagacagaccgctacaagcaggaactagaggaactgaatcgcctgcagggggagctgcaggctgtgtgagactggtgttagccaccgctcactgcaagcactgcctccctccggggtctgtaagaggccgcaggggcctacagacctcatccccccatcccctggctggagccacttccagtggccactctcaggcagagttcagattcctgcccgcagggtcctctgggctgggccttggggcagctcccacattcccagggattttccccatcagtctgtcccttgggttttgcaagctactctgcacctgggctggcctcagttgaaggatcatgcagtagatagaggggaggcagggagagcttgtgggaccttcagtgctgactttagccaccatttccattcctatacaggatgtgaaggtcagaaggcagccaattgttggtttaatttttttttttttttgagacagtctgtttcccaggctggagtgtagtgatacagtcacagctcactgtagcctcgaccttccaggctcaaaagatgctcccaccacagcctcccaggtagtgagtagctggtactacaggtgtgtgctgccacacccgactaatttttttgtagagacggggtttcgctgttcccaggctggtctcaaactcctgggctcaagtgaacctcccgcctcggcctcccaaagtgctgggattcctttctttatttctgtagaatctattttatggttggcattttgggggaagatttcgatgggttccacattcttgctttagttgttgtagagggatttgggtgtttctacccaaggcattggtctagcttttcctacaatgaacctatctttggaggttcaagctccccaccttcccccactgtggtgacctgtggccacttgcagaagggatggtgcctgacccactgccctagccccacgctatgcaccaaacttgttctccccgtcctggtccagggctggggtctttagagactgacagcctctgccccaggcctgagtccttagcaagggttgggtaaggaggttttaagggagaaggtccagtccttagcccttgaaatacaaagctcttctgacactgaatttggatgcaccttgttttatataataaatcgtgtttcacaga

SEQ ID NO: 21143 - DNA, 1028 bp, Homo sapiens
tccgctgtcccgctccggctcctggggctccccgcagacgctgcttttcttgctccactgggggtgcctcttcctgggcgcccgccgcctgcatcctgctcgtcctgtctgggaatggggccgcccccgggcttgggccggcccggctggggcccccgaggcgcttccgccccgtagtgaccgcctggtgccgccccccccccaggatgaagggcggcgagggggacgcgggcgagcaggccccgctgaaccctgagggcgagagccctgcaggctcggccacgtaccgggagttcgtgcaccgcggctacctggacctcatgggggccagtcagcactcgctgcgggcgctcagctggcgccgcctctacctcagccgggccaagctcaaagcttccagccgcacgtctgccttgctctcgggcttcgccatggtggccatggtggaggtgcagctggagagtgaccacgagtacccaccaggcctgctggtggccttcagtgcctgcaccaccgtgctggtggctgtgcacctctttgcactcatggtctccacgtgtctgctgccccacattgaagctgtgagcaacatccacaacctcaactctgtccaccagtcgccacaccagagactgcaccgctacgtggagctggcctggggcttctccactgccctgggcacctttctcttccttgctgaagttgtcctggttggttgggtcaagtttgtgcccattggggctcccttggacacaccgacccccatggtgcccacatcccgggtgcccgggactctggcaccagtggctacctcccttagtccagcttccaatctcccacggtcctctgcgtctgcagcaccgtcccaagctgagccagcctgcccaccccggcaagcctgtggtggtggtggggcccatgggccaggctggcaagcagccatggcctccacattcccagggattttccccatcagtctgtcccttgggttttgcaagctactctgcacctgggctggcctcagttga

SEQ ID NO: 21144 - DNA, 2478 bp, Homo sapiens
gggtctcgtctcctcccaagcggagcatttgtgcctgaagctgccgggtctgctacggcaccgcggggctgcagaaacccgggggccaagggcgggctgcttgccgctatggctggcagtcaggacatattcgatgccatcgtgatggcggatgagaggtttcatggggaagggtatcgggaaggctatgaagaaggcagtagtttgggtgtgatggagggaaggcagcatggcacgctgcatggagccaaaatcgggtctgagatcgggtgctaccaaggttttgcttttgcatggaaatgtctactgcacagttgcaccactgagaaggacagcagaaagatgaaggtcttagaatcattgattggaatgatccagaaattcccttatgatgaccctacttacgataaactccatgaagacttagacaagatcagaggaaaatttaaacagttttgttcgttactcaatgttcagccagactttaaaattagtgcagaaggttccggactttcattttgaggaggatggatgaacagagaccgaacgtcgaggaacagatgtgtgtgtgacgtgtttagaaatgcggtgaagggccagacggtgctgggaaggcagttgttcattgggagggtgagggttccggttcggccgtgggagggcttccttccctggggttttctgcctgtgtcaccttggtgcccgtcttggggcctcgccacacatgccctttgttgggctgaagccgtccctggcagagccctcgtgcattgacttgacagcctctccggcagcacaggcctagctggttctgggttggagttggctctggatagggtcagtcaccaggcctggactgaaggcagttatttttattattattattatttgcaatgagagagatggttggccccgaatgaggctcatgggaggtttggacgggtgctgtgccgcatgtcgaggccgattgtgtgccaggcggtgcgggacgtgcctcccgtgtgttatttaatcccttcaggagcccacaagatgggtgttattctcattttacagaggagggaggggagacgcgaagggattgcctggtctaagggcacccagcagcagagctaggacttccgccctaaggctgtgcctcactgccaccaggcacagccgcctccggaatgcacaggcgagtccctgccctccctcccaggccgcacaggtcctgccaagcctcacggagcacgggggagtctgtggtggccagtttacctgggcatctggctgagaggaagaaaggccaacctgatcctgaggggacccagacatatcctttgcactgtccctagaggggcgatgagctttgcagcattaaaaaatggtgaaggggggaaatattttgaaccaaagaccaaatgttaggccgccgttatatttgcagaagctttgagaaccatgcgtatagcctcctgcattctcccctctcctaggagctcttttgtctctgtccttacgaggcgtcatacagaggcagtggggtgggcacagatgagcagagtggatggttcggtgggtccccacgaggcgagtggtggtcatatgtgatggcacgtgttcacacaccctcctgtgtacccccccagggtcaccgaagtccccacacgctggctctccacacccctcctgttccagaaagcatgtccgaaagcagtccaggagattattaaggggtcgccatgaatccactttggttttaaaaccattcccgaatgtcctagtggattgtgttgtgctgcctaagctgccggctgcaggagccagagaagtgacccccgcgggagcagcggcaggtggatctccacggtggctcgctttgtttttgttttgttttttcttttaagacggagtctcactctgtcgccgagtttggagtgtattggcgcgatctcggctcactgtaacctccgcctcctgaattcaagtgattctcctgcctcagcctccctagtagctgggattataggcgccccccaccacgcccaagtaacttttgtatttttagtagagatggggttttgccttgttggccaggctggtcttgaactcccagcctgaaatgatccacccacgtccacctaccaaagtgctggaattgcaggcatgagccaccactcccggcctgctttttgtttttgaagacaggacttaggtctcctcctcccgaactctaaacctgcgtgtgtggctgtgcaccgctcgtttgtagcgtcacctcaggtctggggaagtctgtgctggcatctcctcattgtgccttcatcagagctggtgccttcgggccagaaagactctcgttctttctagatggtgggatcaggggcctttgctgtgtttcccttggtggatttttgtgttttgtaagttgtctattttgataatgtattatttttataactgtaaaaaaagtaaatagcatattttaaagtgaaa

SEQ ID NO: 21145 - DNA, 1000 bp, Homo sapiens
tctcgtctcctcccaagcggagcatttgtgcctgaagctgccgggtctgctacggcaccgcggggctgcagaaacccgggggccaagggcgggctgcttgccgctatggctggcagtcaggacatattcgatgccatcgtgatggcggatgagaggtttcatggggaagggtatcgggaaggctatgaagaaggcagtagtttgggtgtgatggagggaaggcagcatggcacgctgcatggagccaaaatcgggtctgagatcgggtgctaccaaggttttgcttttgcatggaaatgtctactgcacagttgcaccactgagaaggacagcagaaagatgaaggtcttagaatcattgattggaatgatccagaaattcccttatgatgaccctacttacgataaactccatgaagacttagacaagatcagaggaaaatttaaacagacgggcctttcgccttccgccgtgatggtgaggcctcccagctacgtagaactgccggttacatgttggtgctgggaagcgccgcggtgcaaccagaaatgcacagacccagccgcccgccgcccagaccctcagacttgcgcgtcacaggacagactccgctgtgccccgtgcacttgccaccagcctttggcctctcgatacacacaacatccaggacttgtgcccttgccccatcacgacagacaaagcgtccctcaaggcccccgcgtggttcagacagacgccgcagccaggatggttgagcagcaaacaatgtgaaagagatacacagaagcgatgtgaatatttccaaaccgtgcctggaagtcaacggtagcagcgcaataagaaaatggagctgcggcctgtccccggtgtgggcaccgccccttcccctcgggagcctcctcctcacacctcctcccgcctgtcctccctcacacgtcagcctccacactcttgccacctcccttcaacacttcctaaataaaaattacaagaattacat

SEQ ID NO: 21146 - DNA, 709 bp, Homo sapiens
atttgtgcctgaagctgccgggtctgctacggcaccgcggggctgcagaaacccgggggccaagggcgggctgcttgccgctatggctggcagtcaggacatattcgatgccatcgtgatggcggatgagaggtttcatggggaagggtatcgggaaggctatgaagaaggcagtagtttgggtgtgatggagggaaggcagcatggcacgctgcatggagccaaaatcgggtctgagatcgggtgctaccaaggttttgcttttgcatggaaatgtctactgcacagttgcaccactgagaaggacagcagaaagatgaaggtcttagaatcattgattggaatgatccagaaattcccttatgatgaccctacttacgataaactccatgaagacttagacaagatcagaggaaaatttaaacagttttgttcgttactcaatgttcagccagactttaaaattagtgcagaaggttccggactttcattttgaggaggatggatgaacagagaccgaacgtcgaggaacagatgccgcacaggtcctgccaagcctcacggagcacgggggagtctgtggtggccagtttacctgggcatctggctgagaggaagaaaggccaacctgatcctgaggggacccagacatatcctttgcactgtccctagaggggcgatgagctttgcagcattaaaaaatggtgaa

SEQ ID NO: 21147 - DNA, 2274 bp, Homo sapiens
gcatttgtgcctgaagctgccgggtctgctacggcaccgcggggctgcagaaacccgggggccaagggcgggctgcttgccgctatggctggcagtcaggacatattcgatgccatcgtgatggcggatgagagcagaaagatgaaggtcttagaatcattgattggaatgatccagaaattcccttatgatgaccctacttacgataaactccatgaagacttagacaagatcagaggaaaatttaaacagttttgttcgttactcaatgttcagccagactttaaaattagtgcagaaggttccggactttcattttgaggaggatggatgaacagagaccgaacgtcgaggaacagatgtgtgtgtgacgtgtttagaaatgcggtgaagggccagacggtgctgggaaggcagttgttcattgggagggtgagggttccggttcggccgtgggagggcttccttccctggggttttctgcctgtgtcaccttggtgcccgtcttggggcctcgccacacatgccctttgttgggctgaagccgtccctggcagagccctcgtgcattgacttgacagcctctccggcagcacaggcctagctggttctgggttggagttggctctggatagggtcagtcaccaggcctggactgaaggcagttatttttattattattattatttgcaatgagagagatggttggccccgaatgaggctcatgggaggtttggacgggtgctgtgccgcatgtcgaggccgattgtgtgccaggcggtgcgggacgtgcctcccgtgtgttatttaatcccttcaggagcccacaagatgggtgttattctcattttacagaggagggaggggagacgcgaagggattgcctggtctaagggcacccagcagcagagctaggacttccgccctaaggctgtgcctcactgccaccaggcacagccgcctccggaatgcacaggcgagtccctgccctccctcccaggccgcacaggtcctgccaagcctcacggagcacgggggagtctgtggtggccagtttacctgggcatctggctgagaggaagaaaggccaacctgatcctgaggggacccagacatatcctttgcactgtccctagaggggcgatgagctttgcagcattaaaaaatggtgaaggggggaaatattttgaaccaaagaccaaatgttaggccgccgttatatttgcagaagctttgagaaccatgcgtatagcctcctgcattctcccctctcctaggagctcttttgtctctgtccttacgaggcgtcatacagaggcagtggggtgggcacagatgagcagagtggatggttcggtgggtccccacgaggcgagtggtggtcatatgtgatggcacgtgttcacacaccctcctgtgtacccccccagggtcaccgaagtccccacacgctggctctccacacccctcctgttccagaaagcatgtccgaaagcagtccaggagattattaaggggtcgccatgaatccactttggttttaaaaccattcccgaatgtcctagtggattgtgttgtgctgcctaagctgccggctgcaggagccagagaagtgacccccgcgggagcagcggcaggtggatctccacggtggctcgctttgtttttgttttgttttttcttttaagacggagtctcactctgtcgccgagtttggagtgtattggcgcgatctcggctcactgtaacctccgcctcctgaattcaagtgattctcctgcctcagcctccctagtagctgggattataggcgccccccaccacgcccaagtaacttttgtatttttagtagagatggggttttgccttgttggccaggctggtcttgaactcccagcctgaaatgatccacccacgtccacctaccaaagtgctggaattgcaggcatgagccaccactcccggcctgctttttgtttttgaagacaggacttaggtctcctcctcccgaactctaaacctgcgtgtgtggctgtgcaccgctcgtttgtagcgtcacctcaggtctggggaagtctgtgctggcatctcctcattgtgccttcatcagagctggtgccttcgggccagaaagactctcgttctttctagatggtgggatcaggggcctttgctgtgtttcccttggtggatttttgtgttttgtaagttgtctattttgataatgtattatttttataactgtaaaaaaagtaaatagcatattttaaagtg

SEQ ID NO: 21148 - DNA, 3611 bp, Homo sapiens
cggactggctgtgaggcggtcctgcctcgctgccttcagtccctagtgtctgggtccccgccctccagccgcctttgagtcgtgcctgggtcctcgcccttgcctcagaaccgcgaagaaaggaagctcgcgtgtttgctagaaaacctagttgggagtgcgaggcagagaacgttcagcacctttgttcctcccgaaccctcgggacagaggcagggttctgagggcagggattccccctcgtcttggccccaccgcccgggctgggcactaaactcgggccgcggcggggcgagcgaggcgggctccggagggagctgacgcctgatgatggcgcagtccaacatgtttaccgtggctgatgtgttgagtcaagatgaactgcgcaaaaagctataccagacgtttaaggatcggggtatactggatacactcaagacacaacttcgaaaccagctaattcatgagttgatgcaccctgtattgagtggagaactgcagcctcggtccatttcagtagaagggagctccctcttaataggcgcctctaactctttagtggcagatcacttacaaagatgtggctatgaatattcactttctgttttctttccagaaagtggtttggcaaaagaaaaggtatttactatgcaggatctattacaactcattaaaatcaaccctacttccagtctctacaaatcactggtttcaggatctgataaagaaaatcaaaaaggttttcttatgcattttttaaaagaattggcagaatatcatcaagctaaagagagttgtaatatggaaactcagacaagttcgacatttaacagagattctctggctgagaagcttcagcttattgatgatcagtttgcagatgcttaccctcagcgtatcaagttcgaatctttagaaataaagctaaatgagtataagagagaaatagaagagcaacttcgggcagaaatgtgtcaaaagttgaagttttttaaagataccgagatagcaaaaattaaaatggaagcaaaaaaaaagtatgaaaaggagttaaccatgttccagaatgattttgaaaaagcttgtcaagcaaaatctgaagctctcgttcttcgggaaaagagtacccttgaaagaattcacaagcaccaagagattgaaacaaaagaaatttatgctcaaaggcaacttttactaaaagatatggatttgctaagaggaagagaagcagagctgaagcaaagagttgaagcttttgaattgaaccagaagctccaggaagaaaaacataaaagcataactgaggcacttaggagacaggagcagaatataaagagttttgaggagacctatgaccgaaagctcaagaatgaacttctaaagtatcaacttgaactgaaggatgactacatcattagaactaatcgactgattgaagatgaaaggaagaataaagaaaaagctgttcatttgcaagaggagctcatagctattaattcaaaaaaggaggaactcaatcaatctgtaaatcgtgtgaaagaacttgagcttgaattagagtctgtcaaagcccagtctttggcaataacaaaacaaaaccatatgctgaatgaaaaggttaaagagatgagtgattattcactactaaaagaagagaaactggagcttctggcacaaaataaattacttaaacaacaactggaagagagtagaaatgaaaacctgcgtctcctaaaccgcctagctcagccggctcctgaacttgcagtctttcagaaagaactacggaaagccgaaaaggctatagtggttgagcatgaggagttcgaaagctgcaggcaagctctgcacaaacaactgcaagacgaaattgagcattctgcacagctgaaggcccagattctaggttacaaagcttctgtaaagagtttaactactcaggttgccgatttaaaattgcaactgaagcaaactcagacagccctagagaatgaagtgtactgcaatccaaagcagtctgtgatcgatcgttctgtcaatggattaataaatggcaatgtggtgccttgcaatggtgagataagtggggatttcttgaacaatccttttaaacaggaaaacgttctagcacgtatggttgcatcaaggatcacaaattatccaactgcatgggtggagggtagttcccctgattctgaccttgagtttgtagccaatactaaggcaagggtcaaagagcttcagcaagaggccgaacgcttggaaaaggctttcagaagttaccatcggagagtcattaaaaactctgccaaaagcccactagcagcaaagagcccaccatctctgcacttgctggaagccttcaaaaacattacttccagttccccggaaagacatatttttggagaggacagagttgtctctgagcagcctcaagtgggcacacttgaagaaaggaatgacgtcgtggaagcactgacaggcagtgcagcctcgaggctccgcgggggcacttcctccagacgcctctcttccacaccccttccaaaagcaaaaagaagcctcgaaagtgaaatgtatctggaaggtctgggcagatcacacattgcttcccccagtccttgtcctgacagaatgcccctaccatcacccactgagtctaggcacagcctctccatccctcctgtctccagccctccggagcagaaagtgggtctttatcgaagacaaactgaacttcaagacaaaagtgaattttcagatgtggacaagctagcttttaaggataatgaggagtttgaatcatcttttgaatctgcagggaacatgccaaggcagttggaaatgggcgggctttctcctgccggggatatgtctcatgtggacgctgctgcagctgctgtgcccctctcatatcagcacccaagtgtagatcagaaacaaattgaagaacaaaaggaagaagaaaaaatacgggaacagcaagtgaaagaacgaaggcagagagaagaaagaaggcagagtaacctacaagaagttttagaaagggaacgaagagaactagaaaaactgtatcaggaaaggaagatgattgaagaatcactgaagattaaaataaaaaaggaattagaaatggaaaatgaattagaaatgagtaatcaagaaataaaagacaaatctgctcacagtgaaaatcctttagagaaatacatgaaaatcatccagcaggagcaagaccaggagtcggcagataagagctcaaaaaagatggtccaagaaggctccctagtggacacgctgcaatctagtgacaaagtcgaaagtttaacaggcttttctcatgaagaactagacgactcttggtaaccatgtttgctgcccagcttctaacttacataccgtgagaagttacgtaacatttactcctttgtaaatgtttccctatcatcagacaaaactcaataaaaatgtgtgtaatccaatgtgggtttttttttccataattaattttgataccatagtgtgtgaaccaagaataatctagtcacgtgaaacctcttctccagtcatagtatttctcattcattataataaaagtaactggcttttaa

SEQ ID NO: 21149 - DNA, 3531 bp, Homo sapiens
aaggctatatttagcaggtttccggaagttgccggactggctgtgaggcggtcctgcctcgctgccttcagtccctagtgtctgggtccccgccctccagccgcctttgagtcgtgcctgggtcctcgcccttgcctcagaaccgcgaagaaaggaagctcgcgtgtttgctagaaaacctagttgggagtgcgaggcagagaacgttcagcacctttgttcctcccgaaccctcgggacagaggcagggttctgagggcagggattccccctcgtcttggccccaccgcccgggctgggcactaaactcgggccgcggcggggcgagcgaggcgggctccggagggagctgacgcctgatgatggcgcagtccaacatgtttaccgtggctgatgtgttgagtcaagatgaactgcgcaaaaagctataccagacgtttaaggatcggggtatactggatacactcaagacacaacttcgaaaccagctaattcatgagttgatgcaccctgtattgagtggagaactgcagcctcggtccatttcagtagaagggagctccctcttaataggcgcctctaactctttagtggcagatcacttacaaagatgtggctatgaatattcactttctgttttctttccagaaagtggtttggcaaaagaaaaggtatttactatgcaggatctattacaactcattaaaatcaaccctacttccagtctctacaaatcactggtttcaggatctgataaagaaaatcaaaaaggttttcttatgcattttttaaaagaattggcagaatatcatcaagctaaagagagttgtaatatggaaactcagacaagttcgacatttaacagagattctctggctgagaagcttcagcttattgatgatcagtttgcagatgcttaccctcagcgtatcaagttcgaatctttagaaataaagctaaatgagtataagagagaaatagaagagcaacttcgggcagaaatgtgtcaaaagttgaagttttttaaagataccgagatagcaaaaattaaaatggaagcaaaaaaaaagtatgaaaaggagttaaccatgttccagaatgattttgaaaaagcttgtcaagcaaaatctgaagctctcgttcttcgggaaaagagtacccttgaaagaattcacaagcaccaagagattgaaacaaaagaaatttatgctcaaaggcaacttttactaaaagatatggatttgctaagaggaagagaagcagagctgaagcaaagagttgaagcttttgaattgtatcaacttgaactgaaggatgactacatcattagaactaatcgactgattgaagatgaaaggaagaataaagaaaaagctgttcatttgcaagaggagctcatagctattaattcaaaaaaggaggaactcaatcaatctgtaaatcgtgtgaaagaacttgagcttgaattagagtctgtcaaagcccagtctttggcaataacaaaacaaaaccatatgctgaatgaaaaggttaaagagatgagtgattattcactactaaaagaagagaaactggagcttctggcacaaaataaattacttaaacaacaactggaagagagtagaaatgaaaacctgcgtctcctaaaccgcctagctcagccggctcctgaacttgcagtctttcagaaagaactacggaaagccgaaaaggctatagtggttgagcatgaggagttcgaaagctgcaggcaagctctgcacaaacaactgcaagacgaaattgagcattctgcacagctgaaggcccagattctaggttacaaagcttctgtaaagagtttaactactcaggttgccgatttaaaattgcaactgaagcaaactcagacagccctagagaatgaagtgtactgcaatccaaagcagtctgtgatcgatcgttctgtcaatggattaataaatggcaatgtggtgccttgcaatggtgagataagtggggatttcttgaacaatccttttaaacaggaaaacgttctagcacgtatggttgcatcaaggatcacaaattatccaactgcatgggtggagggtagttcccctgattctgaccttgagtttgtagccaatactaaggcaagggtcaaagagcttcagcaagaggccgaacgcttggaaaaggctttcagaagttaccatcggagagtcattaaaaactctgccaaaagcccactagcagcaaagagcccaccatctctgcacttgctggaagccttcaaaaacattacttccagttccccggaaagacatatttttggagaggacagagttgtctctgagcagcctcaagtgggcacacttgaagaaaggaatgacgtcgtggaagcactgacaggcagtgcagcctcgaggctccgcgggggcacttcctccagacgcctctcttccacaccccttccaaaagcaaaaagaagcctcgaaagtgaaatgtatctggaaggtctgggcagatcacacattgcttcccccagtccttgtcctgacagaatgcccctaccatcacccactgagtctaggcacagcctctccatccctcctgtctccagccctccggagcagaaagtgggtctttatcgaagacaaactgaacttcaagacaaaagtgaattttcagatgtggacaagctagcttttaaggataatgaggagtttgaatcatcttttgaatctgcagggaacatgccaaggcagttggaaatgggcgggctttctcctgccggggatatgtctcatgtggacgctgctgcagctgctgtgcccctctcatatcagcacccaagtgtagatcagaaacaaattgaagaacaaaaggaagaagaaaaaatacgggaacagcaagtgaaagaacgaaggcagagagaagaaagaaggcagagtaacctacaagaagttttagaaagggaacgaagagaactagaaaaactgtatcaggaaaggaagatgattgaagaatcactgaagattaaaataaaaaaggaattagaaatggaaaatgaattagaaatgagtaatcaagaaataaaagacaaatctgctcacagtgaaaatcctttagagaaatacatgaaaatcatccagcaggagcaagaccaggagtcggcagataagagctcaaaaaagatggtccaagaaggctccctagtggacacgctgcaatctagtgacaaagtcgaaagtttaacaggcttttctcatgaagaactagacgactcttggtaaccatgtttgctgcccagcttctaacttacataccgtgagaagttacgtaacatttactcctttgtaaatgtttccctatcatcagacaaaactcaataaaaatgtgtgtaatccaatgtgggtttttttttccataattaattttgataccatagtgtgtgaaccaagaataatctagtcacgtgaaacctcttctccagtcatagtatttctcattcattataataaaagtaactggcttttaacctcctta

SEQ ID NO: 21150 - DNA, 3736 bp, Homo sapiens
cggactggctgtgaggcggtcctgcctcgctgccttcagtccctagtgtctgggtccccgccctccagccgcctttgagtcgtgcctgggtcctcgcccttgcctcagaaccgcgaagaaaggaagctcgcgtgtttgctagaaaacctagttgggagtgcgaggcagagaacgttcagcacctttgttcctcccgaaccctcgggacagaggcagggttctgagggcagggattccccctcgtcttggccccaccgcccgggctgggcactaaactcgggccgcggcggggcgagcgaggcgggctccggagggagctgacgcctgatgatggcgcagtccaacatgtttaccgtggctgatgtgttgagtcaagatgaactgcgcaaaaagctataccagacgtttaaggatcggggtatactggatacactcaagacacaacttcgaaaccagctaattcatgagttgatgcaccctgtattgagtggagaactgcagcctcggtccatttcagtagaagggagctccctcttaataggcgcctctaactctttagtggcagatcacttacaaagatgtggctatgaatattcactttctgttttctttccagaaagtggtttggcaaaagaaaaggtatttactatgcaggatctattacaactcattaaaatcaaccctacttccagtctctacaaatcactggtttcaggatctgataaagaaaatcaaaaagccattaagtctgtgacttaatcgccaagtctcttggtagtaatgttagcagaatataaataaattggagcacaagatattctggactgcccgcaaactagaccatctctactgaagttcagtatggttttcttatgcattttttaaaagaattggcagaatatcatcaagctaaagagagttgtaatatggaaactcagacaagttcgacatttaacagagattctctggctgagaagcttcagcttattgatgatcagtttgcagatgcttaccctcagcgtatcaagttcgaatctttagaaataaagctaaatgagtataagagagaaatagaagagcaacttcgggcagaaatgtgtcaaaagttgaagttttttaaagataccgagatagcaaaaattaaaatggaagcaaaaaaaaagtatgaaaaggagttaaccatgttccagaatgattttgaaaaagcttgtcaagcaaaatctgaagctctcgttcttcgggaaaagagtacccttgaaagaattcacaagcaccaagagattgaaacaaaagaaatttatgctcaaaggcaacttttactaaaagatatggatttgctaagaggaagagaagcagagctgaagcaaagagttgaagcttttgaattgaaccagaagctccaggaagaaaaacataaaagcataactgaggcacttaggagacaggagcagaatataaagagttttgaggagacctatgaccgaaagctcaagaatgaacttctaaagtatcaacttgaactgaaggatgactacatcattagaactaatcgactgattgaagatgaaaggaagaataaagaaaaagctgttcatttgcaagaggagctcatagctattaattcaaaaaaggaggaactcaatcaatctgtaaatcgtgtgaaagaacttgagcttgaattagagtctgtcaaagcccagtctttggcaataacaaaacaaaaccatatgctgaatgaaaaggttaaagagatgagtgattattcactactaaaagaagagaaactggagcttctggcacaaaataaattacttaaacaacaactggaagagagtagaaatgaaaacctgcgtctcctaaaccgcctagctcagccggctcctgaacttgcagtctttcagaaagaactacggaaagccgaaaaggctatagtggttgagcatgaggagttcgaaagctgcaggcaagctctgcacaaacaactgcaagacgaaattgagcattctgcacagctgaaggcccagattctaggttacaaagcttctgtaaagagtttaactactcaggttgccgatttaaaattgcaactgaagcaaactcagacagccctagagaatgaagtgtactgcaatccaaagcagtctgtgatcgatcgttctgtcaatggattaataaatggcaatgtggtgccttgcaatggtgagataagtggggatttcttgaacaatccttttaaacaggaaaacgttctagcacgtatggttgcatcaaggatcacaaattatccaactgcatgggtggagggtagttcccctgattctgaccttgagtttgtagccaatactaaggcaagggtcaaagagcttcagcaagaggccgaacgcttggaaaaggctttcagaagttaccatcggagagtcattaaaaactctgccaaaagcccactagcagcaaagagcccaccatctctgcacttgctggaagccttcaaaaacattacttccagttccccggaaagacatatttttggagaggacagagttgtctctgagcagcctcaagtgggcacacttgaagaaaggaatgacgtcgtggaagcactgacaggcagtgcagcctcgaggctccgcgggggcacttcctccagacgcctctcttccacaccccttccaaaagcaaaaagaagcctcgaaagtgaaatgtatctggaaggtctgggcagatcacacattgcttcccccagtccttgtcctgacagaatgcccctaccatcacccactgagtctaggcacagcctctccatccctcctgtctccagccctccggagcagaaagtgggtctttatcgaagacaaactgaacttcaagacaaaagtgaattttcagatgtggacaagctagcttttaaggataatgaggagtttgaatcatcttttgaatctgcagggaacatgccaaggcagttggaaatgggcgggctttctcctgccggggatatgtctcatgtggacgctgctgcagctgctgtgcccctctcatatcagcacccaagtgtagatcagaaacaaattgaagaacaaaaggaagaagaaaaaatacgggaacagcaagtgaaagaacgaaggcagagagaagaaagaaggcagagtaacctacaagaagttttagaaagggaacgaagagaactagaaaaactgtatcaggaaaggaagatgattgaagaatcactgaagattaaaataaaaaaggaattagaaatggaaaatgaattagaaatgagtaatcaagaaataaaagacaaatctgctcacagtgaaaatcctttagagaaatacatgaaaatcatccagcaggagcaagaccaggagtcggcagataagagctcaaaaaagatggtccaagaaggctccctagtggacacgctgcaatctagtgacaaagtcgaaagtttaacaggcttttctcatgaagaactagacgactcttggtaaccatgtttgctgcccagcttctaacttacataccgtgagaagttacgtaacatttactcctttgtaaatgtttccctatcatcagacaaaactcaataaaaatgtgtgtaatccaatgtgggtttttttttccataattaattttgataccatagtgtgtgaaccaagaataatctagtcacgtgaaacctcttctccagtcatagtatttctcattcattataataaaagtaactggcttttaa

SEQ ID NO: 21151 - DNA, 1597 bp, Homo sapiens
ttccggaagttgccggactggctgtgaggcggtcctgcctcgctgccttcagtccctagtgtctgggtccccgccctccagccgcctttgagtcgtgcctgggtcctcgcccttgcctcagaaccgcgaagaaaggaagctcgcgtgtttgctagaaaacctagttgggagtgcgaggcagagaacgttcagcacctttgttcctcccgaaccctcgggacagaggcagggttctgagggcagggattccccctcgtcttggccccaccgcccgggctgggcactaaactcgggccgcggcggggcgagcgaggcgggctccggagggagctgacgcctgatgatggcgcagtccaacatgtttaccgtggctgatgtgttgagtcaagatgaactgcgcaaaaagctataccagacgtttaaggatcggggtatactggatacactcaagacacaacttcgaaaccagctaattcatgagttgatgcaccctgtattgagtggagaactgcagcctcggtccatttcagtagaagggagctccctcttaataggcgcctctaactctttagtggcagatcacttacaaagatgtggctatgaatattcactttctgttttctttccagaaagtggtttggcaaaagaaaaggtatttactatgcaggatctattacaactcattaaaatcaaccctacttccagtctctacaaatcactggtttcaggatctgataaagaaaatcaaaaaggttttcttatgcattttttaaaagaattggcagaatatcatcaagctaaagagagttgtaatatggaaactcagacaagttcgacatttaacagagattctctggctgagaagcttcagcttattgatgatcagtttgcagatgcttaccctcagcgtatcaagttcgaatctttagaaataaagctaaatgagtataagagagaaatagaagagcaacttcgggcagaaatgtgtcaaaagttgaagttttttaaagataccgagatagcaaaaattaaaatggaagcaaaaaaaaagtatgaaaaggagttaaccatgttccagaatgattttgaaaaagcttgtcaagcaaaatctgaagctctcgttcttcgggaaaagagtacccttgaaagaattcacaagcaccaagagattgaaacaaaagaaatttatgctcaaaggcaacttttactaaaagatatggatttgctaagaggaagagaagcagagctgaagcaaagagttgaagcttttgaattgaaccagaagctccaggaagaaaaacataaaagcataactgaggcacttaggagacaggagcagaatataaagagttttgaggagacctatgaccgaaagctcaagaatgaacttctaaacttccacaggctgcatggtgtctgcctggctttgggaatcctcatatgactttggcaggtgttggagtttggaggctcttcgccacaggagtgcttctatttccttttggaaccaaaagggcagctggtaacagctgggaaagggaagtgaaactgtgaaaatgtgccttttggtattgctaatccggatataatgctcttg

SEQ ID NO: 21152 - DNA, 3307 bp, Homo sapiens
gggagtgcgaggcagagaacgttcagcacctttgttcctcccgaaccctcgggacagaggcagggttctgagggcagggattccccctcgtcttggccccaccgcccgggctgggcactaaactcgggccgcggcggggcgagcgaggcgggctccggagggagctgacgcctgatgatggcgcagtccaacatgtttaccgtggctgatgtgttgagtcaagatgaactgcgcaaaaagctataccagacgtttaaggatcggggtatactggatacactcaagacacaacttcgaaaccagctaattcatgagttgatgcaccctgtattgagtggagaactgcagcctcggtccatttcagtagaagggagctccctcttaataggcgcctctaactctttagtggcagatcacttacaaagatgtggctatgaatattcactttctgttttctttccagaaagtggtttggcaaaagaaaaggtatttactatgcaggatctattacaactcattaaaatcaaccctacttccagtctctacaaatcactggtttcaggatctgataaagaaaatcaaaaagccattaagtctgtgacttaatcgccaagtctcttggtagtaatgttagcagaatataaataaattggagcacaagatattctggactgcccgcaaactagaccatctctactgaagttcagtatggttttcttatgcatttttaaagaattggcagaatatcatcaagctaaagagagttgtaatatggaaactcagacaagttcgacatttaacagagattctctggctgagaagcttcagcttattgatgatcagtttgcagatgcttaccctcagcgtatcaagttcgaatctttagaaataaagctaaatgagtataagagagaaatagaagagcaacttcgggcagaaatgtgtcaaaagttgaagttttttaaagataccgagatagcaaaaattaaaatggaagcaaaaaaaaagtatgaaaaggagttaaccatgttccagaatgattttgaaaaagcttgtcaagcaaaatctgaagctctcgttcttcgggaaaagagtacccttgaaagaattcacaagcaccaagagattgaaacaaaagaaatttatgctcaaaggcaacttttactaaaagatatggatttgctaagaggaagagaagcagagctgaagcaaagagttgaagcttttgaattgtatcaacttgaactgaaggatgactacatcattagaactaatcgactgattgaagatgaaaggaagaataaagaaaaagctgttcatttgcaagaggagctcatagctattaattcaaaaaaggaggaactcaatcaatctgtaaatcgtgtgaaagaacttgagcttgaattagagtctgtcaaagcccagtctttggcaataacaaaacaaaaccatatgctgaatgaaaaggttaaagagatgagtgattattcactactaaaagaagagaaactggagcttctggcacaaaataaattacttaaacaacaactggaagagagtagaaatgaaaacctgcgtctcctaaaccgcctagctcagccggctcctgaacttgcagtctttcagaaagaactacggaaagccgaaaaggctatagtggttgagcatgaggagttcgaaagctgcaggcaagctctgcacaaacaactgcaagacgaaccctagagaatgaagtgtactgcaatccaaagcagtctgtgatcgatcgttctgtcaatggattaataaatggcaatgtggtgccttgcaatggtgagataagtggggatttcttgaacaatccttttaaacaggaaaacgttctagcacgtatggttgcatcaaggatcacaaattatccaactgcatgggtggagggtagttcccctgattctgaccttgagtttgtagccaatactaaggcaagggtcaaagagcttcagcaagaggccgaacgcttggaaaaggctttcagaagttaccatcggagagtcattaaaaactctgccaaaagcccactagcagcaaagagcccaccatctctgcacttgctggaagccttcaaaaacattacttccagttccccggaaagacatatttttggagaggacagagttgtctctgagcagcctcaagtgggcacacttgaagaaaggaatgacgtcgtggaagcactgacaggcagtgcagcctcgaggctccgcgggggcacttcctccagacgcctctcttccacaccccttccaaaagcaaaaagaagcctcgaaagtgaaatgtatctggaaggtctgggcagatcacacattgcttcccccagtccttgtcctgacagaatgcccctaccatcacccactgagtctaggcacagcctctccatccctcctgtctccagccctccggagcagaaagtgggtctttatcgaagacaaactgaacttcaagacaaaagtgaattttcagatgtggacaagctagcttttaaggataatgaggagtttgaatcatcttttgaatctgcagggaacatgccaaggcagttggaaatgggcgggctttctcctgccggggatatgtctcatgtggacgctgctgcagctgctgtgcccctctcatatcagcacccaagtgtagatcagaaacaaattgaagaacaaaaggaagaagaaaaaatacgggaacagcaagtgaaagaacgaaggcagagagaagaaagaaggcagagtaacctacaagaagttttagaaagggaacgaagagaactagaaaaactgtatcaggaaaggaagatgattgaagaatcactgaagattaaaataaaaaaggaattagaaatggaaaatgaattagaaatgagtaatcaagaaataaaagacaaatctgctcacagtgaaaatcctttagagaaatacatgaaaatcatccagcaggagcaagaccaggagtcggcagataagagctcaaaaaagatggtccaagaaggctccctagtggacacgctgcaatctagtgacaaagtcgaaagtttaacaggcttttctcatgaagaactagacgactcttggtaaccatgtttgctgcccagcttctaacttacataccgtgagaagttacgtaacatttactcctttgtaaatgtttccctatcatcagacaaaactcaataaaaatgtgtgtaatccaatgtgggtttttttttccataattaattttgataccatagtgtgtgaaccaagaataatctagtcacgtgaaacctcttctccagtca

SEQ ID NO: 21153 - DNA, 3080 bp, Homo sapiens
ctttggtcctggctttcggcccgtagttgtagaaggagccctgctggtgcaggttagaggtgccgcatcccccggagctctcgaagtggaggcggtaggaaacggagggcttgcggctagccggaggaagctttggagccggccatggcacactaccccacaaggctgaagaccagaaaaacttattcatgggttggcaggcccttgttggatcgaaaactgcactaccaaacctatagagaaatgtgtgtgaaaacagaaggttgttccaccgagattcacatccagattggacagtttgtgttgattgaaggggatgatgatgaaaacccgtatgttgctaaattgcttgagttgttcgaagatgactctgatcctcctcctaagaaacgtgctcgagtacagtggtttgtccgattctgtgaagtccctgcctgtaaacggcatttgttgggccggaagcctggtgcacaggaaatattctggtatgattacccggcctgtgacagcaacattaatgcggagaccatcattggccttgttcgggtgatacctttagccccaaaggatgtggtaccgacgaatctgaaaaatgagaagacactctttgtgaaactatcctggaatgagaagaaattcaggccactttcctcagaactatttgcggagttgaataaaccacaagagagtgcagccaagtgccagaaacccgtgagagccaagagtaagagtgcagagagcccttcttggaccccagcagaacatgtggccaaaaggattgaatcaaggcactccgcctccaaatctcgccaaactcctacccatcctcttaccccaagagccagaaagaggctggagcttggcaacttaggtaaccctcagatgtcccagcagacttcatgtgcctccttggattctccaggaagaataaaacggaaagtggccttctcggagatcacctcaccttctaagagatctcagcctgataaacttcaaaccttgtctccagctctgaaagccccagagaaaaccagagagactggactctcttatactgaggatgacaagaaggcttcacctgaacatcgcataatcctgagaacccgaattgcagcttcgaaaaccatagacattagagaggagagaacacttacccctatcagtgggggacagagatcttcagtggtgccatccgtgattctgaaaccagaaaacatcaaaaagagggatgcaaaagaagcaaaagcccagaatgaagcgacctctactccccatcgtatccgcagaaagagttctgtcttgactatgaatcggattaggcagcagcttcggtttctaggtaatagtaaaagtgaccaagaagagaaagagattctgccagcagcagagatttcagactctagcagtgacgaagaagaggcttccacaccgccccttccaaggagagcacccagaactgtgtccaggaacctgcgatcttccttgaagtcatccttacataccctcacgaaggtgccaaagaagagtctcaagcctagaacgccacgttgtgccgctcctcagatccgtagtcgaagcctggctgcccaggagccagccagtgtgctggaggaagcccgactgaggctgcatgtttctgctgtacctgagtctcttccctgtcgggaacaggaattccaagacatctacaattttgtggaaagcaaactccttgaccataccggagggtgcatgtacatctccggtgtccctgggacagggaagactgccactgttcatgaagtgatacgctgcctgcagcaggcagcccaagccaatgatgttcctccctttcaatacattgaggtcaatggcatgaagctgacggagccccaccaagtctatgtgcaaatcttgcagaagctaacaggccaaaaagcaacagccaaccatgcggcagaactgctggcaaagcaattctgcacccgagggtcacctcaggaaaccaccgtcctgcttgtggatgagctcgaccttctgtggactcacaaacaagacataatgtacaatctctttgactggcccactcataaggaggcccggcttgtggtcctggcaattgccaacacaatggacctgccagagcgaatcatgatgaaccgggtgtccagccgactgggtcttaccaggatgtgcttccagccctatacatatagccagctgcagcagatcctaaggtcccggctcaagcatctaaaggcctttgaagatgatgccatccagctggtagccaggaaggtagcagcactgtctggagatgcacgacggtgcctggacatctgcaggcgtgccacagagatctgtgagttctcccagcagaagcctgactcccctggcctggtcaccatagcccactcaatggaagctgtggatgagatgttttcatcatcatacatcacggccatcaaaaattcctctgttctggaacagagcttcctgagagccatcctcgcagagttccgtcgatcaggactggaggaagccacgtttcaacagatatatagtcaacatgtggcactgtgcagaatggagggactgccgtaccccaccatgtcagagaccatggccgtgtgttctcacctgggctcctgtcgcctcctgcttgtggagcccagcaggaacgatctgctccttcgggtgcggctcaacgtcagccaggatgatgtgctgtatgcgctgaaagacgagtaaaggggcttcacaagttaaaagactggggtcttgctgggttttgttttttgagacagggtcttgctctgtcgcccaggctggagtgcagtggcacgatcatggctcactgcagccttgacttctcaggcttaggtgaccccccaacctcatcctcccaggtggctgaaactacaggcacatgccaccatgcccagctgattttttgtagagacagggcttcaccatgttgccaagctagtctacaaagcatctgattttggaagtacatggaattgttgtaacaaagtatattgaatggaaatggctctcatgtattttggaattttccattaaataatttgctttttcct

SEQ ID NO: 21154 - DNA, 3157 bp, Homo sapiens
cggggccacgccgattggcgcgaagttttcttttctccttccaccttcttttcatttctagtgagacacacgctttggtcctggctttcggcccgtagttgtagaaggagccctgctggtgcaggttagaggtgccgcatcccccggagctctcgaagtggaggcggtaggaaacggagggcttgcggctagccggaggaagctttggagccggaagccatggcacactaccccacaaggctgaagaccagaaaaacttattcatgggttggcaggcccttgttggatcgaaaactgcactaccaaacctatagagaaatgtgtgtgaaaacagaaggttgttccaccgagattcacatccagattggacagtttgtgttgattgaaggggatgatgatgaaaacccgtatgttgctaaattgcttgagttgttcgaagatgactctgatcctcctcctaagaaacgtgctcgagtacagtggtttgtccgattctgtgaagtccctgcctgtaaacggcatttgttgggccggaagcctggtgcacaggaaatattctggtatgattacccggcctgtgacagcaacattaatgcggagaccatcattggccttgttcgggtgatacctttagccccaaaggatgtggtaccgacgaatctgaaaaatgagaagacactctttgtgaaactatcctggaatgagaagaaattcaggccactttcctcagaactatttgcggagttgaataaaccacaagagagtgcagccaagtgccagaaacccgtgagagccaagagtaagagtgcagagagcccttcttggaccccagcagaacatgtggccaaaaggattgaatcaaggcactccgcctccaaatctcgccaaactcctacccatcctcttaccccaagagccagaaagaggctggagcttggcaacttaggtaaccctcagatgtcccagcagacttcatgtgcctccttggattctccaggaagaataaaacggaaagtggccttctcggagatcacctcaccttctaagagatctcagcctgataaacttcaaaccttgtctccagctctgaaagccccagagaaaaccagagagactggactctcttatactgaggatgacaagaaggcttcacctgaacatcgcataatcctgagaacccgaattgcagcttcgaaaaccatagacattagagaggagagaacacttacccctatcagtgggggacagagatcttcagtggtgccatccgtgattctgaaaccagaaaacatcaaaaagagggatgcaaaagaagcaaaagcccagaatgaagcgacctctactccccatcgtatccgcagaaagagttctgtcttgactatgaatcggattaggcagcagcttcggtttctaggtaatagtaaaagtgaccaagaagagaaagagattctgccagcagcagagatttcagactctagcagtgacgaagaagaggcttccacaccgccccttccaaggagagcacccagaactgtgtccaggaacctgcgatcttccttgaagtcatccttacataccctcacgaaggtgccaaagaagagtctcaagcctagaacgccacgttgtgccgctcctcagatccgtagtcgaagcctggctgcccaggagccagccagtgtgctggaggaagcccgactgaggctgcatgtttctgctgtacctgagtctcttccctgtcgggaacaggaattccaagacatctacaattttgtggaaagcaaactccttgaccataccggagggtgcatgtacatctccggtgtccctgggacagggaagactgccactgttcatgaagtgatacgctgcctgcagcaggcagcccaagccaatgatgttcctccctttcaatacattgaggtcaatggcatgaagctgacggagccccaccaagtctatgtgcaaatcttgcagaagctaacaggccaaaaagcaacagccaaccatgcggcagaactgctggcaaagcaattctgcacccgagggtcacctcaggaaaccaccgtcctgcttgtggatgagctcgaccttctgtggactcacaaacaagacataatgtacaatctctttgactggcccactcataaggaggcccggcttgtggtcctggcaattgccaacacaatggacctgccagagcgaatcatgatgaaccgggtgtccagccgactgggtcttaccaggatgtgcttccagccctatacatatagccagctgcagcagatcctaaggtcccggctcaagcatctaaaggcctttgaagatgatgccatccagctggtagccaggaaggtagcagcactgtctggagatgcacgacggtgcctggacatctgcaggcgtgccacagagatctgtgagttctcccagcagaagcctgactcccctggcctggtcaccatagcccactcaatggaagctgtggatgagatgttttcatcatcatacatcacggccatcaaaaattcctctgttctggaacagagcttcctgagagccatcctcgcagagttccgtcgatcaggactggaggaagccacgtttcaacagatatatagtcaacatgtggcactgtgcagaatggagggactgccgtaccccaccatgtcagagaccatggccgtgtgttctcacctgggctcctgtcgcctcctgcttgtggagcccagcaggaacgatctgctccttcgggtgcggctcaacgtcagccaggatgatgtgctgtatgcgctgaaagacgagtaaaggggcttcacaagttaaaagactggggtcttgctgggttttgttttttgagacagggtcttgctctgtcgcccaggctggagtgcagtggcacgatcatggctcactgcagccttgacttctcaggcttaggtgaccccccaacctcatcctcccaggtggctgaaactacaggcacatgccaccatgcccagctgattttttgtagagacagggcttcaccatgttgccaagctagtctacaaagcatctgattttggaagtacatggaattgttgtaacaaagtatattgaatggaaatggctctcatgtattttggaattttccattaaataatttgctttttcctga

SEQ ID NO: 21155 - DNA, 4312 bp, Homo sapiens
gtgccgcacgcaggcttcccatcccccagctggcctccggtgctccttacctccccggtggtcgggcgcgaattactggaaattggcttttcccgttggggccgaaggtaccttccctgcggcggcgactcagcggggtgtcgttcggccggcgtgacgcagccggatcggcgccagacggaaacctagcggtgactgtatctgaattttgcagctgcagaatgtgtagtaccttaaaaggttggcaacaatgagtaaaccagaattaaaggaagacaagatgctggaggttcactttgtgggagatgatgatgttcttaatcacattctagatagagaaggaggagctaaattgaagaaggagcgagcgcagcttttggtcaaccccaaaaaaataataaagaagccagaatatgatttggaggaagatgaccaggaggtcttaaaagatcagaactatgtggaaattatgggaagagatgttcaagaatcattgaaaaatggctctgctacaggtggtggaaataaagtttattcttttcagaatagaaaacactctgaaaagatggctaaattagcttcagaactagcaaaaacaccacaaaaaagtgtttcattcagtttgaagaatgatcctgagattacgataaacgttcctcaaagtagcaagggccattctgcttcagacaaggttcaaccgaagaacaatgacaaaagtgaatttctgtcaacagcacctcgtagtctaagaaaaagattaatagttccaaggtctcattctgacagtgaaagcgaatattctgcttccaactcagaggatgatgaaggggttgcacaggaacatgaagaggacactaatgcagtcatattcagccaaaagattcaagctcagaatagagtagtttcagctcctgttggcaaagaaacaccttctaagagaatgaaaagagataaaacaagtgacttagtagaagaatattttgaagctcacagcagttcaaaagttttaacctctgatagaacactgcagaagctaaagagagctaaactggatcagcaaactttgcgtaacttattgagcaaggtttccccttccttttctgccgaacttaaacaactaaatcaacagtatgaaaaattatttcataaatggatgctgcaattacaccttgggttcaacattgtgctttatggtttgggttctaagagagatttactagaaaggtttcgaaccactatgctgcaagattccattcacgttgtcatcaatggcttctttcctggaatcagtgtgaaatcagtcctgaattctataacagaagaagtcctcgatcatatgggtactttccgcagtatactggatcagctagactggatagtaaacaaatttaaagaagattcttctttagaactcttccttctcatccacaatttggatagccagatgttgagaggagagaagagccagcaaatcattggtcagttgtcatctttgcataacatttaccttatagcatccattgaccacctcaatgctcctctcatgtgggatcatgcaaagcagagtctttttaactggctctggtatgaaactactacatacagtccttatactgaagaaacctcctatgagaactctcttctggtaaagcagtctggatccctgccacttagctcccttactcatgtcttacgaagccttacccctaatgcaaggggaattttcaggctactaataaaataccagctggacaaccaggataacccttcttacattggcctttcttttcaagatttttaccagcagtgtcgggaggcattcctcgtcaatagtgatctgacactccgggcccagttaactgaatttagggaccacaagcttataagaacaaagaagggaactgatggagtagagtatttattaattcctgttgataatggaacattgactgatttcttggaaaaggaagaagaggaggcttgaagctttcctttattcttgaatctcccatggaagggttgtaccccagctgccactcctctagttgaaagtgttgtgtttacatctgacattaaattatttttccagcatacaagatttaaatttgggaagggggggatgtcctcaattagaactttttgatcagcctggctggtaccgtctagtactatgcagcggtcctcaagttggagaaaatgtgcctttcattcattacctctctggagacttcttgctggaatgaacagtgtgctcagggactatttggaactggatgtttttgaattattttatacttagagatattctgaattttttgagggccttttaacactccccgagctgattgtttgcaagtgtgtttgttccagagtgtggaagtataaagacatgggcatcacgtaaattggttttgtttgctattctgtgtgtcagaaccaacgagtgtaatggagagggcaggtcatctcttattgtttctaaaacaacttaaaaggtgtagattgggaagaggtgagtgatccagctttctccttttggattgaggctatgtacttggtgggggcaggggagggaatatattataatactattcagttgggataatgggaaaaacagagtatatagggtatctacccagcctagaaagcacaggaacaatacgtcatatatttggaacagttattgtctgtgccatgaccttcatgataccagtgagaagccaggctagagaaataaaatcctgaattacattttagtaattgttttcaagacaacaaaaaataaaacatttcattattcttgtatattgacatatttttcttttcttgaacaacatgcaggtgagtagcatattaatggctggctgtaaattaattttgattcctctgtcaagtagacctaaaactcactgtaagatatttcagttttttccttaaagtgatgatttcaaacctcctgaatatttgcgcgagacttttttcttaggaaagaaaaaaggctcaccttggctactgttgtcagcttacagtcatcacataccccctgaaatatttgacacttggaaatgaagttcttcctgaaaatatcactgcaataaaatacgtactacgtcagcatttctcactcatttcttatcttgtaaacctctttcatgaaaatatttccaaaaatccttggaatttttaaataatttttcttgtggcatataattaagtaattttggccaggcataatggcttatgcctgtaatcacaacactttgggaggccaaggcaggaggatctctggagcccaggagtttaagaacagcctgggcaacatagtgagaccttgtctctacaaaaaatttaaaaaatcatccgggcatggtggcccatgcctatagtcctagctgctgtggaggctgaggcaggaggatcgcttgagcccaggggttcaagattacagtgagctatgattgtgccactgcacttcagtctgggtgcagagcaagaccttgtctttttttttttttaaatcatttttttaaaaagtaattttatgttaagtccatgggcttagtctttttttttttttttttttttttagatggaattgcactgtcatccagtctagagtgcagtggcgtgatctaagcttacagcagcctccacctcctgggttcaagtgattcttgtgcctcagcctcctgagctgggactacaggcacacgccaccacgcctggctagtttttgaatttttagcagagatggggtttcaccatgttggccaggctggtctcgaattcctgacctcaagtgatcctgcctcggcctcccaaagtactgggatcaggggtgagccactatgcctggccaagggcttagtcttaaatataacctctagtcaaaatgtttaaacaaatttgtacataaatgtgatttaaaaaaatttttttaatagtaccaaaggatattcagtgaaagtgagtttcctgcccactccctgatccacccagttctttaggcaaccactgatagcattttcttaagtattcttccagatatcgtctatgcatatgtaaaagtatctgtctttctccttttaaaaacacaattggtaatatatcatacttgctggtttgcaccttgctttttttgcttaatatatctagtttataatgacctaatgtgcaaatttttgcatctgccctaaatatctactggtttatttttataatttttgtgtctatactatttgcaagcagtatgtgtcagtagactttattattaataaataaaaagccaatttggatagaatcactttataaa

SEQ ID NO: 21156 - DNA, 546 bp, Homo sapiens
aagtcgcgcatctcaggactttccctcggcacttggggcatggtctttgcgcctcgctgccccccgcaggctgcccgggggctcgagaacccttactggtggagcgcagccaactggccagaggctggaggcgcaggccaaagtcctttaagacttgaggtgactgtatctgaattttgcagctgcagaatgtgtagtaccttaaaaggttggcaacaatgagtaaaccagaattaaaggaagacaagatgctggaggttcactttgtgggagatgatgatgttcttaatcacattctagatagagaaggaggagctaaattgaagaaggagcgagcgcagcttttggtcaaccccaaaaaaataataaagaagccagaatatgatttggaggaagatgaccaggaggtcttaaaagatcagaactatgtggaaattatgggaagagatgttcaagaatcattgaaaaatggctctgctacaggtggtggaaataaagtttattcttttcagaatagaaaacactctgaaaagatggctaaattag

SEQ ID NO: 21157 - DNA, 486 bp, Homo sapiens
agaggctggaggcgcaggccaaagtcctttaagacttgaggtgagaggctcactctgggaggacctttcgttagtctgccccgcagttataggccttttgtgcaagggacgcctgatactaacctacctgattcccagcttacgaagccctctggttggaaaaggagaactgtgaagatgtgtaacgacagtggtaaagtgccctgtgaggtgactgtatctgaattttgcagctgcagaatgtgtagtaccttaaaaggttggcaacaatgagtaaaccagaattaaaggaagacaagatgctggaggttcactttgtgggagatgatgatgttcttaatcacattctagatagagaaggaggagctaaattgaagaaggagcgagcgcagcttttggtcaaccccaaaaaaataataaagaagccagaatatgatttggaggaagatgaccaggaggtcttaaaagatcagaactatgtggaaa

SEQ ID NO: 21158 - DNA, 2501 bp, Homo sapiens
gagtgcatctggaatacgcagagtcagtaagaccatggctacgtcctcgatgtctaagggttgctttgtttttaagccaaactccaaaaagagaaagatctctctgccaatagaggactattttaacaaagggaaaaatgagcctgaggacagtaagcttcgattcgaaacttatcagttgatatggcagcagatgaaatctgaaaatgagcgactacaagaggaattaaataaaaacttgtttgacaatctgattgaatttctgcaaaaatcacattctggattccagaagaattcaagagacttgggcggtcaaataaaactcagagaaattccaactgctgctcttgttcttggtgtgaatgtcacagatcatgatttgacattcggaagtctaacagaggcccttcagaataatgtcacaccatatgtagtctcattgcaagctaaagattgtccagatatgaaacattttttgcaaaagttgatctcacagttgatggactgctgtgtagatataaaatccaaagaggaggaaagtgttcacgtcacccaaagaaagacacattattcaatggattcactttccagttggtatatgactgtcacacagaagacggacccaaaaatgctaagcaaaaaaaggactacttctagccaatggcagtctcctcctgttgtcgttatcttgaaggatatggaaagctttgccacaaaagtactacaagacttcataattatcagcagtcaacatctccatgaatttccactaatactcatttttggaatagccacatctcctattatcatccaccgattgcttcctcatgcagtatcatctctattgtgcatagaactgttccaatctttgtcttgtaaggagcacctgactacggtactcgataagctacttcttacaactcagtttccctttaaaataaatgaaaaagtattacaggttctgaccaacatctttttgtatcatgatttctcagttcaaaactttataaaaggacttcagctttctctattagagcatttctattcccagcccttaagtgtcctgtgctgtaatcttccagaagccaaaagaagaataaattttttatcaaataatcaatgtgaaaacatccgacgtctaccatcttttaggaggtacgtggaaaagcaagcttcagaaaagcaagttgcgctcttgaccaatgagagatatttgaaggaggaaacacaattattactagaaaacctgcatgtttatcatatgaattacttcctggttttgagatgtcttcataagttcacctcttctcttcccaagtatccactaggtcgacagatcagagagttgtactgtacatgtttagaaaagaacatatgggattcagaggagtatgcatcagtcttgcagctgctgaggatgttggcaaaggatgaactgatgaccatacttgagaaatgtttcaaggtttttaagtcttattgtgaaaaccaccttggcagcacagctaagagaatagaggagttcctggcccagtttcagagcctcgatgcagaaaccaaagaggaagaagatgcttctgggtcacagccaaaggggcttcagaagacagacctctatcatcttcagaagtccttattggaaatgaaggagttaagaagaagtaagaagcaaaccaaatttgaagtactcagagaaaatgttgtgaacttcattgactgtctagtgagagaataccttctgcctcctgagacacagcctctccatgaggtggtgtacttcagtgctgcccatgcccttcgtgagcatttaaatgctgctccgcgaattgccctccatactgcactcaacaatccttactattatctcaagaatgaagcactgaaaagcgaagaaggctgcattccgaatatcgccccagacatctgcatagcatacaaactgcacctagagtgtagcaggctcatcaacctcgtggactggtcagaggcttttgcaacagttgtgacagctgctgaaaaaatggatgcaaattctgcaacctcagaagaaatgaatgaaattatccatgctcggtttattagagctgtttctgaactagaacttttaggatttataaaacctaccaaacagaagactgaccatgtggcaagactaacatggggaggctgctagaaagcaaataagcaaagccagaactatcacatttagcttaagagaaaaaggtgaccagtcatatttacatatattagaggagcctgttttgttgagaagataaatgtgtaacccccattgatgtttaaccagaaaagtacattgctaaccccaaacaggcatgtatcaaaacacctgtggagtactttagactccaacaaataataatgtaactaaaactgctcacacattttactgtactttccaaagtcattactaaattgtgagtaaatcattcttgaacttagagtatgtaaatgtaataaattccgttatccaggagtataaa

SEQ ID NO: 21159 - DNA, 2512 bp, Homo sapiens
gcgcgggaaatcccgagtgcatctggaatacgcagagtcagtaagaccatggctacgtcctcgatgtctaagggttgctttgtttttaagccaaactccaaaaagagaaagatctctctgccaatagaggactattttaacaaagggaaaaatgagcctgaggacagtaagcttcgattcgaaacttatcagttgatatggcagcagatgaaatctgaaaatgagcgactacaagaggaattaaataaaaacttgtttgacaatctgattgaatttctgcaaaaatcacattctggattccagaagaattcaagagacttgggcggtcaaataaaactcagagaaattccaactgctgctcttgttcttggtgtgaatgtcacagatcatgatttgacattcggaagtctaacagaggcccttcagaataatgtcacaccatatgtagtctcattgcaagctaaagattgtccagatatgaaacattttttgcaaaagttgatctcacagttgatggactgctgtgtagatataaaatccaaagaggaggaaagtgttcacgtcacccaaagaaagacacattattcaatggattcactttccagttggtatatgactgtcacacagaagacggacccaaaaatgctaagcaaaaaaaggactacttctagccaatggcagtctcctcctgttgtcgttatcttgaaggatatggaaagctttgccacaaaagtactacaagacttcataattatcagcagtcaacatctccatgaatttccactaatactcatttttggaatagccacatctcctattatcatccaccgattgcttcctcatgcagtatcatctctattgtgcatagaactgttccaatctttgtcttgtaaggagcacctgactacggtactcgataagctacttcttacaactcagtttccctttaaaataaatgaaaaagtattacaggttctgaccaacatctttttgtatcatgatttctcagttcaaaactttataaaaggacttcagctttctctattagagcatttctattcccagcccttaagtgtcctgtgctgtaatcttccagaagccaaaagaagaataaattttttatcaaataatcaatgtgaaaacatccgacgtctaccatcttttaggaggtacgtggaaaagcaagcttcagaaaagcaagttgcgctcttgaccaatgagagatatttgaaggaggaaacacaattattactagaaaacctgcatgtttatcatatgaattacttcctggttttgagatgtcttcataagttcacctcttctcttcccaagtatccactaggtcgacagatcagagagttgtactgtacatgtttagaaaagaacatatgggattcagaggagtatgcatcagtcttgcagctgctgaggatgttggcaaaggatgaactgatgaccatacttgagaaatgtttcaaggtttttaagtcttattgtgaaaaccaccttggcagcacagctaagagaatagaggagttcctggcccagtttcagagcctcgatgaaaccaaagaggaagaagatgcttctgggtcacagccaaaggggcttcagaagacagacctctatcatcttcagaagtccttattggaaatgaaggagttaagaagaagtaagaagcaaaccaaatttgaagtactcagagaaaatgttgtgaacttcattgactgtctagtgagagaataccttctgcctcctgagacacagcctctccatgaggtggtgtacttcagtgctgcccatgcccttcgtgagcatttaaatgctgctccgcgaattgccctccatactgcactcaacaatccttactattatctcaagaatgaagcactgaaaagcgaagaaggctgcattccgaatatcgccccagacatctgcatagcatacaaactgcacctagagtgtagcaggctcatcaacctcgtggactggtcagaggcttttgcaacagttgtgacagctgctgaaaaaatggatgcaaattctgcaacctcagaagaaatgaatgaaattatccatgctcggtttattagagctgtttctgaactagaacttttaggatttataaaacctaccaaacagaagactgaccatgtggcaagactaacatggggaggctgctagaaagcaaataagcaaagccagaactatcacatttagcttaagagaaaaaggtgaccagtcatatttacatatattagaggagcctgttttgttgagaagataaatgtgtaacccccattgatgtttaaccagaaaagtacattgctaaccccaaacaggcatgtatcaaaacacctgtggagtactttagactccaacaaataataatgtaactaaaactgctcacacattttactgtactttccaaagtcattactaaattgtgagtaaatcattcttgaacttagagtatgtaaatgtaataaattccgttatccaggagtataaa

SEQ ID NO: 21160 - DNA, 2050 bp, Homo sapiens
ggaatacgcagagtcagtaagaccatggctacgtcctcgatgtctaagggttgctttgtttttaagccaaactccaaaaagagaaagatctctctgccaataggcattggtcaaagagataagaggacaccccagggctctaattgaaaagagaatccaattacaccttccaaagaggactattttaacaaagggaaaaatgagcctgaggacagtaagcttcgattcgaaacttatcagttgatatggcagcagatgaaatctgaaaatgagcgactacaagaggaattaaataaaaacttgtttgacaatctgattgaatttctgcaaaaatcacattctggattccagaagaattcaagagacttgggcggtcaaataaaactcagagaaattccaactgctgctcttgttcttggtgtgaatgtcacagatcatgatttgacattcggaagtctaacagaggcccttcagaataatgtcacaccatatgtagtctcattgcaagctaaagattgtccagatatgaaacattttttgcaaaagttgatctcacagttgatggactgctgtgtagatataaaatccaaagaggaggaaagtgttcacgtcacccaaagaaagacacattattcaatggattcactttccagttggtatatgactgtcacacagaagacggacccaaaaatgctaagcaaaaaaaggactacttctagccaatggcagtctcctcctgttgtcgttatcttgaaggatatggaaagctttgccacaaaagtactacaagacttcataattatcagcagtcaacatctccatgaatttccactaatactcatttttggaatagccacatctcctattatcatccaccgattgcttcctcatgcagtatcatctctattgtgcatagaactgttccaatctttgtcttgtaaggagcacctgactacggtactcgataagctacttcttacaactcagtttccctttaaaataaatgaaaaagtattacaggttctgaccaacatctttttgtatcatgatttctcagttcaaaactttataaaaggacttcagctttctctattagagcatttctattcccagcccttaagtgtcctgtgctgtaatcttccagaagccaaaagaagaataaattttttatcaaataatcaatgtgaaaacatccgacgtctaccatcttttaggaggtacgtggaaaagcaagcttcagaaaagcaagttgcgctcttgaccaatgagagatatttgaaggaggaaacacaattattactagaaaacctgcatgtttatcatatgaattacttcctggttttgagatgtcttcataagttcacctcttctcttcccaagtatccactaggtcgacagatcagagagttgtactgtacatgtttagaaaagaacatatgggattcagaggagtatgcatcagtcttgcagctgctgaggctaggtttggccttccttgatattcagttatttggagctcaaagtggacaagagctgttgctgcccctatcctgggaagctaatccttcacatgctgctaacttgggttagatcttctgccagcagaacctcacccgtctttcccctccaagcaagtcagtgccggtgattccttggacaccagaaatgctaatcttgtctatttgaataggcctaaaggatgttggcaaaggatgaactgatgaccatacttgagaaatgtttcaaggtttttaagtcttattgtgaaaaccaccttggcagcacagctaagagaatagaggagttcctggcccagtttcagagcctcgatgcagaaaccaaagaggaagaagatgcttctgggtcacagccaaaggggcttcagaagacagacctctatcatcttcagaagtccttattggaaatgaaggagttaagaagaagtaagaagcaaaccaaatttgaagtactcagagaaaatgttgtgaacttcattgactgtctagtgagagaataccttctgcctcctgagacacagcctctccatgag

SEQ ID NO: 21161 - DNA, 2106 bp, Homo sapiens
ctggaatacgcagagtcagtaagaccatggctacgtcctcgatgtctaagggttgctttgtttttaagccaaactccaaaaagagaaagatctctctgccaatagcgactacaagaggaattaaataaaaacttgtttgacaatctgattgaatttctgcaaaaatcacattctggattccagaagaattcaagagacttgggcggtcaaataaaactcagagaaattccaactgctgctcttgttcttggtgtgaatgtcacagatcatgatttgacattcggaagtctaacagaggcccttcagaataatgtcacaccatatgtagtctcattgcaagctaaagattgtccagatatgaaacattttttgcaaaagttgatctcacagttgatggactgctgtgtagatataaaatccaaagaggaggaaagtgttcacgtcacccaaagaaagacacattattcaatggattcactttccagttggtatatgactgtcacacagaagacggacccaaaaatgctaagcaaaaaaaggactacttctagccaatggcagtctcctcctgttgtcgttatcttgaaggatatggaaagctttgccacaaaagtactacaagacttcataattatcagcagtcaacatctccatgaatttccactaatactcatttttggaatagccacatctcctattatcatccaccgattgcttcctcatgcagtatcatctctattgtgcatagaactgttccaatctttgtcttgtaaggagcacctgactacggtactcgataagctacttcttacaactcagtttccctttaaaataaatgaaaaagtattacaggttctgaccaacatctttttgtatcatgatttctcagttcaaaactttataaaaggacttcagctttctctattagagcatttctattcccagcccttaagtgtcctgtgctgtaatcttccagaagccaaaagaagaataaattttttatcaaataatcaatgtgaaaacatccgacgtctaccatcttttaggaggtacgtggaaaagcaagcttcagaaaagcaagttgcgctcttgaccaatgagagatatttgaaggaggaaacacaattattactagaaaacctgcatgtttatcatatgaattacttcctggttttgagatgtcttcataagttcacctcttctcttcccaagtatccactaggtcgacagatcagagagttgtactgtacatgtttagaaaagaacatatgggattcagaggagtatgcatcagtcttgcagctgctgaggatgttggcaaaggatgaactgatgaccatacttgagaaatgtttcaaggtttttaagtcttattgtgaaaaccaccttggcagcacagctaagagaatagaggagttcctggcccagtttcagagcctcgatgaaaccaaagaggaagaagatgcttctgggtcacagccaaaggggcttcagaagacagacctctatcatcttcagaagtccttattggaaatgaaggagttaagaagaagtaagaagcaaaccaaatttgaagtactcagagaaaatgttgtgaacttcattgactgtctagtgagagaataccttctgcctcctgagacacagcctctccatgaggtggtgtacttcagtgctgcccatgcccttcgtgagcatttaaatgctgctccgcgaattgccctccatactgcactcaacaatccttactattatctcaagaatgaagcactgaaaagcgaagaaggctgcattccgaatatcgccccagacatctgcatagcatacaaactgcacctagagtgtagcaggctcatcaacctcgtggactggtcagaggcttttgcaacagttgtgacagctgctgaaaaaatggatgcaaattctgcaacctcagaagaaatgaatgaaattatccatgctcggtttattagagctgtttctgaactagaacttttaggatttataaaacctaccaaacagaagactgaccatgtggcaagactaacatggggaggctgctagaaagcaaataagcaaagccagaactatcacatttagcttaag

SEQ ID NO: 21162 - DNA, 2806 bp, Homo sapiens
gagctggggaagtggctgctcctgggtgtagtgagatgtctccagccagggccaagcagcagcagtagcagcagcagcagtagcagcagcagcagcaacagcagcagcagcagcaacagcagcagcaaagggatttgaatttgttgaaatgagcagtcgtaaatcaaagagtaacagcttaattcacacagagtgcctttcacaggtacaaagaattttacgtgaaagattttgtcgtcagagtccacatagtaacctatttggagtgcaagtacaatacaaacacttaagtgagctgctgaaaagaactgctctccatggagagagtaactctgtccttattatcggaccccgaggatcaggaaaaactatgttaataaatcatgctttgaaagaactcatggaaatagaagaagtgagtgaaaatgtattacaagttcacttaaatggactgctgcagatcaatgacaaaatcgccctaaaggaaatcacaaggcagttaaatctggaaaatgtagttggagataaagtttttggaagctttgctgaaaacctttcatttcttctggaagctttaaaaaaaggtgaccgaactagcagttgcccagtgatcttcatattagatgaatttgatctttttgctcatcataaaaaccaaacacttctctataatctttttgacatttctcagtctgcacagaccccaatagcagttattggtcttacatgtagattggatattttggaactcttagaaaaaagagtgaagtcaagattttctcaccggcagatacacttaatgaattcatttggttttccacagtatgttaaaatatttaaagaacagttatctctacctgcagagtttccagacaaggtttttgctgagaagtggaatgaaaatgttcagtatctctcagaagatagaagtgtgcaagaagtactacagaagcatttcaatatcagcaaaaacctgcggtcattacacatgctattgatgcttgctttaaatcgagtaacagcatcgcacccatttatgactgccgtagatctaatggaagcaagccaactgtgtagcatggactcgaaagcaaatattgtacatggtctatcagtcttggaaatctgtcttataatagcaatgaaacatttaaatgacatctatgaggaagagccatttaattttcaaatggtctataatgagtttcagaagtttgttcaaaggaaagcacattccgtttataattttgaaaaacctgttgtcatgaaggcttttgaacacttgcagcaattagaattaataaagcccatggaaagaacttcaggaaattcacagagagagtaccagctgatgaaactgcttttggataatactcaaattatgaatgctctgcagaaatatcccaactgtcctacagatgtgaggcagtgggcaacatcctcactaagctggttatgaatataaccagtgacttcaactttggcatttcattcatacttctgtagagaacggaaaactattgtccattaacatgatatgctaaacattctataaacattcttgtatttatgtgagacttgcccatctactgtcttggctgtgtcttgccttttaatcatgaacagttacatgatttataatttcactgattgagattactttgtaagtagctgttcagaagaataaaatatgactgttttagggactagaccatgtgcttttttaacacttatatatataatggtctatttgaagagctcacttcaacctaacagctagatgtctttacaaaccttaaaccaaaggagtaaaaaaaacaatggtaagcactgaagtataataagtaacctttggtacagcaggtttgctgcagtgtttttttctgtccacatgcaaattttggattctatcccagacccaggttttctagttcagaagactaaccagcttagtcagaagatggttccatggaagaaaaaggccaaggagtttgaagatttttcttctagacatctcaaaatgtggtactcataccatccacatcagaatcccttgtaggattttctaaaattacagattgttgagcctaccataggtcaaaaggactggaattttccttcttaacaagtatagtcatggcaccacgtaacattttggtcaatgacattgtataaagggtggtctcataagattataccatatttttactgtaccttttctatgtctaaatatacaaatgttttaccattgtgttacagttgcctacagtatgattacagtaacattctgtacagtgctatagctgaagagtaataggctaggctatctgtatagcctaagtgtgtaacaggctatatacatatcatcagggtctgtgtaagtatactctgtgatgttcatacagtgatgaaatcacccaaagacacatttctcagaacgtagccccatcatgaagtgacgtgactaccagagatttctggaaaagcactcccaaaagtaatgagatgtgtatggcaatgttaactgaacctgtttgtattaaaaagtaaatccctatgaggaatgtggaaatgtccgtcaaagcattgtcttttaagtaagttccaagatccatgaattaacagaggcatatatttaaaatgaaatttaatgagcacttagtgacttcatttgttcaagaatatttgatttcctattgtgtgcatgggaggtttacaaaagacagactgtccctatgcttgtgcagcttacaatctatttaactattagaggccctgtgagatgtaggcagttatttacagatga

SEQ ID NO: 21163 - DNA, 2517 bp, Homo sapiens
gtccgcagcggcaggtgaagtctagcagaggacgcggccaggcgattcggtgaagcgattcctgcaggcgttggttcccctctttgacctggatttgaatttgttgaaatgagcagtcgtaaatcaaagagtaacagcttaattcacacagagtgcctttcacaggtacaaagaattttacgtgaaagattttgtcgtcagagtccacatagtaacctatttggagtgcaagtacaatacaaacacttaagtgagctgctgaaaagaactgctctccatggagagagtaactctgtccttattatcggaccccgaggatcaggaaaaactatgttaataaatcatgctttgaaagaactcatggaaatagaagaagtgagtgaaaatgtattacaagttcacttaaatggactgctgcagatcaatgacaaaatcgccctaaaggaaatcacaaggcagttaaatctggaaaatgtagttggagataaagtttttggaagctttgctgaaaacctttcatttcttctggaagctttaaaaaaaggtgaccgaactagcagttgcccagtgatcttcatattagatgaatttgatctttttgctcatcataaaaaccaaacacttctctataatctttttgacatttctcagtctgcacagaccccaatagcagttattggtcttacatgtagattggatattttggaactcttagaaaaaagagtgaagtcaagattttctcaccggcagatacacttaatgaattcatttggttttccacagtatgttaaaatatttaaagaacagttatctctacctgcagagtttccagacaaggtttttgctgagaagtggaatgaaaatgttcagtatctctcagaagatagaagtgtgcaagaagtactacagaagcatttcaatatcagcaaaaacctgcggtcattacacatgctattgatgcttgctttaaatcgagtaacagcatcgcacccatttatgactgccgtagatctaatggaagcaagccaactgtgtagcatggactcgaaagcaaatattgtacatggtctatcagtcttggaaatctgtcttataatagcaatgaaacatttaaatgacatctatgaggaagagccatttaattttcaaatggtctataatgagtttcagaagtttgttcaaaggaaagcacattccgtttataattttgaaaaacctgttgtcatgaaggcttttgaacacttgcagcaattagaattaataaagcccatggaaagaacttcaggaaattcacagagagagtaccagctgatgaaactgcttttggataatactcaaattatgaatgctctgcagaaatatcccaactgtcctacagatgtgaggcagtgggcaacatcctcactaagctggttatgaatataaccagtgacttcaactttggcatttcattcatacttctgtagagaacggaaaactattgtccattaacatgatatgctaaacattctataaacattcttgtatttatgtgagacttgcccatctactgtcttggctgtgtcttgccttttaatcatgaacagttacatgatttataatttcactgattgagattactttgtaagtagctgttcagaagaataaaatatgactgttttagggactagaccatgtgcttttttaacacttatatatataatggtctatttgaagagctcacttcaacctaacagctagatgtctttacaaaccttaaaccaaaggagtaaaaaaaacaatggtaagcactgaagtataataagtaacctttggtacagcaggtttgctgcagtgtttttttctgtccacatgcaaattttggattctatcccagacccaggttttctagttcagaagactaaccagcttagtcagaagatggttccatggaagaaaaaggccaaggagtttgaagatttttcttctagacatctcaaaatgtggtactcataccatccacatcagaatcccttgtaggattttctaaaattacagattgttgagcctaccataggtcaaaaggactggaattttccttcttaacaagtatagtcatggcaccacgtaacattttggtcaatgacattgtataaagggtggtctcataagattataccatatttttactgtaccttttctatgtctaaatatacaaatgttttaccattgtgttacagttgcctacagtatgattacagtaacattctgtacagtgctatagctgaagagtaataggctaggctatctgtatagcctaagtgtgtaacaggctatatacatatcatcagggtctgtgtaagtatactctgtgatgttcatacagtgatgaaatcacccaaagacacatttctcagaacgtagccccatcatgaagtgacgtgactaccagagatttctggaaaagcactcccaaaagtaatgagatgtgtatggcaatgttaactgaacctgtttgtattaaaaagtaaatcccta

SEQ ID NO: 21164 - DNA, 2818 bp, Homo sapiens
ggggcatgccgggagtggttgtgtacggtccgcagcggcaggtgaagtctagcagaggacgcggccaggcgattcggtgaagcgattcctgcaggcgttggttcccctctttgacctggtaaatgcaggcttttatgcgagaggatttgaatttgttgaaatgagcagtcgtaaatcaaagagtaacagcttaattcacacagagtgcctttcacaggtacaaagaattttacgtgaaagattttgtcgtcagagtccacatagtaacctatttggagtgcaagtacaatacaaacacttaagtgagctgctgaaaagaactgctctccatggagagagtaactctgtccttattatcggaccccgaggatcaggaaaaactatgttaataaatcatgctttgaaagaactcatggaaatagaagaagtgagtgaaaatgtattacaagttcacttaaatggactgctgcagatcaatgacaaaatcgccctaaaggaaatcacaaggcagttaaatctggaaaatgtagttggagataaagtttttggaagctttgctgaaaacctttcatttcttctggaagctttaaaaaaaggtgaccgaactagcagttgcccagtgatcttcatattagatgaatttgatctttttgctcatcataaaaaccaaacacttctctataatctttttgacatttctcagtctgcacagaccccaatagcagttattggtcttacatgtagattggatattttggaactcttagaaaaaagagtgaagtcaagattttctcaccggcagatacacttaatgaattcatttggttttccacagtatgttaaaatatttaaagaacagttatctctacctgcagagtttccagacaaggtttttgctgagaagtggaatgaaaatgttcagtatctctcagaagatagaagtgtgcaagaagtactacagaagcatttcaatatcagcaaaaacctgcggtcattacacatgctattgatgcttgctttaaatcgagtaacagcatcgcacccatttatgactgccgtagatctaatggaagcaagccaactgtgtagcatggactcgaaagcaaatattgtacatggtctatcagtcttggaaatctgtcttataatagcaatgaaacatttaaatgacatctatgaggaagagccatttaattttcaaatggtctataatgagtttcagaagtttgttcaaaggaaagcacattccgtttataattttgaaaaacctgttgtcatgaaggcttttgaacacttgcagcaattagaattaataaagcccatggaaagaacttcaggaaattcacagagagagtaccagctgatgaaactgcttttggataatactcaaattatgaatgctctgcagaaatatcccaactgtcctacagatgtgaggcagtgggcaacatcctcactaagctggttatgaatataaccagtgacttcaactttggcatttcattcatacttctgtagagaacggaaaactattgtccattaacatgatatgctaaacattctataaacattcttgtatttatgtgagacttgcccatctactgtcttggctgtgtcttgccttttaatcatgaacagttacatgatttataatttcactgattgagattactttgtaagtagctgttcagaagaataaaatatgactgttttagggactagaccatgtgcttttttaacacttatatatataatggtctatttgaagagctcacttcaacctaacagctagatgtctttacaaaccttaaaccaaaggagtaaaaaaaacaatggtaagcactgaagtataataagtaacctttggtacagcaggtttgctgcagtgtttttttctgtccacatgcaaattttggattctatcccagacccaggttttctagttcagaagactaaccagcttagtcagaagatggttccatggaagaaaaaggccaaggagtttgaagatttttcttctagacatctcaaaatgtggtactcataccatccacatcagaatcccttgtaggattttctaaaattacagattgttgagcctaccataggtcaaaaggactggaattttccttcttaacaagtatagtcatggcaccacgtaacattttggtcaatgacattgtataaagggtggtctcataagattataccatatttttactgtaccttttctatgtctaaatatacaaatgttttaccattgtgttacagttgcctacagtatgattacagtaacattctgtacagtgctatagctgaagagtaataggctaggctatctgtatagcctaagtgtgtaacaggctatatacatatcatcagggtctgtgtaagtatactctgtgatgttcatacagtgatgaaatcacccaaagacacatttctcagaacgtagccccatcatgaagtgacgtgactaccagagatttctggaaaagcactcccaaaagtaatgagatgtgtatggcaatgttaactgaacctgtttgtattaaaaagtaaatccctatgaggaatgtggaaatgtccgtcaaagcattgtcttttaagtaagttccaagatccatgaattaacagaggcatatatttaaaatgaaatttaatgagcacttagtgacttcatttgttcaagaatatttgatttcctattgtgtgcatgggaggtttacaaaagacagactgtccctatgcttgtgcagcttacaatctatttaactattagaggccctgtgagatgtaggcagttatttacagatga

SEQ ID NO: 21165 - DNA, 571 bp, Homo sapiens
ggctgctcctgggtgtagtgagatgtctccagccagggccaagcagcagcagtagcagcagcagcagtagcagcagcagcagcaacagcagcagcagcagcaacagcagcagcaaagggatttgaatttgttgaaatgagcagtcgtaaatcaaagagtaacagcttaattcacacagagtgcctttcacaggtacaaagaattttacgtgaaagattttgtcgtcagagtccacatagtaacctatttggagtgcaagtacaatacaaacacttaagtgagctgctgaaaagaactgctctccatggagagagtaactctgtccttattatcggaccccgaggatcaggaaaaactatgttaataaatcatgctttgaaagaactcatggaaatagaagaagtgagtgaaaatgtattacaagttcacttaaatggactgctgcagatcaatgacaaaatcgccctaaaggaaatcacaaggcagttaaatctggaaaatgtagttggagataaagtttttggaagctttgctgaaaacctttcatttcttctggaagctttaaaaaaag

SEQ ID NO: 21166 - DNA, 552 bp, Homo sapiens
gtgcgtgcgcggggcatgccgggagtggttgtgtacggtccgcagcggcaggtgaagtctagcagaggacgcggccaggcgattcggtgaagcgattcctgcaggcgttggttcccctctttgacctggtaaatgcaggcttttatgcgagaggatttgaatttgttgaaatgagcagtcgtaaatcaaagagtaacagcttaattcacacagagtgcctttcacaggtacaaagaattttacgtgaaagattttgtcgtcagagtccacatagtaacctatttggagtgcaagtacaatacaaacacttaagtgagctgctgaaaagaactgctctccatggagagagtaactctgtccttattatcggaccccgaggatcaggaaaaactatgttaataaatcatgctttgaaagaactcatggaaatagaagaagtgagtgaaaatgtattacaagttcacttaaatggactgctgcagatcaatgacaaaatcgccctaaaggaaatcacaaggcagttaaatctggaaaatgtagttggagataaag

SEQ ID NO: 21167 - DNA, 647 bp, Homo sapiens
ggtccgcagcggcaggtgaagtctagcagaggacgcggccaggcgattcggtgaagcgattcctgcaggcgttggttcccctctttgacctggaagcctggagccagaggacttttggtggctgaggccttagctacctggcttacacattaaggaggacacagatttgcttgctgtctgtctgtcaaggcctggctcagctaaggacctgttaacatttctagagaagaaaacagcattaccatggatttgaatttgttgaaatgagcagtcgtaaatcaaagagtaacagcttaattcacacagagtgcctttcacaggtacaaagaattttacgtgaaagattttgtcgtcagagtccacatagtaacctatttggagtgcaagtacaatacaaacacttaagtgagctgctgaaaagaactgctctccatggagagagtaactctgtccttattatcggaccccgaggatcaggaaaaactatgttaataaatcatgctttgaaagaactcatggaaatagaagaagtgagtgaaaatgtattacaagttcacttaaatggactgctgcagatcaatgacaaaatcgccctaaaggaaatcacaaggcagttaaatctggaaaatgtagttggagataaagtt

SEQ ID NO: 21168 - DNA, 3091 bp, Homo sapiens
ggaagtcgctacgcttttaacacccccagctccctcctccttcctaagggaaagtggaggaacggaagtgggcgtggacggagacgaaaggaggtcacgtgtttgggcgggagaggggcggggtgggagaggtagtgcgtgcgcggggcatgccgggagtggttgtgtacggtccgcagcggcaggtgaagtctagcagaggacgcggccaggcgattcggtgaagcgattcctgcaggcgttggttcccctctttgacctggaagcctggagccagaggacttttggtggctgaggccttagctacctggcttacacattaaggaggacacagatttgcttgctgtctgtctgtcaaggcctggctcagctaaggacctgttaacatttctagagaagaaaacagcattaccatggatttgaatttgttgaaatgagcagtcgtaaatcaaagagtaacagcttaattcacacagagtgcctttcacaggtacaaagaattttacgtgaaagattttgtcgtcagagtccacatagtaacctatttggagtgcaagtacaatacaaacacttaagtgagctgctgaaaagaactgctctccatggagagagtaactctgtccttattatcggaccccgaggatcaggaaaaactatgttaataaatcatgctttgaaagaactcatggaaatagaagaagtgagtgaaaatgtattacaagttcacttaaatggactgctgcagatcaatgacaaaatcgccctaaaggaaatcacaaggcagttaaatctggaaaatgtagttggagataaagtttttggaagctttgctgaaaacctttcatttcttctggaagctttaaaaaaaggtgaccgaactagcagttgcccagtgatcttcatattagatgaatttgatctttttgctcatcataaaaaccaaacacttctctataatctttttgacatttctcagtctgcacagaccccaatagcagttattggtcttacatgtagattggatattttggaactcttagaaaaaagagtgaagtcaagattttctcaccggcagatacacttaatgaattcatttggttttccacagtatgttaaaatatttaaagaacagttatctctacctgcagagtttccagacaaggtttttgctgagaagtggaatgaaaatgttcagtatctctcagaagatagaagtgtgcaagaagtactacagaagcatttcaatatcagcaaaaacctgcggtcattacacatgctattgatgcttgctttaaatcgagtaacagcatcgcacccatttatgactgccgtagatctaatggaagcaagccaactgtgtagcatggactcgaaagcaaatattgtacatggtctatcagtcttggaaatctgtcttataatagcaatgaaacatttaaatgacatctatgaggaagagccatttaattttcaaatggtctataatgagtttcagaagtttgttcaaaggaaagcacattccgtttataattttgaaaaacctgttgtcatgaaggcttttgaacacttgcagcaattagaattaataaagcccatggaaagaacttcaggaaattcacagagagagtaccagctgatgaaactgcttttggataatactcaaattatgaatgctctgcagaaatatcccaactgtcctacagatgtgaggcagtgggcaacatcctcactaagctggttatgaatataaccagtgacttcaactttggcatttcattcatacttctgtagagaacggaaaactattgtccattaacatgatatgctaaacattctataaacattcttgtatttatgtgagacttgcccatctactgtcttggctgtgtcttgccttttaatcatgaacagttacatgatttataatttcactgattgagattactttgtaagtagctgttcagaagaataaaatatgactgttttagggactagaccatgtgcttttttaacacttatatatataatggtctatttgaagagctcacttcaacctaacagctagatgtctttacaaaccttaaaccaaaggagtaaaaaaaacaatggtaagcactgaagtataataagtaacctttggtacagcaggtttgctgcagtgtttttttctgtccacatgcaaattttggattctatcccagacccaggttttctagttcagaagactaaccagcttagtcagaagatggttccatggaagaaaaaggccaaggagtttgaagatttttcttctagacatctcaaaatgtggtactcataccatccacatcagaatcccttgtaggattttctaaaattacagattgttgagcctaccataggtcaaaaggactggaattttccttcttaacaagtatagtcatggcaccacgtaacattttggtcaatgacattgtataaagggtggtctcataagattataccatatttttactgtaccttttctatgtctaaatatacaaatgttttaccattgtgttacagttgcctacagtatgattacagtaacattctgtacagtgctatagctgaagagtaataggctaggctatctgtatagcctaagtgtgtaacaggctatatacatatcatcagggtctgtgtaagtatactctgtgatgttcatacagtgatgaaatcacccaaagacacatttctcagaacgtagccccatcatgaagtgacgtgactaccagagatttctggaaaagcactcccaaaagtaatgagatgtgtatggcaatgttaactgaacctgtttgtattaaaaagtaaatccctatgaggaatgtggaaatgtccgtcaaagcattgtcttttaagtaagttccaagatccatgaattaacagaggcatatatttaaaatgaaatttaatgagcacttagtgacttcatttgttcaagaatatttgatttcctattgtgtgcatgggaggtttacaaaagacagactgtccctatgcttgtgcagcttacaatctatttaactattagaggccctgtgagatgtaggcagttatttacagatga

SEQ ID NO: 21169 - DNA, 2695 bp, Homo sapiens
ggaagtcgctacgcttttaacacccccagctccctcctccttcctaagggaaagtggaggaacggaagtgggcgtggacggagacgaaaggaggtcacgtgtttgggcgggagaggggcggggtgggagaggtagtgcgtgcgcggggcatgccgggagtggttgtgtacggtccgcagcggcaggtgaagtctagcagaggacgcggccaggcgattcggtgaagcgattcctgcaggcgttggttcccctctttgacctgttaataaatcatgctttgaaagaactcatggaaatagaagaagtgagtgaaaatgtattacaagttcacttaaatggactgctgcagatcaatgacaaaatcgccctaaaggaaatcacaaggcagttaaatctggaaaatgtagttggagataaagtttttggaagctttgctgaaaacctttcatttcttctggaagctttaaaaaaaggtgaccgaactagcagttgcccagtgatcttcatattagatgaatttgatctttttgctcatcataaaaaccaaacacttctctataatctttttgacatttctcagtctgcacagaccccaatagcagttattggtcttacatgtagattggatattttggaactcttagaaaaaagagtgaagtcaagattttctcaccggcagatacacttaatgaattcatttggttttccacagtatgttaaaatatttaaagaacagttatctctacctgcagagtttccagacaaggtttttgctgagaagtggaatgaaaatgttcagtatctctcagaagatagaagtgtgcaagaagtactacagaagcatttcaatatcagcaaaaacctgcggtcattacacatgctattgatgcttgctttaaatcgagtaacagcatcgcacccatttatgactgccgtagatctaatggaagcaagccaactgtgtagcatggactcgaaagcaaatattgtacatggtctatcagtcttggaaatctgtcttataatagcaatgaaacatttaaatgacatctatgaggaagagccatttaattttcaaatggtctataatgagtttcagaagtttgttcaaaggaaagcacattccgtttataattttgaaaaacctgttgtcatgaaggcttttgaacacttgcagcaattagaattaataaagcccatggaaagaacttcaggaaattcacagagagagtaccagctgatgaaactgcttttggataatactcaaattatgaatgctctgcagaaatatcccaactgtcctacagatgtgaggcagtgggcaacatcctcactaagctggttatgaatataaccagtgacttcaactttggcatttcattcatacttctgtagagaacggaaaactattgtccattaacatgatatgctaaacattctataaacattcttgtatttatgtgagacttgcccatctactgtcttggctgtgtcttgccttttaatcatgaacagttacatgatttataatttcactgattgagattactttgtaagtagctgttcagaagaataaaatatgactgttttagggactagaccatgtgcttttttaacacttatatatataatggtctatttgaagagctcacttcaacctaacagctagatgtctttacaaaccttaaaccaaaggagtaaaaaaaacaatggtaagcactgaagtataataagtaacctttggtacagcaggtttgctgcagtgtttttttctgtccacatgcaaattttggattctatcccagacccaggttttctagttcagaagactaaccagcttagtcagaagatggttccatggaagaaaaaggccaaggagtttgaagatttttcttctagacatctcaaaatgtggtactcataccatccacatcagaatcccttgtaggattttctaaaattacagattgttgagcctaccataggtcaaaaggactggaattttccttcttaacaagtatagtcatggcaccacgtaacattttggtcaatgacattgtataaagggtggtctcataagattataccatatttttactgtaccttttctatgtctaaatatacaaatgttttaccattgtgttacagttgcctacagtatgattacagtaacattctgtacagtgctatagctgaagagtaataggctaggctatctgtatagcctaagtgtgtaacaggctatatacatatcatcagggtctgtgtaagtatactctgtgatgttcatacagtgatgaaatcacccaaagacacatttctcagaacgtagccccatcatgaagtgacgtgactaccagagatttctggaaaagcactcccaaaagtaatgagatgtgtatggcaatgttaactgaacctgtttgtattaaaaagtaaatccctatgaggaatgtggaaatgtccgtcaaagcattgtcttttaagtaagttccaagatccatgaattaacagaggcatatatttaaaatgaaatttaatgagcacttagtgacttcatttgttcaagaatatttgatttcctattgtgtgcatgggaggtttacaaaagacagactgtccctatgcttgtgcagcttacaatctatttaactattagaggccctgtgagatgtaggcagttatttacagatga

SEQ ID NO: 21170 - DNA, 2863 bp, Homo sapiens
ggaagtcgctacgcttttaacacccccagctccctcctccttcctaagggaaagtggaggaacggaagtgggcgtggacggagacgaaaggaggtcacgtgtttgggcgggagaggggcggggtgggagaggtagtgcgtgcgcggggcatgccgggagtggttgtgtacggtccgcagcggcaggtgaagtctagcagaggacgcggccaggcgattcggtgaagcgattcctgcaggcgttggttcccctctttgacctggtacaaagaattttacgtgaaagattttgtcgtcagagtccacatagtaacctatttggagtgcaagtacaatacaaacacttaagtgagctgctgaaaagaactgctctccatggagagagtaactctgtccttattatcggaccccgaggatcaggaaaaactatgttaataaatcatgctttgaaagaactcatggaaatagaagaagtgagtgaaaatgtattacaagttcacttaaatggactgctgcagatcaatgacaaaatcgccctaaaggaaatcacaaggcagttaaatctggaaaatgtagttggagataaagtttttggaagctttgctgaaaacctttcatttcttctggaagctttaaaaaaaggtgaccgaactagcagttgcccagtgatcttcatattagatgaatttgatctttttgctcatcataaaaaccaaacacttctctataatctttttgacatttctcagtctgcacagaccccaatagcagttattggtcttacatgtagattggatattttggaactcttagaaaaaagagtgaagtcaagattttctcaccggcagatacacttaatgaattcatttggttttccacagtatgttaaaatatttaaagaacagttatctctacctgcagagtttccagacaaggtttttgctgagaagtggaatgaaaatgttcagtatctctcagaagatagaagtgtgcaagaagtactacagaagcatttcaatatcagcaaaaacctgcggtcattacacatgctattgatgcttgctttaaatcgagtaacagcatcgcacccatttatgactgccgtagatctaatggaagcaagccaactgtgtagcatggactcgaaagcaaatattgtacatggtctatcagtcttggaaatctgtcttataatagcaatgaaacatttaaatgacatctatgaggaagagccatttaattttcaaatggtctataatgagtttcagaagtttgttcaaaggaaagcacattccgtttataattttgaaaaacctgttgtcatgaaggcttttgaacacttgcagcaattagaattaataaagcccatggaaagaacttcaggaaattcacagagagagtaccagctgatgaaactgcttttggataatactcaaattatgaatgctctgcagaaatatcccaactgtcctacagatgtgaggcagtgggcaacatcctcactaagctggttatgaatataaccagtgacttcaactttggcatttcattcatacttctgtagagaacggaaaactattgtccattaacatgatatgctaaacattctataaacattcttgtatttatgtgagacttgcccatctactgtcttggctgtgtcttgccttttaatcatgaacagttacatgatttataatttcactgattgagattactttgtaagtagctgttcagaagaataaaatatgactgttttagggactagaccatgtgcttttttaacacttatatatataatggtctatttgaagagctcacttcaacctaacagctagatgtctttacaaaccttaaaccaaaggagtaaaaaaaacaatggtaagcactgaagtataataagtaacctttggtacagcaggtttgctgcagtgtttttttctgtccacatgcaaattttggattctatcccagacccaggttttctagttcagaagactaaccagcttagtcagaagatggttccatggaagaaaaaggccaaggagtttgaagatttttcttctagacatctcaaaatgtggtactcataccatccacatcagaatcccttgtaggattttctaaaattacagattgttgagcctaccataggtcaaaaggactggaattttccttcttaacaagtatagtcatggcaccacgtaacattttggtcaatgacattgtataaagggtggtctcataagattataccatatttttactgtaccttttctatgtctaaatatacaaatgttttaccattgtgttacagttgcctacagtatgattacagtaacattctgtacagtgctatagctgaagagtaataggctaggctatctgtatagcctaagtgtgtaacaggctatatacatatcatcagggtctgtgtaagtatactctgtgatgttcatacagtgatgaaatcacccaaagacacatttctcagaacgtagccccatcatgaagtgacgtgactaccagagatttctggaaaagcactcccaaaagtaatgagatgtgtatggcaatgttaactgaacctgtttgtattaaaaagtaaatccctatgaggaatgtggaaatgtccgtcaaagcattgtcttttaagtaagttccaagatccatgaattaacagaggcatatatttaaaatgaaatttaatgagcacttagtgacttcatttgttcaagaatatttgatttcctattgtgtgcatgggaggtttacaaaagacagactgtccctatgcttgtgcagcttacaatctatttaactattagaggccctgtgagatgtaggcagttatttacagatga

SEQ ID NO: 21171 - DNA, 1441 bp, Homo sapiens
ggggcatgccgggagtggttgtgtacggtccgcagcggcaggtgaagtctagcagaggacgcggccaggcgattcggtgaagcgattcctgcaggcgttggttcccctctttgacctggatttgaatttgttgaaatgagcagtcgtaaatcaaagagtaacagcttaattcacacagagtgcctttcacaggtacaaagaattttacgtgaaagattttgtcgtcagagtccacatagtaacctatttggagtgcaagtacaatacaaacacttaagtgagctgctgaaaagaactgctctccatggagagagtaactctgtccttattatcggaccccgaggatcaggaaaaactatggactgctgcagatcaatgacaaaatcgccctaaaggaaatcacaaggcagttaaatctggaaaatgtagttggagataaagtttttggaagctttgctgaaaacctttcatttcttctggaagctttaaaaaaaggatattttggaactcttagaaaaaagagtgaagtcaagattttctcaccggcagatacacttaatgaattcatttggttttccacagtatgttaaaatatttaaagaacagttatctctacctgcagagtttccagacaaggtttttgctgagaagtggaatgaaaatgttcagtatctctcagaagatagaagtgtgcaagaagtactacagaagcatttcaatatcagcaaaaacctgcggtcattacacatgctattgatgcttgctttaaatcgagtaacagcatcgcacccatttatgactgccgtagatctaatggaagcaagccaactgtgtagcatggactcgaaagcaaatattgtacatggtctatcagtcttggaaatctgtcttataatagcaatgaaacatttaaatgacatctatgaggaagagccatttaattttcaaatggtctataatgagtttcagaagtttgttcaaaggaaagcacattccgtttataattttgaaaaacctgttgtcatgaaggcttttgaacacttgcagcaattagaattaataaagcccatggaaagaacttcaggaaattcacagagagagtaccagctgatgaaactgcttttggataatactcaaattatgaatgctctgcagaaatatcccaactgtcctacagatgtgaggcagtgggcaacatcctcactaagctggttatgaatataaccagtgacttcaactttggcatttcattcatacttctgtagagaacggaaaactattgtccattaacatgatatgctaaacattctataaacattcttgtatttatgtgagacttgcccatctactgtcttggctgtgtcttgccttttaatcatgaacagttacatgatttataatttcactgattgagattactttgtaagtagctgttcagaag

SEQ ID NO: 21172 - DNA, 1958 bp, Homo sapiens
agcccggcagcgcaggctcctcccacgacgctgcgggtccggtttccggcgggagcgtgggccgccagactcgggagaggctccgtcttgtgcaagggtcctgtgggctggctgcactggcctctgcggtggtgcctgccagaatgccccacttggaaaacgtggtgctttgtcgcgagtctcaagtgtccatcttgcagtccttgtttggagagagacatcatttcagctttccatccatttttatttatggacatactgctagtggaaagacctatgtaacacaaacgttgttgaaaactttagagctcccacatgtgtttgtgaattgtgttgaatgctttacattgaggctgcttttggaacaaattttaaacaaattgaatcatcttagttcttcagaggatggatgttctactgaaataacctgtgaaacatttaatgactttgttcgcttgtttaaacaagtaaccacagctgaaaatcttaaagatcagactgtatatattgttctagataaagcagagtatctaagagatatggaagcaaatcttttgcctggatttcttagattacaagaattggctgacagaaatgtgactgttctctttctcagtgaaattgtttgggaaaagtttcgtccaaatactggatgctttgagccgtttgtcttatatttccctgattacagcataggcaaccttcaaaagatcctgtcccatgatcatcctccagagtattcagctgatttctatgctgcctacattaacattcttcttggagttttctacactgtttgtcgagatttgaaagagctcagacatctggcagtacttaattttcctaaatattgtgaacccgtggttaaaggagaagcaagtgaacgtgatactcgcaaactgtggagaaatattgaacctcatttgaagaaagctatgcagactgtttatctcagggaaatatcaagttcccagtgggaaaagctacagaaagatgacacagatccggggcaactgaaaggcctctcagcgcatactcatgtggaacttccatattactctaagttcattctaattgctgcataccttgcttcatacaatccagcaagaactgacaagaggttttttcttaagcatcatggaaaaatcaagaaaaccaactttctaaaaaaacacgaaaagacaagcaatcatctccttgggccaaaaccatttccactagacagattattagcaatattatatagtatcgtggacagcagagttgctccaacagcaaatattttttcccagattacctctctagtgacccttcagctgttaaccctggttggccatgacgatcagcttgatggaccaaaatacaaatgcacagtgtctctagacttcatcagagctattgcaaggacggtgaactttgacataataaaatacttgtatgatttcttgtgaaaacaagcttcaaagccatatggacactgtgacaatgactaagccaagctgtgttcatccagctacttagctggccaaggagaggagttctttggctctattggatttgtccaaacaggtgctggcccagcatggaatctgatgaaaatattctgattggtctgggtggatgtgagcagaagactatttaccagggaccctggagtatttggaagcaacgtgttaattataaacagcagggtttgagcacaatctgttctactcttaatgatgttatcttaacactgaaattgcctgaaacccatttacttaggactacattttgctctgtgaactatcccctgcgctttgaacgtgccagcagcccttgtttatatgcccattcttttcacttcctctccacaggagcctctgcagtcgcttgccaaagcagattttcctaaggccactgttttaaaagatcatagttgcaaaatataataaatacaagttctttttaaaatccaa

SEQ ID NO: 21173 - DNA, 1409 bp, Homo sapiens
tgcaagggtcctgtgggctggctgcactggcctctgcggtggtgcctgccagaatgccccacttggaaaacgtggtgctttgtcgcgagtctcaagtgtccatcttgcagtccttgtttggagagagacatcatttcagctttccatccatttttatttatggacatactgctagtggaaagacctatgtaacacaaacgttgttgaaaactttagagctcccacatgtgtttgtgaattgtgttgaatgctttacattgaggctgcttttggaacaaattttaaacaaattgaatcatcttagttcttcagaggatggatgttctactgaaataacctgtgaaacatttaatgactttgttcgcttgtttaaacaagtaaccacagctgaaaatcttaaagatcagactgtatatattgttctagataaagcagagtatctaagagatatggaagcaaatcttttgcctggatttcttagattacaagaattggctgacagaaatgtgactgttctctttctcagtgaaattgtttgggaaaagtttcgtccaaatactggatgctttgagccgtttgtcttatatttccctgattacagcataggcaaccttcaaaagatcctgtcccatgatcatcctccagagtattcagctgatttctatgctgcctacattaacattcttcttggagttttctacactgtttgtcgagatttgaaagagctcagacatctggcagtacttaattttcctaaatattgtgaacccgtggttaaaggagaagcaagtgaacgtgatactcgcaaactgtggagaaatattgaacctcatttgaagaaagctatgcagactgtttatctcagggaaatatcaagttcccagtgggaaaagctacagaaagatgacacagatccggggcaactgaaaggtatcagaggaagtattgagacagttaccggagatacttcttcagctaattatcaagatactaaagttaatactaaagagcattcagtcaggaaatagtgttataaaagagaatttacttttcaagctataatgctattttgattaatgatttttctttaactgaagctctaatttaatgggaggaaataaaagtttgaataccagctttctattttctaaatattggattatatcatgaaaatcaagcagtttctatttctttaaatgcttttattaaagcaatctaattatgtgacagttttatctcattatgtttatatttcatgagttttatggaataaaatgtaattttatgttaatcggtttgggatatgcactttggtggttatgttttgaaaacattgtgcttttgtttaagaaaactactactttggattcatcccaaatattaaatagaactaattttacttaaaaaaa

SEQ ID NO: 21174 - DNA, 2043 bp, Homo sapiens
ggcgggagcgtgggccgccagactcgggagaggctccgtcttgtgcaagggtcctgtgggctggctgcactggcctctgcggtggtgcctgccagaatgccccacttggaaaacgtggtgctttgtcgcgagtctcaagtgtccatcttgcagtccttgtttggagagagacatcatttcagctttccatccatttttatttatggacatactgctagtggaaagacctatgtaacacaaacgttgttgaaaactttagagggactcagacaggcacttagaatatgctgcctttaaaagtcatggatggtacaaatgccgtaagcaagacactattcataacagagatgttgtggacttttgttcttaaaggacagtaaaggagtgagagagaactcccacatgtgtttgtgaattgtgttgaatgctttacattgaggctgcttttggaacaaattttaaacaaattgaatcatcttagttcttcagaggatggatgttctactgaaataacctgtgaaacatttaatgactttgttcgcttgtttaaacaagtaaccacagctgaaaatcttaaagatcagactgtatatattgttctagataaagcagagtatctaagagatatggaagcaaatcttttgcctggatttcttagattacaagaattggctgacagaaatgtgactgttctctttctcagtgaaattgtttgggaaaagtttcgtccaaatactggatgctttgagccgtttgtcttatatttccctgattacagcataggcaaccttcaaaagatcctgtcccatgatcatcctccagagtattcagctgatttctatgctgcctacattaacattcttcttggagttttctacactgtttgtcgagatttgaaagagctcagacatctggcagtacttaattttcctaaatattgtgaacccgtggttaaaggagaagcaagtgaacgtgatactcgcaaactgtggagaaatattgaacctcatttgaagaaagctatgcagactgtttatctcagggaaatatcaagttcccagtgggaaaagctacagaaagatgacacagatccggggcaactgaaaggcctctcagcgcatactcatgtggaacttccatattactctaagttcattctaattgctgcataccttgcttcatacaatccagcaagaactgacaagaggttttttcttaagcatcatggaaaaatcaagaaaaccaactttctaaaaaaacacgaaaagacaagcaatcatctccttgggccaaaaccatttccactagacagattattagcaatattatatagtatcgtggacagcagagttgctccaacagcaaatattttttcccagattacctctctagtgacccttcagctgttaaccctggttggccatgacgatcagcttgatggaccaaaatacaaatgcacagtgtctctagacttcatcagagctattgcaaggacggtgaactttgacataataaaatacttgtatgatttcttgtgaaaacaagcttcaaagccatatggacactgtgacaatgactaagccaagctgtgttcatccagctacttagctggccaaggagaggagttctttggctctattggatttgtccaaacaggtgctggcccagcatggaatctgatgaaaatattctgattggtctgggtggatgtgagcagaagactatttaccagggaccctggagtatttggaagcaacgtgttaattataaacagcagggtttgagcacaatctgttctactcttaatgatgttatcttaacactgaaattgcctgaaacccatttacttaggactacattttgctctgtgaactatcccctgcgctttgaacgtgccagcagcccttgtttatatgcccattcttttcacttcctctccacaggagcctctgcagtcgcttgccaaagcagattttcctaaggccactgttttaaaagatcatagttgcaaaatataataaatacaagttctttttaaaatcc

SEQ ID NO: 21175 - DNA, 1628 bp, Homo sapiens
gcgcgcgggtttcgttgacccgcggcgttcacgggaattgttcgctttagtgccggcgccatggggtcggagctgatcgggcgcctagccccgcgcctgggcctcgccgagcccgacatgctgaggaaagcagaggagtacttgcgcctgtcccgggtgaagtgtgtcggcctctccgcacgcaccacggagaccagcagtgcagtcatgtgcctggaccttgcagcttcctggatgaagtgccccttggacagggcttatttaattaaactttctggtttgaacaaggagacatatcagagctgtcttaaatcttttgagtgtttactgggcctgaattcaaatattggaataagagacctagctgtacagtttagctgtatagaagcagtgaacatggcttcaaagatactaaaaagctatgagtccagtcttccccagacacagcaagtggatcttgacttatccaggccacttttcacttctgctgcactgctttcagcatgcaagattctaaagctgaaagtggataaaaacaaaatggtagccacatccggtgtaaaaaaagctatatttgatcgactgtgtaaacaactagagaagattggacagcaggtcgacagagaacctggagatgtagctactccaccacggaagagaaagaagatagtggttgaagccccagcaaaggaaatggagaaggtagaggagatgccacataaaccacagaaagatgaagatctgacacaggattatgaagaatggaaaagaaaaattttggaaaatgctgccagtgctcaaaaggctacagcagagtgatttcagcttccaaactggtatacattccaaactgatagtacattgccatctccaggaagacttgacggctttgggattttgtttaaacttttataataaggatcctaagactgttgcctttaaatagcaaagcagcctacctggaggctaagtctgggcagtgggctggcccctggtgtgagcattagaccagccacagtgcctgattggtatagccttatgtgctttcctacaaaatggaattggaggccgggcgcagtggctcacgcctgtaatcccagcactttgggaggccaaggtgggtggatcacctgaggtcaggagctcgagaccagcctggccaacatggtgaaaccccatctctactaaaaatacaaaaattagccaggtgtgatggtgcatgcctgtaatcccagctcctcagtaggctgagacaggagcatcacttgaacgtgggaggcagaggttgcagtgagccgagattgcaccaccgcactccagcctgggtgacagagcgagacttatctcataaataaatagatagatactccagcctgggtgacagagcgagacttatagatagatagatagatagatggatagatagatagatagatagatagatagataaacggaattggagccattttgctttaagtgaatggcagtcccttgtcttattcagaatataaaattcagtctgaatggcatcttacagattttacttcaatttttgtgtacggtattttttatttgactaaatcaatatattgtacagcctaagttaataaatgttatttatatatgca

SEQ ID NO: 21176 - DNA, 2692 bp, Homo sapiens
attttaagcaattcttagtctcaagtaaacaccatcattaaaagaactgagaactattatcaattcttcctttggagtccatcttcaatggaaaggagaagggaaaaccttttttaaaaagaagaaagaaaactgaagtttttgatttgactagagaaatattcagaagactccttattttcacctagtttaatcacaaaattgagaaacaaacattatcccttgaccatgtaaattttacaccacattatgtcaacagcatgtaccttccacattgagtattcagaaagaagtgatctgaactctgaccattctttatggatacattaagtcaaatataagagtctgactacttgacacactggctcggtgagttctgctttttctttttaatataaatttattatgttggtaaatttagcttttggcttttcactttgctctcatgatataagaaaatgtaggttttctctttcagtttgaattttcctattcagtaaaacaacatgctagaaaacaaacttttggaaaggcattgtaactattttttcaaatagaaccataataacaagtcttgtcttaccctaaagtcaaatgctgaagattctttactgctgtcatcagcatctacaagtagcatattttggatggtgtttgtgtgctacttcaaagtaactaggaaaaaataatcctcgcaacacaggtaccttgtcatgtcagaattgggggtgttaggttgccagttgtatcagtgttgattcatttcattacttcctacagagcaaacatgaacgttggagttgcccacagtgaagtgaatccaaatacccgtgtcatgaacagccggggtatgtggctgacatatgcattgggagttggcttgcttcatattgtcttactcagcattcccttcttcagtgttcctgttgcttggactttaacaaatattatacataatctggggatgtacgtatttttgcatgcagtgaaaggaacacctttcgaaactcctgaccagggtaaagcaaggctcctaactcattgggaacaactggactatggagtacagtttacatcttcacggaagtttttcacaatttctccaataattctatattttctggcaagtttctatacgaagtatgatccaactcacttcatcctaaacacagcttctctcctgagtgtactaattcccaaaatgccacaactacatggtgttcggatctttggaattaataagtattgaaatgttttgaaactgaaaaaaaattttacagctactgaatttcttataaggaaggagtggttagtaaactgcactgtttctgtgataatgtgaaatgagaagtatttacattggagggccaatggctggtccttcaagtgctgttttgaagtgcagatttccattaaatgatgcctctgtttaatacacctggtacatttctgaagaggggctttataagcaggctgggcaggcccagcttataagttaaagggcatcacagtgagggtgtagtagataaattcaaggaaataagagatttgtaagaaactaggaccagcttaacttataatgaatgggcattgtgttaagaaaagaacatttccagtcattcagctgtggttatttaaagcagacttacatgtaaaccggaatcctctctatacaagtttattaaagattatttttattaccgtacatatttctcgttttatgtaagcggatgtatatcctcttgttttatacaagccagttcccacttatgagggtacttttttggttttgctggcttaatattgtgtattggtcaatgaggccatttttacatttattacgttacagagttcatggaggttcacctttgtgactgattggtgataaaagatagccaagtgtcttacaagcagcttctgagtcaagtgttctaattttggaacaaagcaggttttactgcttttccagacacaaggctgctaaaccaattaagaaaataattaatttctttcaagcaactaaaaaatatatggtaatttaaaggtgtctgcttatttggttgaacaatttaattgggaaagtttgtcatcatttgaaaaaggaaatataaaaggaacaaccatatagccaacctgtggtctggcagaaacaacgtctctagcaatagtaccaaagtaagtaatggagtcttttttttggcaggtctgcagtaaaagataacattttcttttcttagtcctcctgctctcaacccccatattttgcctttgaatacgtgggttttagtatatatagcccaaaatggtaactgtctccagaacagcaaccacattgaattcttgtgacttaggaaagcttcttatagttgctgacattaattgcaagaaataactatatactactttgagaagtaaacatgtcaaaaaaaacaaagttcagatatgggacaaaatttaaaaattcagtaacatttataaacagaattgaatgaaaagagttacagaccaacttaaacatcaattcgtgtcagtaaactgacttttgggggtaatgatcattgttttgtatctcaaaagtattgagtttagaaatcagttgtatgatactacctttgtatgtctgtcttttcccgtgtatttttaaataactggtgatctataatttaataaaatttttcgttggtgtaatatt

SEQ ID NO: 21177 - DNA, 1137 bp, Homo sapiens
agcttccgcaagctgcgcagcgccgggcctgagggcgtgtatccgcggccgtagcagccgggctggtcctgctgcgagccggcggcccggagtggggcggcggcatgtaccttccacattgagtattcagaaagaagtgatctgaactctgaccattctttatggatacattaagtcaaatataagagtctgactacttgacacactggctcgagcaaacatgaacgttggagttgcccacagtgaagtgaatccaaatacccgtgtcatgaacagccggggtatgtggctgacatatgcattgggagttggcttgcttcatattgtcttactcagcattcccttcttcagtgttcctgttgcttggactttaacaaatattatacataatctggggatgtacgtatttttgcatgcagtgaaaggaacacctttcgaaactcctgaccagggtaaagcaaggctcctaactcattgggaacaactggactatggagtacagtttacatcttcacggaagtttttcacaatttctccaataattctatattttctggcaagtttctatacgaagtatgatccaactcacttcatcctaaacacagcttctctcctgagtgtactaattcccaaaatgccacaactacatggtgttcggatctttggaattaataagtattgaaatgttttgaaactgaaaaaaaattttacagctactgaatttcttataaggaaggagtggttagtaaactgcactgtttctgtgataatgtgaaatgagaagtatttacattggagggccaatggctggtccttcaagtgctgttttgaagtgcagatttccattaaatgatgcctctgtttaatacacctggtacatttctgaagaggggctttataagcaggctgggcaggcccagcttataagttaaagggcatcacagtgagggtgtagtagataaattcaaggaaataagagatttgtaagaaactaggaccagcttaacttataatgaatgggcattgtgttaagaaaagaacatttccagtcattcagctgtggttatttaaagcagacttacatgtaaaccggaatcctctctatacaagtttattaaagattatttttattaccgt

SEQ ID NO: 21178 - DNA, 2009 bp, Homo sapiens
gcaagctgcgcagcgccgggcctgagggcgtgtatccgcggccgtagcagccgggctggtcctgctgcgagccggcggcccggagtggggcggcggagcaaacatgaacgttggagttgcccacagtgaagtgaatccaaatacccgtgtcatgaacagccggggtatgtggctgacatatgcattgggagttggcttgcttcatattgtcttactcagcattcccttcttcagtgttcctgttgcttggactttaacaaatattatacataatctggggatgtacgtatttttgcatgcagtgaaaggaacacctttcgaaactcctgaccagggtaaagcaaggctcctaactcattgggaacaactggactatggagtacagtttacatcttcacggaagtttttcacaatttctccaataattctatattttctggcaagtttctatacgaagtatgatccaactcacttcatcctaaacacagcttctctcctgagtgtactaattcccaaaatgccacaactacatggtgttcggatctttggaattaataagtattgaaatgttttgaaactgaaaaaaaattttacagctactgaatttcttataaggaaggagtggttagtaaactgcactgtttctgtgataatgtgaaatgagaagtatttacattggagggccaatggctggtccttcaagtgctgttttgaagtgcagatttccattaaatgatgcctctgtttaatacacctggtacatttctgaagaggggctttataagcaggctgggcaggcccagcttataagttaaagggcatcacagtgagggtgtagtagataaattcaaggaaataagagatttgtaagaaactaggaccagcttaacttataatgaatgggcattgtgttaagaaaagaacatttccagtcattcagctgtggttatttaaagcagacttacatgtaaaccggaatcctctctatacaagtttattaaagattatttttattaccgtacatatttctcgttttatgtaagcggatgtatatcctcttgttttatacaagccagttcccacttatgagggtacttttttggttttgctggcttaatattgtgtattggtcaatgaggccatttttacatttattacgttacagagttcatggaggttcacctttgtgactgattggtgataaaagatagccaagtgtcttacaagcagcttctgagtcaagtgttctaattttggaacaaagcaggttttactgcttttccagacacaaggctgctaaaccaattaagaaaataattaatttctttcaagcaactaaaaaatatatggtaatttaaaggtgtctgcttatttggttgaacaatttaattgggaaagtttgtcatcatttgaaaaaggaaatataaaaggaacaaccatatagccaacctgtggtctggcagaaacaacgtctctagcaatagtaccaaagtaagtaatggagtcttttttttggcaggtctgcagtaaaagataacattttcttttcttagtcctcctgctctcaacccccatattttgcctttgaatacgtgggttttagtatatatagcccaaaatggtaactgtctccagaacagcaaccacattgaattcttgtgacttaggaaagcttcttatagttgctgacattaattgcaagaaataactatatactactttgagaagtaaacatgtcaaaaaaaacaaagttcagatatgggacaaaatttaaaaattcagtaacatttataaacagaattgaatgaaaagagttacagaccaacttaaacatcaattcgtgtcagtaaactgacttttgggggtaatgatcattgttttgtatctcaaaagtattgagtttagaaatcagttgtatgatactacctttgtatgtctgtcttttcccgtgtatttttaaataactggtgatctataatttaataaaatttttcgttggtgtaatatta

SEQ ID NO: 21179 - DNA, 893 bp, Homo sapiens
tatgggtctctagagcggaaggagcattatactccggaaacatttgctggaaggggttatgagaaattcctctctgtatgctaactccgtaatacaagcgtttgtgtattttaaaatcacagctgttccaaatataatctagcctcgttttccccctccgtcggatgataggtgttcttcaggacagttttattttaagcaattcttagtctcaagtaaacaccatcattaaaagaactgagaactattatcaattcttcctttggagtccatcttcaatggaaaggagaagggaaaaccttttttaaaaagaagaaagaaaactgaagtttttgatttgactagagaaatattcagaagactccttattttcacctagtttaatcacaaaattgagaaacaaacattatcccttgaccatgtaaattttacaccacattatgtcaacagcatgtaccttccacattgagtattcagaaagaagtgatctgaactctgaccattctttatggatacattaagtcaaatataagagtctgactacttgacacactggctcgagcaaacatgaacgttggagttgcccacagtgaagtgaatccaaatacccgtgtcatgaacagccggggtatgtggctgacatatgcattgggagttggcttgcttcatattgtcttactcagcattcccttcttcagtgttcctgttgcttggactttaacaaatattatacataatctggggatgtacgtatttttgcatgcagtgaaaggaacacctttcgaaactcctgaccagggtaaagcaaggctcctaactcattgggaacaactggactatggagtacagtttacatcttcacggaagtttttcacaatttctccaataattct

SEQ ID NO: 21180 - DNA, 914 bp, Homo sapiens
cgcggccgtagcagccgggctggtcctgctgcgagccggcggcccggagtggggcggcggcatgtaccttccacattgagtattcagaaagaagtgatctgaactctgaccattctttatggatacattaagtcaaatataagagtctgactacttgacacactggctcggtgagttctgctttttctttttaatataaatttattatgttggtaaatttagcttttggcttttcactttgctctcatgatataagaaaatgtaggttttctctttcagtttgaattttcctattcagtaaaacaacatgctagaaaacaaacttttggaaaggcattgtaactattttttcaaatagaaccataataacaagtcttgtcttaccctaaagtcaaatgctgaagattctttactgctgtcatcagcatctacaagtagcatattttggatggtgtttgtgtgctacttcaaagtaactaggaaaaaataatcctcgcaacacaggtaccttgtcatgtcagaattgggggtgttaggttgccagttgtatcagtgttgattcatttcattacttcctacagagcaaacatgaacgttggagttgcccacagtgaagtgaatccaaatacccgtgtcatgaacagccggggtatgtggctgacatatgcattgggagttggcttgcttcatattgtcttactcagcattcccttcttcagtgttcctgttgcttggactttaacaaatattatacataatctggggatgtacgtatttttgcatgcagtgaaaggaacacctttcgaaactcctgaccagggtaaagcaaggctcctaactcattgggaacaactggactatggagtacagtttacatcttcacggaagtttttcacaatttctccaataattct

SEQ ID NO: 21181 - DNA, 2141 bp, Homo sapiens
actgtatcttgcgaacgacagaaatggcaaccaactgtgcttctgcattacagaccaccaaccaatgggtggtggcagcgctgattctgttcctccaataggaaaggggcagaaggagaggcgttacttcctggagacttcaggtgtggtagccggcgccgcgcccatagccggacggggatctgagctggcaggatgaatgtgggggtggcacacagcgaagtaaaccccaacacccgagtgatgaatagccgaggcatctggctggcctacatcatcttggtaggattgctgcatatggttctactcagcatccccttcttcagcattcctgttgtctggaccctgaccaacgtcatccataacctggctacgtatgtcttccttcatacggtgaaagggacaccctttgagactcctgaccaaggaaaggctcggctactgacacactgggagcaaatggactatgggctccagtttacctcttcccgcaagttcctcagcatctctcctattgtgctctatctcctggccagcttctataccaagtatgatgctgcgcacttcctcatcaacacagcctcattgctaagtgtactgctgccgaagttgccccagttccatggggttcgtgtctttggcatcaacaaatactgagggatgggttttgggacagctccatgggcatggggaaggcactgaaacagaggactataaaacatccttctcttattctccatactgtcttctacacctttaaagcctgagaactatacaacctttcccagactcccaagaagagaagagattggcaaatggggctcctgggcccagtcctgctagtggcaagtttctttgaatcaggaaggcaggtgaggtaagggccaaatcactctcctccatagcaggaagccatttgggcagcttctttggtgattacatctttccatatcttttacacttaccaccttccagctctgttttgctgtgtatttttcttacaataatttttttcagctatagctgcagtttaatcaggatgggtagagagctgtcctcataaggctgggggtgggaagatggaatactgacctaatgtataaaacttaaaacaattctccaatcccctctcctttggtccagtaggaggtgcccttcactctaagcttaacacttagtagggaagagattctcaaatgagaaaaagggctccggctatatgggcaacaaagagggaagatacaggttgccagttatacatttatagaaagataatcccctggctttaaatagtcatgtacatacaaatatgaacaaacttaaaaaaaaaatacaaacccttggatcacatgggggcttctgggaacccccgtattcttccccctcacccaagggcagtgggcatgaatctactttttaaaaatgattaattttggccatccttgcagaaaagagcctaaaattgggtgatttacccacaaagtgaaagtcgagggaaaattcagtttccagtctctgaactctatgcgataatctcctatcattagggctacatgctttcttgttctcttttaaatattatatcaggataaaggagagggctccctcctgaaatgggtcaagaaagaagatagacttgtagctttaaaagggtgggaaaaagtgtcatctgccctaaaagcaaatgacaagacaaaggcatacagaccccagggaaatacccagttcccacacctaaagggatacactgtccagcccaggtccaggccctaggttctttactctagctaccccctatttctttggtattgtcaaaagacaagattcaggccgggcacagtggcttatgcctgtaatccagcactttgggaggccaagacgggtggatcacctgagctcaggagttcgagaccagcctgggcaacatggtgaaaccccgtctctactaaaaatacaaaaaagaattagctgggccaggtgtggtggtgtgtgcctgtaatcccagctactcaggaggctgagatgggagaattgcttgaacccgggagacagaggttgcagtaagctgagatcacaccactgcactccagctgggcaacagagcaagactccatctcaaaaaataaaaagaaaaagattca

SEQ ID NO: 21182 - DNA, 671 bp, Homo sapiens
atcagctttagagctaccacaattttaaagatccgagttcagataatcactgctgcccctggagtcagagccaaggctccacctttcgaggatgaatgtgggggtggcacacagcgaagtaaaccccaacacccgagtgatgaatagccgaggcatctggctggcctacatcatcttggtaggattgctgcatatggttctactcagcatccccttcttcagcattcctgttgtctggaccctgaccaacgtcatccataacctggctacgtatgtcttccttcatacggtgaaagggacaccctttgagactcctgaccaaggaaaggctcggctactgacacactgggagcaaatggactatgggctccagtttacctcttcccgcaagttcctcagcatctctcctattgtgctctatctcctggccagcttctataccaagtatgatgctgcgcacttcctcatcaacacagcctcattgctaagtgtactgctgccgaagttgccccagttccatggggttcgtgtctttggcatcaacaaatactgagggatgggttttgggacagctccatgggcatggggaaggcactgaaacagaggactataaaacatccttctcttattctccatactgtcttctacacctttaaagcctgagaactata

SEQ ID NO: 21183 - DNA, 2111 bp, Homo sapiens
gattcggccggagctgccagcggggaggctgcagccgcgggttgttacagctgctggagcagcagcggcccccgctcccgggaaccgttcccgggccgttgatcttcggccccacacgaacagcagagaggggcagcaggatgaatgtgggcacagcgcacagcgaggtgaaccccaacacgcgggtgatgaacagccgtggcatctggctctcctacgtgctggccatcggtctcctccacatcgtgctgctgagcatcccgtttgtgagtgtccctgtcgtctggaccctcaccaacctcattcacaacatgggcatgtatatcttcctgcacacggtgaaggggacaccctttgagaccccggaccagggcaaggcgaggctgctaacccactgggagcagatggattatggggtccagttcacggcctctcggaagttcttgaccatcacacccatcgtgctgtacttcctcaccagcttctacactaagtacgaccagatccattttgtgctcaacaccgtgtccctgatgagcgtgcttatccccaagctgccccagctccacggagtccggatttttggaatcaataagtactgagagtgcagccccttcccctgcccagggtggcaggggaggggtagggtaaaaggcatgtgctgcaacactgaagacagaaagaagaagcctctggacactgccagagatgggggttgagcctctggcctaatttcccccctcgcttcccccagtagccaacttggagtagcttgtagtggggttggggtaggccccctgggctctgaccttttctgaattttttgatcttttccttttgctttttgaatagagactccatggagttggtcatggaatgggctgggctcctgggctgaacatggaccacgcagttgcgacaggaggccaggggaaaaacccctgctcacttgtttgccctcaggcagccaaagcactttaacccctgcatagggagcagagggcggtacggcttctggattgtttcactgtgattcctaggttttttcgatgccacgcagtgtgtgcttttgtgtatggaagcaagtgtgggatgggtctttgcctttctgggtagggagctgtctaatccaagtcccaggcttttggcagcttctctgcaacccaccgtgggtcctggttgggagtggggagggtcaggttggggaaagatggggtagagtgtagatggcttggttccagaggtgagggggccagggctgctgccatcctggcctggtggaggttggggagctgtaggagagctagtgagtcgagacttagaagaatggggccacatagcagcagaggactggtgtaagggagggaggggtagggacagaagctagacccaatctcctttgggatgtgggcagggagggaagcaggcttggagggttaatttacccacagaatgtgatagtaataggggagggaggctgctgtgggtttaactcctgggttggctgttgggtagacaggtggggaaaaggcccgtgagtcattgtaagcacaggtccaacttggccctgactcctgcgggggtatggggaagctgtgacagaaacgatgggtgctgtggtcctctgcaggccctcaccccttaacttcctcatacagactggcactgggcagggcctctcatgtggcagccacatgtggcgttgtgaggccaccccatgtggggtctgtggtgagagtcctgtaggatccctgctcaagcagcacagaggaaggggcaagacgtggcctgtaggcactgtctcagcctgcagagaagaaagtgaggccgggagcctgagcctgggctggagccttctcccctccccagttggactaggggcagtgttaattttgaaaaggtgtgggtccctgtgtcctcttccaggggtccaagggaacgggagaggtcactgggcctgttttctccctcctgaccctgcatctcccaccccgtgtatcatagggaactttcaccttaaaatctttctaagcaaagtgtgaataggatttttactccctttgtacagtattctgagaaacgcaaataaaagggcaacatgtttctgtttc

SEQ ID NO: 21184 - DNA, 2230 bp, Homo sapiens
gtgctcctcttccagaagacaggaggtttgctgttgtgagggctgctctttcctgggggagggaatgggaagggctcacctggtggctgccctggtggtgctcagccttggcttgagtgtctggcatactggctgggcccggatatttgtatgtggagccaagagggtggggcgggaaggagggggaaagagctaccagcaaaaaagtggttaacacaacagagttgctgcaggctctggtttgaggcaggttatgaaaccacatcagggcccagcactaagcagccacctgccagctatggcagcagaagttttcggctcaactcctgtagacctagtcgacctctgccagcctcttctctctgtttctccccatctagggtaggggccagttggttgttttactaatggaagtgatatgtatccatagtcacacgaaagtctcaagagtgtttcctcattgccagtctttttgttagtttattgatctcttctttttcaggggtctctggtggtttcctgctctcagggcacctagtgtttaggcttcaggaagaagcttctgagggtgttggctaggacctaggtctaggcttttcctaggctcatcaagttttgttggctgccctgtgaaagccagaaaggcgtatggggtcctgtgatctgggattccccaaggcttttggcactcctggacaaatactaggaagggttagtggactttctataccagcacccctgtaggtgcgggttacagagaggtgatggggtggcagtttcaggtcagacttgggaagctctttccctctccttagtcagagttaagtccttcagagccctcacttgtcagccacatgccgccctcccctctcaggtggaggcttttgcgtagcagctgtcccaggggctgctagagtaactgaagccccaaggccctgggaagataaacaatctgagccagctctggctttctagatacttgaatttctgttaggctcaattatccagcctagtgggctgcgctgatgggtcccaggagcatctcttcaatcagaatgcgccccaggctggcgcacgggtgtttgcttgttgggatggcgtgttgtgggtcacattttctctgaggtctctaagcttggagctgtctgagaagaggaaacttgctcctgttatcctggaagtaaataactggcccctgaggactcagtctcctgtgcagggccctcagggatctggggacagccaaactctggataaggggcagatcattccaccccttccttctctacttccctctgctcactgtgggttgcggccacctcctggttcctcctgctgcaggactcctaccgttggtgctgggcaggggaaggcatggtgctaatatacacctggaaacaggtgctgagaggggagactgagtcctcctaagttggggtttggggagatccagaattgaaaaaatcagaggagaacagcagagaggggcagcaggatgaatgtgggcacagcgcacagcgaggtgaaccccaacacgcgggtgatgaacagccgtggcatctggctctcctacgtgctggccatcggtctcctccacatcgtgctgctgagcatcccgtttgtgagtgtccctgtcgtctggaccctcaccaacctcattcacaacatgggcatgtatatcttcctgcacacggtgaaggggacaccctttgagaccccggaccagggcaaggcgaggctgctaacccactgggagcagatggattatggggtccagttcacggcctctcggaagttcttgaccatcacacccatcgtgctgtacttcctcaccagcttctacactaagtacgaccagatccattttgtgctcaacaccgtgtccctgatgagcgtgcttatccccaagctgccccagctccacggagtccggatttttggaatcaataagtactgagagtgcagccccttcccctgcccagggtggcaggggaggggtagggtaaaaggcatgtgctgcaacactgaagacagaaagaagaagcctctggacactgccagagatgggggttgagcctctggcctaatttcccccctcgcttcccccagtagccaacttggagtagcttgtagtggggttggggtaggccccctgggctctgaccttttctgaattttttgatcttttccttttgctttttgaatagagactccatggagttggtcatgg

SEQ ID NO: 21185 - DNA, 2048 bp, Homo sapiens
ctccggcgtcactgttgcgcttcatagacgccgcgtgtacccggttgtcctcaggcgctgtcagatctgtggtttttctacttgaaggacacaatgttttccaaactagcacatttgcagaggtttgctgtacttagtcgcggagttcattcttcagtggcttctgctacatctgttgcaactaaaaaaacagtccaaggccctccaacctctgatgacatttttgaaagggaatataagtatggtgcacacaactaccatcctttacctgtagccctggagagaggaaaaggtatttacttatgggatgtagaaggcagaaaatattttgacttcctgagttcttacagtgctgtcaaccaagggcattgtcaccccaagattgtgaatgctctgaagagtcaagtggacaaattgaccttaacatctagagctttctataataacgtacttggtgaatatgaggagtatattactaaacttttcaactaccacaaagttcttcctatgaatacaggagtggaggctggagagactgcctgtaaactagctcgtaagtggggctataccgtgaagggcattcagaaatacaaagcaaagattgtttttgcagctgggaacttctggggtaggacgttgtctgctatctccagttccacagacccaaccagttacgatggttttggaccatttatgccgggattcgacatcattccctataatgatctgcccgcactggagcgtgctcttcaggatccaaatgtggctgcgttcatggtagaaccaattcagggtgaagcaggcgttgttgttccggatccaggttacctaatgggagtgcgagagctctgcaccaggcaccaggttctctttattgctgatgaaatacagacaggattggccagaactggtagatggctggctgttgattatgaaaatgtcagacctgatatagtcctccttggaaaggccctttctgggggcttataccctgtgtctgcagtgctgtgtgatgatgacatcatgctgaccattaagccaggggagcatgggtccacatacggtggcaatccactaggctgccgagtggccatcgcagcccttgaggttttagaagaagaaaaccttgctgaaaatgcagacaaattgggcattatcttgagaaatgaactcatgaagctaccttctgatgttgtaactgccgtaagaggaaaaggattattaaacgctattgtcattaaagaaaccaaagattgggatgcttggaaggtgtgtctacgacttcgagataatggacttctggccaagccaacccatggcgacattatcaggtttgcgcctccgctggtgatcaaggaggatgagcttcgagagtccattgaaattattaacaagaccatcttgtctttctgagggtagccagctgttttcagtggtccctgggagccagctggagacaggtggtcctgtaaaagctttattcctaatgtgggcacattccactcccatgagtcttcaaaaactttttttttgaatatatttttttcagttgatacataatagaacaacgtttatgaacctgccgtttgctttgtaacgtaactaaataatgtaatggcatctatattcagttgaagtgttttgatgtgcatgtgtacttcctaaggtgaaatgcatctatatacagacagcctctaaatcaagtccttcagtataattgatatatgtttttataatttcctcactggtataagtgtttcatatttgaaaaagttatctctgggtattgcataaaaggcttcatcttataaagtgaaatcattgttattgaattttaggaaggattaatggttaagtgtatataaaatactaatattaagtaaacttcatattggccaacaccagggttgtattctatggatgtcattattttgaattaagaattagtgtttaacattcctaaattgttttgagtgcttgattataatttgtaaaaaatgtttattttcaatacttctttaaatttaaaataaagcttatatttcaaa

SEQ ID NO: 21186 - DNA, 1864 bp, Homo sapiens
ttgggggcggggcagaatcagcctttaagttgcagtgactctccggcgtcactgttgcgcttcatagacgccgcgtgtacccggttgtcctcaggcgctgtcaggtatttacttatgggatgtagaaggcagaaaatattttgacttcctgagttcttacagtgctgtcaaccaagggcattgtcaccccaagattgtgaatgctctgaagagtcaagtggacaaattgaccttaacatctagagctttctataataacgtacttggtgaatatgaggagtatattactaaacttttcaactaccacaaagttcttcctatgaatacaggagtggaggctggagagactgcctgtaaactagctcgtaagtggggctataccgtgaagggcattcagaaatacaaagcaaagattgtttttgcagctgggaacttctggggtaggacgttgtctgctatctccagttccacagacccaaccagttacgatggttttggaccatttatgccgggattcgacatcattccctataatgatctgcccgcactggagcgtgctcttcaggatccaaatgtggctgcgttcatggtagaaccaattcagggtgaagcaggcgttgttgttccggatccaggttacctaatgggagtgcgagagctctgcaccaggcaccaggttctctttattgctgatgaaatacagacaggattggccagaactggtagatggctggctgttgattatgaaaatgtcagacctgatatagtcctccttggaaaggccctttctgggggcttataccctgtgtctgcagtgctgtgtgatgatgacatcatgctgaccattaagccaggggagcatgggtccacatacggtggcaatccactaggctgccgagtggccatcgcagcccttgaggttttagaagaagaaaaccttgctgaaaatgcagacaaattgggcattatcttgagaaatgaactcatgaagctaccttctgatgttgtaactgccgtaagaggaaaaggattattaaacgctattgtcattaaagaaaccaaagattgggatgcttggaaggtgtgtctacgacttcgagataatggacttctggccaagccaacccatggcgacattatcaggtttgcgcctccgctggtgatcaaggaggatgagcttcgagagtccattgaaattattaacaagaccatcttgtctttctgagggtagccagctgttttcagtggtccctgggagccagctggagacaggtggtcctgtaaaagctttattcctaatgtgggcacattccactcccatgagtcttcaaaaactttttttttgaatatatttttttcagttgatacataatagaacaacgtttatgaacctgccgtttgctttgtaacgtaactaaataatgtaatggcatctatattcagttgaagtgttttgatgtgcatgtgtacttcctaaggtgaaatgcatctatatacagacagcctctaaatcaagtccttcagtataattgatatatgtttttataatttcctcactggtataagtgtttcatatttgaaaaagttatctctgggtattgcataaaaggcttcatcttataaagtgaaatcattgttattgaattttaggaaggattaatggttaagtgtatataaaatactaatattaagtaaacttcatattggccaacaccagggttgtattctatggatgtcattattttgaattaagaattagtgtttaacattcctaaattgttttgagtgcttgattataatttgtaaaaaatgtttattttcaatacttctttaaatttaaaataaagcttatatttcaaatgtc

SEQ ID NO: 21187 - DNA, 2653 bp, Homo sapiens
gacgtcggcccgccggcgccccaccagctccgcgcgggcccgggttggccaccgccgggcccccgcccctcccccggcggtgtcccggccggaaccgatcgtggctggtttgagctggtgcgtctccatggcgacccgccggtgctataagtagggagcggcgtgccgtggggctttgtcagtccctcctgtagccgccgccgccgccgcccgccgcccctctgccagcagctccggcgccacctcgggccggcgtctccggcgggcgggagccaggcgctgacgggcgcggcgggggcggccgagcgctcctgcggctgcgactcaggctccggcgtctgcgcttccccatggggctggcctgcggcgcctgggcgctctgagattgtcactgctgttccaagggcacacgcagagggatttggaattcctggagagttgcctttgtgagaagctggaaatatttctttcaattccatctcttagttttccataggaacatcaagaaatcatgaacaactttggtaatgaagagtttgactgccacttcctcgatgaaggttttactgccaaggacattctggaccagaaaattaatgaagtttcttcttctgatgataaggatgccttctatgtggcagacctgggagacattctaaagaaacatctgaggtggttaaaagctctccctcgtgtcacccccttttatgcagtcaaatgtaatgatagcaaagccatcgtgaagacccttgctgctaccgggacaggatttgactgtgctagcaagactgaaatacagttggtgcagagtctgggggtgcctccagagaggattatctatgcaaatccttgtaaacaagtatctcaaattaagtatgctgctaataatggagtccagatgatgacttttgatagtgaagttgagttgatgaaagttgccagagcacatcccaaagcaaagttggttttgcggattgccactgatgattccaaagcagtctgtcgtctcagtgtgaaattcggtgccacgctcagaaccagcaggctccttttggaacgggcgaaagagctaaatatcgatgttgttggtgtcagcttccatgtaggaagcggctgtaccgatcctgagaccttcgtgcaggcaatctctgatgcccgctgtgtttttgacatgggggctgaggttggtttcagcatgtatctgcttgatattggcggtggctttcctggatctgaggatgtgaaacttaaatttgaagagatcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatgacgaagatgagtcgagtgagcagacctttatgtattatgtgaatgatggcgtctatggatcatttaattgcatactctatgaccacgcacatgtaaagccccttctgcaaaagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggcaactcatgcagcaattccagaaccccgacttcccacccgaagtagaggaacaggatgccagcaccctgcctgtgtcttgtgcctgggagagtgggatgaaacgccacagagcagcctgtgcttcggctagtattaatgtgtagatagcactctggtagctgttaactgcaagtttagcttgaattaagggatttggggggaccatgtaacttaattactgctagttttgaaatgtctttgtaagagtagggtcgccatgatgcagccatatggaagactaggatatgggtcacacttatctgtgttcctatggaaactatttgaatatttgttttatatggatttttattcactcttcagacacgctactcaagagtgcccctcagctgctgaacaagcatttgtagcttgtacaatggcagaatgggccaaaagcttagtgttgtgacctgtttttaaaataaagtatcttgaaataattaggcattgggacgtttttatggtgtgttcattccagacagttcacgaatcccgtatagctcgctctgattctcagagaacaatgagtgggtccacccacacacaggtaggaggacaggtgagacggaagccccatcctcccatgtggacggtgcacatctgctcagcccaccccacatgtccagagttggctgcaaactccttgtccagagcctctggtggtgggacctacttaagtctgacggacctgtcctgtccaggccagtgcccagggaaggtgtgggaggccctttgagcctggcctgcagagaccatccgtgtcccctcccaccttcatgcctgtgagaagttaggaatgtatacggtaccacatttggcagtcagcttattttaataaattcagcaacagcaagtcccta

SEQ ID NO: 21188 - DNA, 1943 bp, Homo sapiens
cctggcggccgcgcagcaggtgcaggggcgcagagcccgggctcgccttggtacagacgagcgggccccggccttggcgccttcagtttccttccagtttttattttcgctgtgtctacagagcagatgacaccaatttggaaacccgcgagagtgggtagagctaagatagtcttgctgtagtagctgtgatattagatgctcggccatgacttagaggtgtttatttaaggactgtgaatgactcggtgatttcggaaaagcttggcttagatgaacggacatacacaggggagacagccctaagattgtcactgctgttccaagggcacacgcagagggatttggaattcctggagagttgcctttgtgagaagctggaaatatttctttcaattccatctcttagttttccataggaacatcaagaaatcatgaacaactttggtaatgaagagtttgactgccacttcctcgatgaaggttttactgccaaggacattctggaccagaaaattaatgaagtttcttcttctgatgataaggatgccttctatgtggcagacctgggagacattctaaagaaacatctgaggtggttaaaagctctccctcgtgtcacccccttttatgcagtcaaatgtaatgatagcaaagccatcgtgaagacccttgctgctaccgggacaggatttgactgtgctagcaagactgaaatacagttggtgcagagtctgggggtgcctccagagaggattatctatgcaaatccttgtaaacaagtatctcaaattaagtatgctgctaataatggagtccagatgatgacttttgatagtgaagttgagttgatgaaagttgccagagcacatcccaaagcaaagttggttttgcggattgccactgatgattccaaagcagtctgtcgtctcagtgtgaaattcggtgccacgctcagaaccagcaggctccttttggaacgggcgaaagagctaaatatcgatgttgttggtgtcagcttccatgtaggaagcggctgtaccgatcctgagaccttcgtgcaggcaatctctgatgcccgctgtgtttttgacatgggggctgaggttggtttcagcatgtatctgcttgatattggcggtggctttcctggatctgaggatgtgaaacttaaatttgaagagatcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatgacgaagatgagtcgagtgagcagacctttatgtattatgtgaatgatggcgtctatggatcatttaattgcatactctatgaccacgcacatgtaaagccccttctgcaaaagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggcaactcatgcagcaattccagaaccccgacttcccacccgaagtagaggaacaggatgccagcaccctgcctgtgtcttgtgcctgggagagtgggatgaaacgccacagagcagcctgtgcttcggctagtattaatgtgtagatagcactctggtagctgttaactgcaagtttagcttgaattaagggatttggggggaccatgtaacttaattactgctagttttgaaatgtctttgtaagagtagggtcgccatgatgcagc

SEQ ID NO: 21189 - DNA, 494 bp, Homo sapiens
ggggaggccctggcggccgcgcagcaggtgcaggggcgcagagcccgggctcgccttggtacagacgagcgggccccggccttggcgccttcagtttccttccagtttttattttcgctgtgtctacagagcagatgacaccaatttggaaacccgcgagaattgtcactgctgttccaagggcacacgcagagggatttggaattcctggagagttgcctttgtgagaagctggaaatatttctttcaattccatctcttagttttccataggaacatcaagaaatcatgaacaactttggtaatgaagagtttgactgccacttcctcgatgaaggttttactgccaaggacattctggaccagaaaattaatgaagtttcttcttctgatgataaggatgccttctatgtggcagacctgggagacattctaaagaaacatctgaggtggttaaaagctctccctcgtgtcacccccttttatgcagtcaa

SEQ ID NO: 21190 - DNA, 1548 bp, Homo sapiens
gtcagtccctcctgtagccgccgccgccgccgcccgccgcccctctgccagcagctccggcgccacctcgggccggcgtctccggcgggcgggagccaggcgctgacgggcgcggcgggggcggccgagcgctcctgcggctgcgactcaggctccggcgtctgcgcttccccatggggctggcctgcggcgcctgggcgctctgagattgtcactgctgttccaagggcacacgcagagggatttggaattcctggagagttgcctttgtgagaagctggaaatatttctttcaattccatctcttagttttccataggaacatcaagaaatcatgaacaactttggtaatgaagagtttgactgccacttcctcgatgaaggttttactgccaaggacattctggaccagaaaattaatgaagtttcttcttcttcaaatgtaatgatagcaaagccatcgtgaagacccttgctgctaccgggacaggatttgactgtgctagcaagactgaaatacagttggtgcagagtctgggggtgcctccagagaggattatctatgcaaatccttgtaaacaagtatctcaaattaagtatgctgctaataatggagtccagatgatgacttttgatagtgaagttgagttgatgaaagttgccagagcacatcccaaagcaaagttggttttgcggattgccactgatgattccaaagcagtctgtcgtctcagtgtgaaattcggtgccacgctcagaaccagcaggctccttttggaacgggcgaaagagctaaatatcgatgttgttggtgtcagcttccatgtaggaagcggctgtaccgatcctgagaccttcgtgcaggcaatctctgatgcccgctgtgtttttgacatgggggctgaggttggtttcagcatgtatctgcttgatattggcggtggctttcctggatctgaggatgtgaaacttaaatttgaagagatcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatgacgaagatgagtcgagtgagcagacctttatgtattatgtgaatgatggcgtctatggatcatttaattgcatactctatgaccacgcacatgtaaagccccttctgcaaaagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggcaactcatgcagcaattccagaaccccgacttcccaccctgcctgtgtcttgtgcctgggagagtgggatga

SEQ ID NO: 21191 - DNA, 1142 bp, Homo sapiens
ttttgcgaacggcgagcagcggcggcggcgcggagagacgcagcggaggttttcctggtttcggaccccagcggccggatggtgaaatcctccctgcagcggatcctcaatagccactgcttcgccagagagaaggaaggggataaacccagcgccaccatccacgccagccgcaccatgccgctcctaagcctgcacagccgcggcggcagcagcagtgagagttccagggtctccctccactgctgtagtaacccgggtccggggcctcggtggtgcgatgcccctcacccacccctgaagatcccaggtgggcgagggaatagtcagagggatcacaatctttcagctaacttattctactccgatgatcggctgaatgtaacagaggaactaacgtccaacgacaagacgaggattctcaacgtccagtccaggctcacagacgccaaacgcattaactggcgaacagtgctgagtggcggcagcctctacatcgagatcccgggcggcgcgctgcccgaggggagcaaggacagctttgcagttctcctggagttcgctgaggagcagctgcgagccgaccatgtcttcatttgcttccacaagaaccgcgaggacagagccgccttgctccgaaccttcagctttttgggctttgagattgtgagaccggggcatccccttgtccccaagagacccgacgcttgcttcatggcctacacgttcgagagagagtcttcgggagaggaggaggagtagggccgcctcggggctgggcatccggcccctggggccaccccttgtcagccgggtgggtaggaaccgtagactcgctcatctcgcctgggtttgtccgcatgttgtaatcgtgcaaataaacgctcactccgaattagcggtgtatttcttgaagtttaatattgtgtttgtgatactgaagtatttgctttaattctaaataaaaatttatattttacttttttattgctggtttaagatgattcagattatccttgtactttgaggagaagtttcttatttggagtcttttggaaacagtcttagtcttttaacttggaaagatgaggtattaatcccctccattgctctccaaaagccaataaagtgattacacccga

SEQ ID NO: 21192 - DNA, 1004 bp, Homo sapiens
atgtggatcaccagtctcatcaccatgaaggatgaagatatatttgatttggcaggggatccccaagacagcctcattcctgggccttctcccacccccaagcaaaacccagtttgtaatgaggctttctttggacaccagactttctccttaagagagactggattgaaatctgtgcattgccaagggcaagaagctgagaacatggagagagagaagtttcagcagaaggctctgaagcaaactaagcagaagaaatccaagtcggctgaatttctgatggttaaagaagatagagaagctacagaaggcactggaaatccagcttttaacatgagcagtccagatctctcagcatgtcagactgcagaaaagaaagttattagacacgacatgccggatcgcacccttgcagctcaccaacaaaaattcaggctgccagcctctgcagaaccaaaaggaaatgaatacggcagaaattactttgacccactgatggatgaggaaataaacccaaggcagtgtgcgacggaggtcagcagagaagatgagagtggccgggaggagactctgaattctgaagcacctgggagttccaataagagtcacgaaatccacaaagaagccagcgaagccaccactgctcaccttgaggagttccaaagatctcagaaaactataattctgcttggaagttctccattagaacaggaaattagatctacttcattgcattgtatggaggatgagatgagtcatccatggatactcttgctcaaagtaactgctgtaatcagaagcaggaggtactatagagagcaaagattctaaaacccattctcaggtcagtgctcgcaatgttcttatgttcactgtgtcgggaagttccatgaacacacaaggcaacatcataagtaggaaaaaccttcagatttggtgttagaactcagagctgtcatccttgattcagatatttatgtgaacttaaacctctttgtaaaata

SEQ ID NO: 21193 - DNA, 1489 bp, Homo sapiens
agagactggattgaaatctgtgcattgccaagggcaagaagctgagaacatggagagagagaagtttcagcagaaggctctgaagcaaactaagcagaagaaatccaagtcggctgaatttctgatggttaaagaagatagagaagctacagaaggcactggaaatccagcttttaacatgagcagtccagatctctcagcatgtcagactgcagaaaagaaagttattagacacgacatgccggatcgcacccttgcagctcaccaacaaaaattcaggctgccagcctctgcagaaccaaaaggaaatgaatacggcagaaattactttgacccactgatggatgaggaaataaacccaaggcagtgtgcgacggaggtcagcagagaagtttgtctaatggctaaaggagagaaagcagaatcaggagtggataatacagctggcctttcagagaaggaaacacagaagaatcctcgtgcaccaatggatgaggcagacgttaaatccgcagcacactcttctcaggggagcattcctaaaaaaatcggtccctgttctatggactatgatcccaatctcttagaagaagacgatgaactacactctcagggagatagcctgacggatcattctgtgaaaggaaaatcaactgtttggagaattggagaagctgaagattattcacaggacatatcttacttggaggaactggaggaacaccgattttctgtttgctgttcttcagttgctgatagtagatatggagacttcttcaagcatctccattttgtgctggtatcagcgtcttcagaacttcagttatctcaatggcaaagccagggcttctggtacattatactgctgatgttttttctctggttcctgaggctctacctgcattacttgggccagtggcttttcctccaggccatttcaactcctgttacaaaattccatttttctcttcacatcgttgagctttgctacccaacttcctcacttcacattggagaagagcttcccgtggttgtgatggggcctttaatgctgaatgcaatcctgcttcttttggttttgatcagatggggctgtcagctactctttgcctcctgtcctgatgtcttgtcaaagttaatcattaccatgggactatggacaattctggacccattggcagtgtttatactggatactctcctggggcggcttacagataatgaggagactcctgtggcggatgccgcgaagctctactggatgtttgtaagaaccgtgcagccaggcattcttggcgtggtgatcacagtgctgctttacatcctcctgttcgtcatttcttctttgattttatatttatattgtcttaggttgcacaatgactcttggatattagatgcttttcagcgcatccacagtgaagaaaccaagttcttcataccgtatgacttggagatttccaatcaggagctaagttatatagtgaaa

SEQ ID NO: 21194 - DNA, 802 bp, Homo sapiens
gcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctataacaccacctacctgaatgtccagcgggaaaatgggaccatctccagatacgtgggaggccaagagcatttcgctcacttgctgatcctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacag

SEQ ID NO: 21195 - DNA, 996 bp, Homo sapiens
cagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccgggtgagtgcctgggctagccctgtcctgagcacatgggcagctgcctcccttctctgggcttccctttccctgctggctgtggtcggacccccactcccggctctgcctttttctcttctgggtccccagggtgaaattctcaccagcccaggggactctggaggcaccccctgcctccaaacacagaagcctcactgcagagtccttcacggaggacggttctgtgctgggcctggaggggctgcctggggggcaatgactgatcctcagggtgagctcctgcatgcgcactgcccaccaggggcctcatctccccatctgcaaaatcagggagagatctgcctgagtctcctcccagctgacagtcaaagattcagcatcaagcccccatcaccagctcccaccttctccccagatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctataacaccacctacctgaatgtccagcgggaaaatgggaccatctccagatacggtgagggccagccctcaggcaggagggttcactgtgggaacagggcaggccagcataaggtgggggctggatgtagagccctggaggctttgggcacagagaaataaccactaacatttttgagctctaacgatgtgctcagaaacaactctaagaggacactgagagaattagaggaggaaaaagaagaacagagacctcaaatagtttccccaa

SEQ ID NO: 21196 - DNA, 980 bp, Homo sapiens
actgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccgggtgagtgcctgggctagccctgtcctgagcacatgggcagctgcctcccttctctgggcttccctttacctgctggctgtggtcgcacccccactcccagctctgcctttttctcttctgggtccccagggtgaaattctcaccagcccaggggactctggaggcaccccctgcctccaaacacagaagcctcactgcagagtccttcacggaggacggttctgtgctgggcctggaggggctgcctggggggcaatgactgatcctcagggtgagctcctgcatgcgcactgcccaccaggggcctcatctccccatctgcaaaatcagggagagatctgcctgagtctcctcccagctgacagtcaaagattcagcatcaagcccccatcaccagctccccccttctccccagatcactggcaagtggttttatatcgcatcggcctttcgaaacgaggagtacaataagtcggttcaggagatccaagcaaccttcttttactttacccccaacaagacagaggacacgatctttctcagagagtaccagacccgccagaaccagtgcttctataactccagttacctgaatgtccagcgggagaatgggaccgtctccagatacgagggaggccgagaacatgttgctcacctgctgttccttagggacaccaagaccttgatgtttggttcctacctggacgatgagaagaactgggggctgtctttctatgctgacaagccagagacgaccaaggagcaactgggagagttctacgaagctctcgactgcttgtgcattcccaggtcagatgtcatgtacaccgact

SEQ ID NO: 21197 - DNA, 760 bp, Homo sapiens
agcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttactttacccccaacaagacagaggacacgatctttctcagagagtaccagacccgccagaaccagtgcttctataactccagttacctgaatgtccagcgggagaatgggaccgtctccagatacgagggaggccgagaacatgttgctcacctgctgttccttagggacaccaagaccttgatgtttggttcctacctggacgatgagaagaactgggggctgtctttctatgctgacaagccagagacgaccaaggagcaactgggagagttctacgaagctctcgactgcttgtgcattcccaggtcagatgtcatgtacaccgactggaaaaaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaacag

SEQ ID NO: 21198 - DNA, 2861 bp, Homo sapiens
acatacccggggagggcagtagaaaggtgatcaatcttcatcaggctacatttccaatcacctaaacaaccgagcaagacaagccactccgacaaggttggctgcccggcgggtctctgtgagagatccaggtagatggtgaacggccccggcagctgagggcaggccaggcccccagacgcatcagaccctgaaggactgcgtggtgggagccctgcaccgctcctggccccgggccccctggatccgtcggggcgcctccacccagctgttagcatgatgtcttacctcaaacaacccccatacggcatgaacgggctgggcctggccgggcccgccatggacctcctgcacccatccgtgggctatccggccactccgcggaagcagcggcgggagcgcaccaccttcacgcgttcacagctggacgtgctcgaggcgctcttcgccaagactcgctaccctgacatcttcatgcgggaggaggtggcgctcaagatcaacctgccggagtctagagtccaggtctggttcaagaaccgccgcgccaaatgccgccagcagcagcagagcgggagcggaaccaagagccgcccagccaagaagaagtcctctccagtgcgggagagctcgggctccgaaagcagtggccaattcacgccgccagctgtgtccagctctgcctcgtcctctagctcggcgtccagctcttccgccaacccagcggctgcagcggctgcgggactaggtgggaacccggtggcggccgcgtcgtcgctgagtacaccagctgcctcatctatctggagcccggcctccatctcgccaggctcagcgcccgcgtccgtgtcggtgccggagccattggccgcgcctagcaacacctcgtgtatgcagcgctccgtagctgcaggcgccgccaccgcagcagcctcttatcccatgtcctacggccagggcggcagctacggccaaggctaccctacgccctcctcttcctactttggcggcgtggactgcagctcatacctagcgcccatgcactcacatcaccacccgcaccagctcagccccatggcaccctcctccatggcgggccaccatcatcaccacccacatgcgcaccacccgttgagccagtcctcaggccaccaccaccaccatcaccaccaccaccaccaaggctacggtggctctgggcttgccttcaactctgccgactgcttggattacaaggagcctggcgccgctgctgcttcctccgcctggaaactcaacttcaactcccccgactgtctggactataaggaccaagcctcatggcggttccaggtcttgtgagcccaggaatgaaagaggagaagaaacgcaactacctgcgccctccgtggtcccgatcctgttgctgctgctgcaccgcccgcctttgcctcgtcttctccaaaactgaattttcaccccccaaaaagatgtccattgcctgcactgccgcccccatttttgtgccacttgcttggggggatgtgcaaacccaccctgccccttggatggggggaccggtgcttcggcttggcctacacattctatacaggagagatgtattatttccccccttcagcccctactaaactcttaagcctccccttccagtctttctggacagctattaagcacttgcagccttcggaggctctgcgctctgatccgctgtttgagcccaacactttaatttattctttctggacactggagtcactaactggcgtgtttctgcccattggagcacccgcacactactccaaatcaaaaccactaagagttcctcccgcgcagactgctgccccttcagctgccctcgattttgctccacgcctgccggccagagcctcccggcgtttcttccgccccagcggagtgcgctggggcgcgccagggctaggcccgccggaggagcgcgtccccagccttccgcgcacagagccgcatcccgccccgccctgcgctggactggttcaagcttccgcctcggcgggaacgctgtacatagtcaggtccgttccagggaccacttaaactttttagttgctgttggttggttgaactgaacatatcttgtcttagcacccaggaaacagaactttaagatatatacagcacatatatatatatatacatatatatatacacatatataaaaaacaaaagcaaaaaatattttccctctgtccgtcccccttctgctcttcctcaatcaatggcgctttttctttttcagttgttgcaaagctgccctgccctcttcacatcttctccctctgtgtatttattgaagagaaccgcttggtttcaggaagctgggcgcgggatatccgaagtgtggaggaaacagacaagtcagggtacagaggtgggggttgggcaggggcgcagggctgaccccctcacccggtctaagcacagggtcgcagttccagtttacaaacctaaaacaagaaaaccaaaaccagggaacaaaacaacaaaacaaaacaaaatccgtaaaagtacagcattagggaaaaacaaacaaacccaggccccaaacccagttccaactcctctgtcggcttctctctttcaacacccttgttttgtctagtgagtttttagtgcaccttcgttctccgaaatctgcggagagcccgcgcgcctgtgtatcaattttggctttggccgcttcgtccagtaggtgggaaagtaatttgtaaatttgatttgtctgatgtgaagatcacaaattacttgttgaaatgtaaggcagtccccctcctcctctttatctacattacttcccgaaaataaatgcaaattaatgaacggct

SEQ ID NO: 21199 - DNA, 2861 bp, Homo sapiens
ggacgctgggctccaacgtttcagtagaagcgcttaagacttgcaaacacccttggtggggacctggaaccccgggagatgccgacgagcaagcaggttggctgcccggcgggtctctgtgagagatccaggtagatggtgaacggccccggcagctgagggcaggccaggcccccagacgcatcagaccctgaaggactgcgtggtgggagccctgcaccgctcctggccccgggccccctggatccgtcggggcgcctccacccagctgttagcatgatgtcttacctcaaacaacccccatacggcatgaacgggctgggcctggccgggcccgccatggacctcctgcacccatccgtgggctatccggccactccgcggaagcagcggcgggagcgcaccaccttcacgcgttcacagctggacgtgctcgaggcgctcttcgccaagactcgctaccctgacatcttcatgcgggaggaggtggcgctcaagatcaacctgccggagtctagagtccaggtctggttcaagaaccgccgcgccaaatgccgccagcagcagcagagcgggagcggaaccaagagccgcccagccaagaagaagtcctctccagtgcgggagagctcgggctccgaaagcagtggccaattcacgccgccagctgtgtccagctctgcctcgtcctctagctcggcgtccagctcttccgccaacccagcggctgcagcggctgcgggactaggtgggaacccggtggcggccgcgtcgtcgctgagtacaccagctgcctcatctatctggagcccggcctccatctcgccaggctcagcgcccgcgtccgtgtcggtgccggagccattggccgcgcctagcaacacctcgtgtatgcagcgctccgtagctgcaggcgccgccaccgcagcagcctcttatcccatgtcctacggccagggcggcagctacggccaaggctaccctacgccctcctcttcctactttggcggcgtggactgcagctcatacctagcgcccatgcactcacatcaccacccgcaccagctcagccccatggcaccctcctccatggcgggccaccatcatcaccacccacatgcgcaccacccgttgagccagtcctcaggccaccaccaccaccatcaccaccaccaccaccaaggctacggtggctctgggcttgccttcaactctgccgactgcttggattacaaggagcctggcgccgctgctgcttcctccgcctggaaactcaacttcaactcccccgactgtctggactataaggaccaagcctcatggcggttccaggtcttgtgagcccaggaatgaaagaggagaagaaacgcaactacctgcgccctccgtggtcccgatcctgttgctgctgctgcaccgcccgcctttgcctcgtcttctccaaaactgaattttcaccccccaaaaagatgtccattgcctgcactgccgcccccatttttgtgccacttgcttggggggatgtgcaaacccaccctgccccttggatggggggaccggtgcttcggcttggcctacacattctatacaggagagatgtattatttccccccttcagcccctactaaactcttaagcctccccttccagtctttctggacagctattaagcacttgcagccttcggaggctctgcgctctgatccgctgtttgagcccaacactttaatttattctttctggacactggagtcactaactggcgtgtttctgcccattggagcacccgcacactactccaaatcaaaaccactaagagttcctcccgcgcagactgctgccccttcagctgccctcgattttgctccacgcctgccggccagagcctcccggcgtttcttccgccccagcggagtgcgctggggcgcgccagggctaggcccgccggaggagcgcgtccccagccttccgcgcacagagccgcatcccgccccgccctgcgctggactggttcaagcttccgcctcggcgggaacgctgtacatagtcaggtccgttccagggaccacttaaactttttagttgctgttggttggttgaactgaacatatcttgtcttagcacccaggaaacagaactttaagatatatacagcacatatatatatatatacatatatatatacacatatataaaaaacaaaagcaaaaaatattttccctctgtccgtcccccttctgctcttcctcaatcaatggcgctttttctttttcagttgttgcaaagctgccctgccctcttcacatcttctccctctgtgtatttattgaagagaaccgcttggtttcaggaagctgggcgcgggatatccgaagtgtggaggaaacagacaagtcagggtacagaggtgggggttgggcaggggcgcagggctgaccccctcacccggtctaagcacagggtcgcagttccagtttacaaacctaaaacaagaaaaccaaaaccagggaacaaaacaacaaaacaaaacaaaatccgtaaaagtacagcattagggaaaaacaaacaaacccaggccccaaacccagttccaactcctctgtcggcttctctctttcaacacccttgttttgtctagtgagtttttagtgcaccttcgttctccgaaatctgcggagagcccgcgcgcctgtgtatcaattttggctttggccgcttcgtccagtaggtgggaaagtaatttgtaaatttgatttgtctgatgtgaagatcacaaattacttgttgaaatgtaaggcagtccccctcctcctctttatctacattacttcccgaaaataaatgcaaattaatgaacggct

SEQ ID NO: 21200 - DNA, 2198 bp, Homo sapiens
cctgagagcgggaccggcctcagctccaacacagcctccactgtgattaaaaataaaaattgctagagcagccctcactcgccacatctactttgatagctggctatttggaatttaaaggatatttgactttttctaacctcccatgaggctgtaagttccactgctccaaacccacccaccaaggactctgaacctgtccaccccgggcgcatcaagatcttccagctgggtacccccgatttgggccgactttgcacctccaaacaaccttagcatgatgtcttatcttaagcaaccgccttacgcagtcaatgggctgagtctgaccacttcgggtatggacttgctgcacccctccgtgggctacccggggccctgggcttcttgtcccgcagccaccccccggaaacagcgccgggagaggacgacgttcactcgggcgcagctagatgtgctggaagcactgtttgccaagacccggtacccagacatcttcatgcgagaggaggtggcactgaaaatcaacttgcccgagtcgagggtgcaggtatggtttaagaatcgaagagctaagtgccgccaacaacagcaacaacagcagaatggaggtcaaaacaaagtgagacctgccaaaaagaagacatctccagctcgggaagtgagttcagagagtggaacaagtggccaattcactcccccctctagcacctcagtcccgaccattgccagcagcagtgctcctgtgtctatctggagcccagcttccatctccccactgtcagatcccttgtccacctcctcttcctgcatgcagaggtcctatcccatgacctatactcaggcttcaggttatagtcaaggatatgctggctcaacttcctactttgggggcatggactgtggatcatatttgacccctatgcatcaccagcttcccggaccaggggccacactcagtcccatgggtaccaatgcagtcaccagccatctcaatcagtccccagcttctctttccacccagggatatggagcttcaagcttgggttttaactcaaccactgattgcttggattataaggaccaaactgcctcctggaagcttaacttcaatgctgactgcttggattataaagatcagacatcctcgtggaaattccaggttttgtgaagacctgtagaacctctttttgtgggtgatttttaaatatactgggctggacattccagttttagccaggcattggttaaaagagttagatgggatgatgctcagactcatctgatcaaagttccgagaggcatagaaggaaaaacgaagggccttagaggggcctacaaaccagcaacatgaaatggacaaaccaatctgcttaagatcctgtcatagttttagatcattggttatcctgatttgcaaagtgatcaaaagcattctagccatgtgcaaccaaacaccaccaaaaataaaatcaaacaaaactaagttgtgaaggaagggagggaaggtcatagccttcttaagcagaggtgttccattgttttagccaatccttggttgaatcttaggaatgaacagtgtctcaagctcattcacgtttcatgaccaactggtagttggcactgaaaaaacttttcagggctgtgtgaattgtgtgactgattgtcctagatgcactactttatttaaaaaataatgttcataaggagtcaatatgtagtttaagagacaatcagtgtgtgtcttataaatggtacatctgtggtttttaatctgtgctagacttcaaaactgtgatctcctgttattgtatgcaaccttgaactccacctctgcaggggttcttctgtgattaaataggttataattataagcaaaattcagagcaactgagtactgatctaaaaagattacctttggctggaggtgagctgcactgaaactttacgacaaaatgtctctggacaaagagagtcagagaagagaagcaaaaggacactaattcatctgtaatttactgttggtaagcctagcagtaaagagacattggtcaattgctctgaccctgatgaattattaaactgagatcattgtcgtttatgcttgcagatgttaaatggaaaagttatatatgcataaaccttttcttcctggatttggcagatatgtataattatattaaaatggttctagcaca

SEQ ID NO: 21201 - DNA, 1082 bp, Homo sapiens
tttttaagttagtgctggaacgtggaagagctgctgcctccgaagcagtaaaccagcccctctgtttgtttgtttgctttgcccttagttccactgctccaaacccacccaccaaggactctgaacctgtccaccccgggcgcatcaagatcttccagctgggtacccccgatttgggccgactttgcacctccaaacaaccttagcatgatgtcttatcttaagcaaccgccttacgcagtcaatgggctgagtctgaccacttcgggtatggacttgctgcacccctccgtgggctacccggccaccccccggaaacagcgccgggagaggacgacgttcactcgggcgcagctagatgtgctggaagcactgtttgccaagacccggtacccagacatcttcatgcgagaggaggtggcactgaaaatcaacttgcccgagtcgagggtgcaggtatggtttaagaatcgaagagctaagtgccgccaacaacagcaacaacagcagaatggaggtcaaaacaaagtgagacctgccaaaaagaagacatctccagctcgggaagtgagttcagagagtggaacaagtggccaattcactcccccctctagcacctcagtcccgaccattgccagcagcagtgctcctgtgtctatctggagcccagcttccatctccccactgtcagatcccttgtccacctcctcttcctgcatgcagaggtcctatcccatgacctatactcaggcttcaggttatagtcaaggatatgctggctcaacttcctactttgggggcatggactgtggatcatatttgacccctatgcatcaccagcttcccggaccaggggccacactcagtcccatgggtaccaatgcagtcaccagccatctcaatcagtccccagcttctctttccacccagggatatggagcttcaagcttgggttttaactcaaccactgattgcttggattataaggaccaaactgcctcctggaagcttaacttcaatgctgactgcttggattataaagatcagacatcctcgtggaaattccaggttttgtgaagacc

SEQ ID NO: 21202 - DNA, 908 bp, Homo sapiens
tggaacgtggaagagctgctgcctccgaagcagtaaaccagcccctctgtttgtttgtttgctttgcccttagttccactgctccaaacccacccaccaaggactctgaacctgtccaccccgggcgcatcaagatcttccagctgggtacccccgatttgggccgactttgcacctccaaacaaccttagcatgatgtcttatcttaagcaaccgccttacgcagtcaatgggctgagtctgaccacttcgggtatggacttgctgcacccctccgtgggctacccggggccctgggcttcttgtcccgcagccaccccccggaaacagcgccgggagaggacgacgttcactcgggcgcagctagatgtgctggaagcactgtttgccaagacccggtacccagacatcttcatgcgagaggaggtggcactgaaaatcaacttgcccgagtcgagggtgcaggtatggtttaagaatcgaagagctaagtgccgccaacaacagcaacaacagcagaatggaggtcaaaacaaagtgagacctgccaaaaagaagacatctccagctcgggaagtgagttcagagagtggaacaagtggccaattcactcccccctctagcacctcagtcccgaccattgccagcagcagtgctcctgtgtctatctggagcccagcttccatctccccactgtcagatcccttgtccacctcctcttcctgcatgcagaggtcctatcccatgacctatactcaggcttcaggttatagtcaaggatatgctggctcaacttcctactttgggggcatggactgtggatcatatttgacccctatgcatcaccagcttcccggaccaggggccacactcagtcccatgggtaccaatgcagtcaccagccatct

SEQ ID NO: 21203 - DNA, 1279 bp, Homo sapiens
agctccaacacagcctccactgtgattaaaaataaaaattgctagagcagccctcactcgccacatctactttgtatgtattgcagaggggcccacgcgtgtttagaactctagccgccttcctcattttcgttctttaaaaaaaattttttttggttgtgtttgacttttcatggaagggtgaagactgcaaggtttctaactcaatactcttgatttcttttaggatagctggctatttggaatttaaaggatatttgactttttctaacctcccatgaggctgtaagttccactgctccaaacccacccaccaaggactctgaacctgtccaccccgggcgcatcaagatcttccagctgggtacccccgatttgggccgactttgcacctccaaacaaccttagcatgatgtcttatcttaagcaaccgccttacgcagtcaatgggctgagtctgaccacttcgggtatggacttgctgcacccctccgtgggctacccggccaccccccggaaacagcgccgggagaggacgacgttcactcgggcgcagctagatgtgctggaagcactgtttgccaagacccggtacccagacatcttcatgcgagaggaggtggcactgaaaatcaacttgcccgagtcgagggtgcaggtatggtttaagaatcgaagagctaagtgccgccaacaacagcaacaacagcagaatggaggtcaaaacaaagtgagacctgccaaaaagaagacatctccagctcgggaagtgagttcagagagtggaacaagtggccaattcactcccccctctagcacctcagtcccgaccattgccagcagcagtgctcctgtgtctatctggagcccagcttccatctccccactgtcagatcccttgtccacctcctcttcctgcatgcagaggtcctatcccatgacctatactcaggcttcaggttatagtcaaggatatgctggctcaacttcctactttgggggcatggactgtggatcatatttgacccctatgcatcaccagcttcccggaccaggggccacactcagtcccatgggtaccaatgcagtcaccagccatctcaatcagtccccagcttctctttccacccagggatatggagcttcaagcttgggttttaactcaaccactgattgcttggattataaggaccaaactgcctcctggaagcttaacttcaatgctgactgcttggattataaagatcagacatcctcgtggaaattccaggttttgtga

SEQ ID NO: 21204 - DNA, 797 bp, Homo sapiens
agcaaatctccctgagagcgggaccggcctcagctccaacacagcctccactgtgattaaaaataaaaattgctagagcagccctcactcgccacatctactttgatagctggctatttggaatttaaaggatatttgactttttctaacctcccatgaggctgtaaggattgtaggaaacttgaaagttccactgctccaaacccacccaccaaggactctgaacctgtccaccccgggcgcatcaagatcttccagctgggtacccccgatttgggccgactttgcacctccaaacaaccttagcatgatgtcttatcttaagcaaccgccttacgcagtcaatgggctgagtctgaccacttcgggtatggacttgctgcacccctccgtgggctacccggccaccccccggaaacagcgccgggagaggacgacgttcactcgggcgcagctagatgtgctggaagcactgtttgccaagacccggtacccagacatcttcatgcgagaggaggtggcactgaaaatcaacttgcccgagtcgagggtgcaggtatggtttaagaatcgaagagctaagtgccgccaacaacagcaacaacagcagaatggaggtcaaaacaaagtgagacctgccaaaaagaagacatctccagctcgggaagtgagttcagagagtggaacaagtggccaattcactcccccctctagcacctcagtcccgaccattgccagcagcagtgctcctgtgtctatctggagcccagcttccatctccccactgtcagatccct

SEQ ID NO: 21205 - DNA, 3668 bp, Homo sapiens
tactctggttagaaatatattactaatctaaactttgttgttggctggctctgaaaaatcagaacattagaaatggttcgcttcacttgtgcaaagcactttaaattgttcaagtagtttaacatattcaagaggaaaataaagagcatttaactttatttacagccttaagtggagttgggagccgagctgaacttagaaactttgaccaaaagagcgagttaggggcgaggatgcgggcgtgggccaagcggaagagcaggagccgggaagaagcccggtgagaagagtgcagagcgctcgaacccacactccgcgagggtccccaaagcagacagcgggcgctggcggtgccagggaagccgactcctctttgcgctctaggcccactgtggggttggggctcgtatagaccccagggcacagccagggcgcctggaccctaggcgcaggcctactgagccgcggcgaagtccaggcgttgtctgaaggccgcggtgtgccctcgtcgcgccctgggctggcgggccaatatgagcggcaggcccagagagcgcaggtgggggcgaccctcaggtcacgccagggtcatggcccgctctgacccctgctctgcccctgccctaggaagatgttagctcagaggcacagagctacgccttcgaagcgcgcagcgccggccaaggggaaggaaaggggagcctggagaaaatcgcagggaagaactagagggagccgggcccagaagctcagggcgaggccgaggcggctgaggctgctttagctcctgctccgggctggagctgccagggctgccgccgccgcctccttcaggcgggcgcaggcgagcgggcgggcggagtgggggactctccgggcgctgacatttgcaggctgccctcctgattggtcccctcgccgagctgctcacgggttcattcaactgttaagcacctccccgtctctctaaaggacattataatgcaagaagccccctttttaaccacaaaccgaattttctttcatttaggtgatctatatatatctatatcgtatagcttatagcttatatctattttaaataacttaaagccgctaaaatttgggggggaacagctttcgccctggagcggtgcgcgatgctgtctcatgccgacctcctggacgccaggctaggtatgaaagatgccgccgagcttctgggccaccgggaggcggtgaagtgtaggctgggcgtggggggctccgaccccgggggccatccgggggacctggcgcccaactctgacccagtggagggagccactctgctgcccggggaggacatcaccacagtgggctctactccggcctcgctggcggtgagcgccaaagacccggacaagcagcccgggccccagggcggcccgaaccccagccaagccggccagcagcagggccaacagaagcagaagcgccaccggacgcgcttcacccccgcacagctcaacgagttggagaggagcttcgccaagactcactaccccgacatctttatgcgtgaggagctggcactgcgtatcgggctgaccgagtcccgagtgcaggtctggttccagaaccgacgcgccaagtggaagaagcgcaaaaagacgaccaacgtgttccgtgcgcccggcacactgctgcccacgccaggcctgcctcagttcccgtcggctgccgccgccgctgccgccgccatgggcgacagcctgtgctctttccacgccaacgacacccgctgggcggcggccgccatgcctggcgtgtcacagctgcctctgccgccggcgctgggcaggcagcaggccatggcgcagtcgctgtcccagtgcagcctggcggccggtccgccgcccaactccatgggcctgtccaacagcctggcgggttccaacggcgcggggctgcagtcgcacctctaccagcccgccttccccggcatggtgcccgcctccctccccggccccagcaacgtctccggttcgccccagctctgcagctccccggacagcagcgacgtgtggcggggcaccagcatcgcctccctccgccgcaaggcgctagagcacacagtctctatgagcttcacttaatgcagccgcgccccggcccgctccgcccccagcaccgccccgggggccgccccgaggcccttccggcgcgcacccggaccccggcgccctgccccgtcccgccccggccttcgccccgtctcgtttcgtcctcgcctctctcctccactcgctcgggctcaccccaagccccagcccgcgaggcctcccctccgcctgatttcgatcgcccgcggtcccccgtctcccggccgcccctcttcccttcccacccagctgcgccctcggctcggtctccagcgcctcagcccacccttcccgccaccctggcctccctgcttgcgctggccgtgctcgcgccctcctcctggccttctgacgggcggcgttcccacccacaccttcgacgcgacgcctacgacccccctcgcccgccgcctcccctccggtcccctctttccccacacttcgcgaccctcctcccgcgcccggcaaaaagtatccttcccgccattttacgtaccagggagtcgactcaggatctgaaatcagacaccaatggactggtttgtgggcagaaacacacacactcgcactctcgctcacgctcagacgctacacacgcgcgcgcacagacacggtgcacctaggtcacacacggacgtgttcaagggacagcacaatgttagggatttttgtcttaaaggaggacaagcattgctaccaaccgcctcatctgagggcccaactgatatgatttgatttatccttgtactctccaagctcctgtctttctttcctctcccaccacgctacccttgcccagtccacccagtcacatccgtgcagccctctcttggcttgcaagataacgcttttatttttattttatcttattttcattttcttaagcacaactgtgtgagagtgtagaagggaaggcttctcaggaggaacgtgacagtggattgggtggctggagtagactaaagcagtcatgtgacgaggaagaggtgatctgacccattttgataagtctttataaggaagaataaaataaacgtgtaagcaaaattttcttttgtaaaagcaaaagccacatctcttttctggatccttcaggactggggtttgtttgcttccttttctgtttctgtcttctcgctgctctgtgcccttggttgttttgtggtggtcctgtcgtccctcgtgcccctcggccacctgctggcagccgatgggggcactcggacatctacaaccctgcaactttgtacagagaaacacaatcagctctttctgcatgtgctggtcaaatccaaacccagagaacagaagcgctttctaagaatgaacaaatatgtgaaataggatgttttgtgtagataaagcattcttgttacatactggtcaatttgtgatatgttttaacttaatgtctgtgtttatttatggaattcggttttcttaataaatgtttgagctaatataaagcatattatttgacttttccggacaagtttatatcaagttaaatgtaaatggataaaataaaatcattttcagtatgtg

SEQ ID NO: 21206 - DNA, 2002 bp, Homo sapiens
ctcgcctccctcctctaattctctaggacacttaggtccccaaccctccctcgggctgtttatcgttgtgccagatgcacagcacattgtgtgacactgacttaagattctaactatgtgcaagagggaaaaaaacagtggagaaggctgggctggaccacgggaaagagataggaaaacggatacgaatgtaaggcacagagttggctcggcgtccctggcagttaggaagacaggtccctggaggggccttggcgggtctccgctcgcgggagttccgcggtgtctttcccagtgctatctgcaggctggccagcttcctctgcgctccggaaagctgcggcccagcgcggactagtgaggacctccacagctcctgacattgccaggagtcctgtcggcgttttctcccagcctccgccatgccggcggtgctgggttttgaaggcagcgccaataagattggcgtgggcgtggtgcgggatggcaaggtgctggcgaacccgcggcggacttacgtcacgcctcctggcacaggattccttccaggtgatacagccaggcatcaccgagctgttatcctagacctgctgcaggaggcactaacagagtctggattaacctcccaggatatcgactgcattgcatacaccaagggccctggcatgggtgccccactggtttctgtggctgttgtggcccgtactgtggcccaactgtggaataagccattggtgggtgtgaaccactgtataggccacattgagatgggccgcctcatcactggagccaccagcccaaccgtgttgtatgtgagtggaggaaatacgcaggtgattgcatactcggaacatcgttaccgtatctttggggaaaccatcgatattgcagtgggtaattgtctggatcgttttgctcgagtgctgaagatttctaacgacccaagtccaggatacaacattgaacagatggcaaagcgaggcaagaagctagttgagctgccatacactgtaaaggggatggacgtctcattctcagggatcctgtctttcattgaggatgtagcccatcggatgctggccacaggcgagtgtactcctgaggatctgtgtttctccctgcaggaaactgtgtttgcaatgctggtagagatcacagagcgagccatggcacattgtggctcccaggaggccctcattgtgggaggagtggggtgtaatgtgaggctacaggagatgatggcaacaatgtgccaggaacgtggagcccggctttttgctacagatgagagattctgtattgacaatggagcgatgatagcccaggctggctgggagatgtttcgggctggacacaggaccccactcagtgattctggggttacacagaggtatcggacagatgaagtagaggtgacctggagggactaataagatcaacagaatcagagtagatagttccttaatcggaacccaaaggaccccgtgcctcaatctctatcctgatgtcatgggagtcctagcaaagctatagactccaagcaaggcttggggtcctttatggaaccccaggatgactcagcaataaaatatttttggttttttggttttgtatgttggtgattggattgtgttgttcaggaccaatgtagatttggtgctggataaattcttgttggagcttgctgctgtggaaccaagaatgaggtatctttttttttttttttaagaaacggaatcttgctgtgtttcccaggctggtctcgaactgggctcaagcagtcttaccacctcagcctcctgagtaaggatgccattgtgcctggcaacaatagtagtatcataactattattatagcatcgggtcccgtgctaactgctttacattcattctctcatttaaattctttgaagtaggtgtgcaagacttctctcaaaatagcctggaggctcacacctgttatcccagtgctgtgggaggccaagtcaggaggatcccttga

SEQ ID NO: 21207 - DNA, 1892 bp, Homo sapiens
gctctagcgggtatctgcccaccatggccctggtgctgatcctccagctgctgaccctctggcctctgtgtcacacagacatcactccgtctgtggccattatagtccccccagcttcataccaccctaagccatggctgggagctcagccggctacagttgtgacccctggggtcaacgtgaccttgagatgccgggcaccccaacccgcttggagatttggacttttcaagcctggagagatcgctccccttctcttccgggatgtgtcctccgagctggcagaattctttctggaggaggtgactccagcccaagggggaatttaccgctgctgctaccgaaggccagactgggggccgggtgtctggtcccagcccagcgatgtcctggagctgctggtgacagaggagctgccgcggccgtcgctggtggcgctgcccgggccggtggtgggtcctggcgccaacgtgagcctgcgctgcgcgggccgcctgcggaacatgagcttcgtgctgtaccgcgagggcgtggcggccccgctgcagtaccgccactccgcgcagccctgggccgacttcacgctgctgggcgcccgcgcccccggcacctacagctgctactatcacacgccctccgcgccctacgtgctgtcgcagcgcagcgaggtgctggtcatcagctgggaaggtgagggccctgaggcccggcccgcctcctccgccccaggaatgcaggccccaggacctccgccctcagacccaggagcccaggcccccagcctctcctccttcagacccaggggtctagtcctgcagcccctcctccctcagacccaggattcctgggacccagcccctcctccctcagatccaggagtctagtcctccagctcctcctccctcagacccaggattcccgggccccagtacctcctccctcagacccaggactccaggcccccagcccctccttcctggacccaggactccaggcccccagcccctccttcctgatccagcagtccaggccccagccccttcttcctggacccaggagttgaagcctccatcgactccccctcaactttgagactgtagagtcaggtccctaagtccaccccaggggctggaaacctggagttcagggcccagactttggggtccgggagctgatggcccctctctcccggctccgcccgcagactctggctcctccgactacacccgggggaacctagtccgcctggggctggccgggctggtcctcatctccctgggcgcgctggtcacttttgactggcgcagtcagaaccgcgctcctgctggtatccgcccctgagccccaggagcactgcagcccgagacttccaacctgagtggcggagaagctgggaccctgggctggactgtcctttcctgcagccccacagtcctgctggctgagctccgcggaacggtccttagaccccgctgtgccctgtgctgtagcttctttccaggcctttcccaaggagtagctgaaaggaagacgcgattagtggttaagacttccaagccagaagacagagggttcgaatcccagcactgccgtctactcactgtagtagtagcagctacagaaaggtagtagtgagacgtgaagccagctggacttcctgggttgaatggggacctggagaacttttctgtcttacaagaggattgtaaaatggaccaatcagcactctgtaagatggaccaatcagcgctctgtaaaatggaccaatcagcaggacatgggcggggacaataagggaataaaagctggcgagcgcggcaccccaccagagtctgcttccacgctgtgggagctttgttctcttgctctacacaataaatcttgctgctgct

SEQ ID NO: 21208 - DNA, 2055 bp, Homo sapiens
gcgtgcgcactcgcgcagaacaaagatggagccgtggagtgccatagggctatgacacagtcacccacaggcccccacctcgatactctcttccgtaaatgaggatctgggtctggttttctgatgttgcctcatttcctgggaggggagagggtgcgaccaagccctggctccagctctagcgggtatctgcccaccatggccctggtgctgatcctccagctgctgaccctctggcctctgtgtcacacagacatcactccgtctgtccccccagcttcataccaccctaagccatggctgggagctcagccggctacagttgtgacccctggggtcaacgtgaccttgagatgccgggcaccccaacccgcttggagatttggacttttcaagcctggagagatcgctccccttctcttccgggatgtgtcctccgagctggcagaattctttctggaggaggtgactccagcccaagggggaatttaccgctgctgctaccgaaggccagactgggggccgggtgtctggtcccagcccagcgatgtcctggagctgctggtgacagaggagctgccgcggccgtcgctggtggcgctgcccgggccggtggtgggtcctggcgccaacgtgagcctgcgctgcgcgggccgcctgcggaacatgagcttcgtgctgtaccgcgagggcgtggcggccccgctgcagtaccgccactccgcgcagccctgggccgacttcacgctgctgggcgcccgcgcccccggcacctacagctgctactatcacacgccctccgcgccctacgtgctgtcgcagcgcagcgaggtgctggtcatcagctgggaaggtgagggccctgaggcccggcccgcctcctccgccccaggaatgcaggccccaggacctccgccctcagacccaggagcccaggcccccagcctctcctccttcagacccaggggtctagtcctgcagcccctcctccctcagacccaggattcctgggacccagcccctcctccctcagatccaggagtctagtcctccagctcctcctccctcagacccaggattcccgggccccagtacctcctccctcagacccaggactccaggcccccagcccctccttcctggacccaggactccaggcccccagcccctccttcctgatccagcagtccaggccccagccccttcttcctggacccaggagttgaagcctccatcgactccccctcaactttgagactgtagagtcaggtccctaagtccaccccaggggctggaaacctggagttcagggcccagactttggggtccgggagctgatggcccctctctcccggctccgcccgcagactctggctcctccgactacacccgggggaacctagtccgcctggggctggccgggctggtcctcatctccctgggcgcgctggtcacttttgactggcgcagtcagaaccgcgctcctgctggtatccgcccctgagccccaggagcactgcagcccgagacttccaacctgagtggcggagaagctgggaccctgggctggactgtcctttcctgcagccccacagtcctgctggctgagctccgcggaacggtccttagaccccgctgtgccctgtgctgtagcttctttccaggcctttcccaaggagtagctgaaaggaagacgcgattagtggttaagacttccaagccagaagacagagggttcgaatcccagcactgccgtctactcactgtagtagtagcagctacagaaaggtagtagtgagacgtgaagccagctggacttcctgggttgaatggggacctggagaacttttctgtcttacaagaggattgtaaaatggaccaatcagcactctgtaagatggaccaatcagcgctctgtaaaatggaccaatcagcaggacatgggcggggacaataagggaataaaagctggcgagcgcggcaccccaccagagtctgcttccacgctgtgggagctttgttctcttgctctacacaataaatcttgctgctgct

SEQ ID NO: 21209 - DNA, 1375 bp, Homo sapiens
atttcctgggaggggagagggtgcgaccaagccctggctccagctctagcgggtatctgcccaccatggccctggtgctgatcctccagctgctgaccctcttccccccagcttcataccaccctaagccatggctgggagctcagccggctacagttgtgacccctggggtcaacgtgaccttgagatgccgggcaccccaacccgcttggagatttggacttttcaagcctggagagatcgctccccttctcttccgggatgtgtcctccgagctggcagaattctttctggaggaggtgactccagcccaagggggaatttaccgctgctgctaccgaaggccagactgggggccgggtgtctggtcccagcccagcgatgtcctggagctgctggtgacagaggagctgccgcggccgtcgctggtggcgctgcccgggccggtggtgggtcctggcgccaacgtgagcctgcgctgcgcgggccgcctgcggaacatgagcttcgtgctgtaccgcgagggcgtggcggccccgctgcagtaccgccactccgcgcagccctgggccgacttcacgctgctgggcgcccgcgcccccggcacctacagctgctactatcacacgccctccgcgccctacgtgctgtcgcagcgcagcgaggtgctggtcatcagctgggaagactctggctcctccgactacacccgggggaacctagtccgcctggggctggccgggctggtcctcatctccctgggcgcgctggtcacttttgactggcgcagtcagaaccgcgctcctgctggtatccgcccctgagccccaggagcactgcagcccgagacttccaacctgagtggcggagaagctgggaccctgggctggactgtcctttcctgcagccccacagtcctgctggctgagctccgcggaacggtccttagaccccgctgtgccctgtgctgtagcttctttccaggcctttcccaaggagtagctgaaaggaagacgcgattagtggttaagacttccaagccagaagacagagggttcgaatcccagcactgccgtctactcactgtagtagtagcagctacagaaaggtagtagtgagacgtgaagccagctggacttcctgggttgaatggggacctggagaacttttctgtcttacaagaggattgtaaaatggaccaatcagcactctgtaagatggaccaatcagcgctctgtaaaatggaccaatcagcaggacatgggcggggacaataagggaataaaagctggcgagcgcggcaccccaccagagtctgcttccacgctgtgggagctttgttctcttgctctacacaataaatcttgctgctgct

SEQ ID NO: 21210 - DNA, 1355 bp, Homo sapiens
atggccctggtgctgatcctccagctgctgaccctctggcctctgtgtcacacagacatcactccgtctgtggccattatagtccccccagcttcataccaccctaagccatggctgggagctcagccggctacagttgtgacccctggggtcaacgtgaccttgagatgccgggcaccccaacccgcttggagatttggacttttcaagcctggagagatcgctccccttctcttccgggatgtgtcctccgagctggcagaattctttctggaggaggtgactccagcccaagggggaatttaccgctgctgctaccgaaggccagactgggggccgggtgtctggtcccagcccagcgatgtcctggagctgctggtgacagaggagctgccgcggccgtcgctggtggcgctgcccgggccggtggtgggtcctggcgccaacgtgagcctgcgctgcgcgggccgcctgcggaacatgagcttcgtgctgtaccgcgagggcgtggcggccccgctgcagtaccgccactccgcgcagccctgggccgacttcacgctgctgggcgcccgcgcccccggcacctacagctgctactatcacacgccctccgcgccctacgtgctgtcgcagcgcagcgaggtgctggtcatcagctgggaagactctggctcctccgactacacccgggggaacctagtccgcctggggctggccgggctggtcctcatctccctgggcgcgctggtcacttttgactggcgcagtcagaaccgcgctcctgctggtatccgcccctgagccccaggagcactgcagcccgagacttccaacctgagtggcggagaagctgggaccctgggctggactgtcctttcctgcagccccacagtcctgctggctgagctccgcggaacggtccttagaccccgctgtgccctgtgctgtagcttctttccaggcctttcccaaggagtagctgaaaggaagacgcgattagtggttaagacttccaagccagaagacagagggttcgaatcccagcactgccgtctactcactgtagtagtagcagctacagaaaggtagtagtgagacgtgaagccagctggacttcctgggttgaatggggacctggagaacttttctgtcttacaagaggattgtaaaatggaccaatcagcactctgtaagatggaccaatcagcgctctgtaaaatggaccaatcagcaggacatgggcggggacaataagggaataaaagctggcgagcgcggcaccccaccagagtctgcttccacgctgtgggagctttgttctcttgctctacacaataaatcttgctgctgct

SEQ ID NO: 21211 - DNA, 1389 bp, Homo sapiens
ggtgcgaccaagccctggctccagctctagcgggtatctgcccaccatggccctggtgctgatcctccagctgctgaccctctggcctctgtgtcacacagacatcactccgtctgtccccccagcttcataccaccctaagccatggctgggagctcagccggctacagttgtgacccctggggtcaacgtgaccttgagatgccgggcaccccaacccgcttggagatttggacttttcaagcctggagagatcgctccccttctcttccgggatgtgtcctccgagctggcagaattctttctggaggaggtgactccagcccaagggggaatttaccgctgctgctaccgaaggccagactgggggccgggtgtctggtcccagcccagcgatgtcctggagctgctggtgacagaggagctgccgcggccgtcgctggtggcgctgcccgggccggtggtgggtcctggcgccaacgtgagcctgcgctgcgcgggccgcctgcggaacatgagcttcgtgctgtaccgcgagggcgtggcggccccgctgcagtaccgccactccgcgcagccctgggccgacttcacgctgctgggcgcccgcgcccccggcacctacagctgctactatcacacgccctccgcgccctacgtgctgtcgcagcgcagcgaggtgctggtcatcagctgggaagactctggctcctccgactacacccgggggaacctagtccgcctggggctggccgggctggtcctcatctccctgggcgcgctggtcacttttgactggcgcagtcagaaccgcgctcctgctggtatccgcccctgagccccaggagcactgcagcccgagacttccaacctgagtggcggagaagctgggaccctgggctggactgtcctttcctgcagccccacagtcctgctggctgagctccgcggaacggtccttagaccccgctgtgccctgtgctgtagcttctttccaggcctttcccaaggagtagctgaaaggaagacgcgattagtggttaagacttccaagccagaagacagagggttcgaatcccagcactgccgtctactcactgtagtagtagcagctacagaaaggtagtagtgagacgtgaagccagctggacttcctgggttgaatggggacctggagaacttttctgtcttacaagaggattgtaaaatggaccaatcagcactctgtaagatggaccaatcagcgctctgtaaaatggaccaatcagcaggacatgggcggggacaataagggaataaaagctggcgagcgcggcaccccaccagagtctgcttccacgctgtgggagctttgttctcttgctctacacaataaatcttgctgctgct

SEQ ID NO: 21212 - DNA, 1319 bp, Homo sapiens
ctcttcccgcagccaagggtgggcgccggtcctaggaggcgcacggttgtaagccagacaaaaagaactggggtgcccggagtgccaggtggcgggcaagcggtgggcttttcggcggggtctttaggatttgcagctccaggaagcgagatgtcgaagccgccacccaaaccagtcaaaccagggcaagttaaagtcttcagagccctgtatacgtttgaacccagaactccagatgaattatactttgaggaaggtgatattatctacattactgacatgagcgataccaattggtggaaaggcacctccaaaggcaggactggactaattccaagcaactatgtggctgagcaggcagaatccattgacaatccattgcatgaagcagcaaaaagaggcaacttgagctggttgagagagtgtttggacaacagagtgggtgttaatggcttagacaaagctggaagcactgccttatactgggcttgccacgggggccacaaagatatagtggaaatgctatttactcaaccaaatattgaactgaaccagcagaacaagttgggagatacagctttgcatgctgctgcctggaagggttatgcagatatcgtccagttgcttctggcaaaaggtgctagaacagacttaagaaacattgagaagaagctggccttcgacatggctaccaatgctgcctgtgcatctctcctgaaaaagaaacagggaacagatgcagttcgaacattaagcaatgccgaggactatctcgatgatgaagactcagattaattcctttctggagctttgagatctaaaacttctgttgcttttgccattccaaaactttgtctttgccagaaaagtgttggtaactataaagaaaattatatatgaacacggcagtgttgcactgtgtttgagtagaacgtgtaaatgaattgttcccacctttggtttgccagtaagtgactggattcttggcacatttatgttcaccaaagtagaacaagaagatattatttctatttatcaagcaaaaggaattttaagatttttttttttctttaaaaacaaattaggattttttttttttttttttttttagttaaaatgctttacctcaatggttgagatattttgaatggatttttcaagggggggaaatgcttattataataataaaccaaaatacttaacagaaaattgtcagctattctgacaaaaataaacattttgagagactttatttcttttgtccgtttctgtggtatcactcattgtcgttaagtaagtaaagctttttatatttaggt

SEQ ID NO: 21213 - DNA, 2971 bp, Homo sapiens
gctaatgcacagacatgaacatctattgaggaaaaccacaaaaaacttcaaaacagctacaacggtatcctaagaatatttcaattaaatattagtatgtctgctgaaggcacttaattattaagaaacttaaaattatcaatctttcttgaatttctgatagagaagtaaaactattttccaaaactatttttcagaatgttcactgatacataaaaactgctagcatctaattaaagatcactaagggttaaatactgttctctggcccttactgcgcacaccctgccaaaacatcctctaagcttttaaatattgcttcgatggtctgaatttttatttccagggaaaaagagagttttgtcccacagtcagcaggccactagtttattaacttccagtcaccttgatttttgctaaaatgaagactctgcagtctacacttctcctgttactgcttgtgcctctgataaagccagcaccaccaacccagcaggactcacgcattatctatgattatggaacagataattttgaagaatccatatttagccaagattatgaggataaatacctggatggaaaaaatattaaggaaaaagaaactgtgataatacccaatgagaaaagtcttcaattacaaaaagatgaggcaataacaccattacctcccaagaaagaaaatgatgaaatgcccacgtgtctgctgtgtgtttgtttaagtggctctgtatactgtgaagaagttgacattgatgctgtaccacccttaccaaaggaatcagcctatctttacgcacgattcaacaaaattaaaaagctgactgccaaagattttgcagacatacctaacttaagaagactcgattttacaggaaatttgatagaagatatagaagatggtactttttcaaaactttctctgttagaagaactttcacttgctgaaaatcaactactaaaacttccagttcttcctcccaagctcactttatttaatgcaaaatacaacaaaatcaagagtaggggaatcaaagcaaatgcattcaaaaaactgaataacctcaccttcctctacttggaccataatgccctggaatccgtgcctcttaatttaccagaaagtctacgtgtaattcatcttcagttcaacaacatagcttcaattacagatgacacattctgcaaggctaatgacaccagttacatccgggaccgcattgaagagatacgcctggagggcaatccaatcgtcctgggaaagcatccaaacagttttatttgcttaaaaagattaccgatagggtcatacttttaacctctattggtacaacatataaatgaaagtacacctacactaatagtctgtctcaacaatgagtaaaggaacttaagtattggtttaatattaaccttgtatctcattttgaaggaatttaatattttaagcaaggatgttcaaaatcttacatataataagtaaaaagtaagactgaatgtctacgttcgaaacaaagtaatatgaaaatatttaaacagcattacaaaatcctagtttatactagactaccatttaaaaatcatgtttttatataaatgcccaaatttgagatgcattattcctattactaatgatgtaagtacgaggataaatccaagaaactttcaactctttgcctttcctggcctttactggatcccaaaagcatttaaggtacatgttccaaaaactttgaaaagctaaatgtttcccatgatcgctcattcttcttttatgattcatacgttattccttataaagtaagaactttgttttcctcctatcaaggcagctattttattaaatttttcacttagtctgagaaatagcagatagtctcatatttaggaaaactttccaaataaaataaatgttattctctgataaagagctaatacagaaatgttcaagttattttactttctggtaatgtcttcagtaaaatattttctttatctaaatattaacattctaagtctaccaaaaaaagttttaaactcaagcaggccaaaaccaatatgcttataagaaataatgaaaagttcatccatttctgataaagttctctatggcaaagtctttcaaatacgagataactgcaaaatattttccttttatactacagaaatgagaatctcatcaataaattagttcaagcataagatgaaaacagaatattctgtggtgccagtgcacactaccttcccacccatacacatccatgttcactgtaacaaactgaatattcacaataaagcttctgagtaacactttctgattactcatgataaactgacatggctaactgcaagaattaaatcttctatctgagagtaataatttatgatgactcagtggtgccagagtaaagtttctaaaataacattcctctcacttgtaccccactaaaagtattagactacacattacattgaagttaaacacaaaattatcagtgttttagaaacatgagtccggactgtgtaagtaaaagtacaaacattatttccaccataaagtatgtattgaaatcaagttgtctctgtgtacagaatacatacttattcccatttttaagcatttgcttctgttttccctacctagaatgtcagatgtttttcagttatctccccatttgtcaaagttgacctcaagataacatttttcattaaagcatctgagatctaagaacacaattattattctaacaatgattattagctcattcacttattttgataactaatgatcacagctattatactactttctcgttattttgtgtgcatgcctcatttccctgacttaaacctcactgagagcgcaaaatgcagctttatactttttactttcaattgcctagcacaatagtgagtacatttgaattgaatatataataaatattgcaaaataaaatccatctaaatagaa

SEQ ID NO: 21214 - DNA, 2743 bp, Homo sapiens
actcagcagtttgaaatcaagacatagcttttctcattcaccctcccacttggggctaatgcacagacatgaacatctattgaggaaaaccacaaaaaacttcaaaacagctacaacgggaaaaagagagttttgtcccacagtcagcaggccactagtttattaacttccagtcaccttgatttttgctaaaatgaagactctgcagtctacacttctcctgttactgcttgtgcctctgataaagccagcaccaccaacccagcaggactcacgcattatctatgattatggaacagataattttgaagaatccatatttagccaagattatgaggataaatacctggatggaaaaaatattaaggaaaaagaaactgtgataatacccaatgagaaaagtcttcaattacaaaaagatgaggcaataacaccattacctcccaagaaagaaaatgatgaaatgcccacgtgtctgctgtgtgtttgtttaagtggctctgtatactgtgaagaagttgacattgatgctgtaccacccttaccaaaggaatcagcctatctttacgcacgattcaacaaaattaaaaagctgactgccaaagattttgcagacatacctaacttaagaagactcgattttacaggaaatttgatagaagatatagaagatggtactttttcaaaactttctctgttagaagaactttcacttgctgaaaatcaactactaaaacttccagttcttcctcccaagctcactttatttaatgcaaaatacaacaaaatcaagagtaggggaatcaaagcaaatgcattcaaaaaactgaataacctcaccttcctctacttggaccataatgccctggaatccgtgcctcttaatttaccagaaagtctacgtgtaattcatcttcagttcaacaacatagcttcaattacagatgacacattctgcaaggctaatgacaccagttacatccgggaccgcattgaagagatacgcctggagggcaatccaatcgtcctgggaaagcatccaaacagttttatttgcttaaaaagattaccgatagggtcatacttttaacctctattggtacaacatataaatgaaagtacacctacactaatagtctgtctcaacaatgagtaaaggaacttaagtattggtttaatattaaccttgtatctcattttgaaggaatttaatattttaagcaaggatgttcaaaatcttacatataataagtaaaaagtaagactgaatgtctacgttcgaaacaaagtaatatgaaaatatttaaacagcattacaaaatcctagtttatactagactaccatttaaaaatcatgtttttatataaatgcccaaatttgagatgcattattcctattactaatgatgtaagtacgaggataaatccaagaaactttcaactctttgcctttcctggcctttactggatcccaaaagcatttaaggtacatgttccaaaaactttgaaaagctaaatgtttcccatgatcgctcattcttcttttatgattcatacgttattccttataaagtaagaactttgttttcctcctatcaaggcagctattttattaaatttttcacttagtctgagaaatagcagatagtctcatatttaggaaaactttccaaataaaataaatgttattctctgataaagagctaatacagaaatgttcaagttattttactttctggtaatgtcttcagtaaaatattttctttatctaaatattaacattctaagtctaccaaaaaaagttttaaactcaagcaggccaaaaccaatatgcttataagaaataatgaaaagttcatccatttctgataaagttctctatggcaaagtctttcaaatacgagataactgcaaaatattttccttttatactacagaaatgagaatctcatcaataaattagttcaagcataagatgaaaacagaatattctgtggtgccagtgcacactaccttcccacccatacacatccatgttcactgtaacaaactgaatattcacaataaagcttctgagtaacactttctgattactcatgataaactgacatggctaactgcaagaattaaatcttctatctgagagtaataatttatgatgactcagtggtgccagagtaaagtttctaaaataacattcctctcacttgtaccccactaaaagtattagactacacattacattgaagttaaacacaaaattatcagtgttttagaaacatgagtccggactgtgtaagtaaaagtacaaacattatttccaccataaagtatgtattgaaatcaagttgtctctgtgtacagaatacatacttattcccatttttaagcatttgcttctgttttccctacctagaatgtcagatgtttttcagttatctccccatttgtcaaagttgacctcaagataacatttttcattaaagcatctgagatctaagaacacaattattattctaacaatgattattagctcattcacttattttgataactaatgatcacagctattatactactttctcgttattttgtgtgcatgcctcatttccctgacttaaacctcactgagagcgcaaaatgcagctttatactttttactttcaattgcctagcacaatagtgagtacatttgaattgaatatataataaatattgcaaaataaaatccatctaaatagaa

SEQ ID NO: 21215 - DNA, 825 bp, Homo sapiens
gcatttcaccctagagaaagaatgctggcaaagatctctaccacatggaaactgttcttaaagctgctgggccctgaaattttactcagcagtttgaaatcaagacatagcttttctcattcaccctcccacttggggctaatgcacagacatgaacatctattgaggaaaaccacaaaaaacttcaaaacagctacaacgactctgcagtctacacttctcctgttactgcttgtgcctctgataaagccagcaccaccaacccagcaggactcacgcattatctatgattatggaacagataattttgaagaatccatatttagccaagattatgaggataaatacctggatggaaaaaatattaaggaaaaagaaactgtgataatacccaatgagaaaagtcttcaattacaaaaagatgaggcaataacaccattacctcccaagaaagaaaatgatgaaatgcccacgtgtctgctgtgtgtttgtttaagtggctctgtatactgtgaagaagttgacattgatgctgtaccacccttaccaaaggaatcagcctatctttacgcacgattcaacaaaattaaaaagctgactgccaaagattttgcagacatacctaacttaagaagactcgattttacaggaaatttgatagaagatatagaagatggtactttttcaaaactttctctgttagaagaactttcacttgctgaaaatcaactactaaaacttccagttcttcctcccaagctcactttatttaatgcaaaatacaacaaaatcaagagtaggggaatcaaagcaaatgcattcaaa

SEQ ID NO: 21216 - DNA, 2505 bp, Homo sapiens
aagaaggggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgtagactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggaggtgaaggctggcatggagcgggaactggaaaacatcatccaggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgagctgtggacctctcgggcaactctgtgggtgtgggggccctgggtgaatgctgctgcccctgctggcagccaccttgagacctcaccgggcctgtgatatttgctctcctgaactctcactcaatcctcttcctctcctctgtggcttttcctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagtcgttttaccctcttctattgaattgccttgggatttccttctccctttccctgcccaccctgtcccctacaatttgtgcttctgagttgaggagccttcacctctgttgctgaggaaatggtagaatgctgcctatcacctccagcacaatcccagtgaaaaaggtgtgaagcacccaccatgttcttgaacaatcaggtttctaaataaacaactggaccatc

SEQ ID NO: 21217 - DNA, 2091 bp, Homo sapiens
aagaaggggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacagaggaggatcctgagcacagagtccgggtccgggtcaccaagctccgtctcggaggccctaatcaggatctgactgtcctcgagatgaaacgggaaaacccacagctgaaacaaatcgaggggctggtgaaggagctgctggagagggagggactcacagctgcagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgag

SEQ ID NO: 21218 - DNA, 2346 bp, Homo sapiens
aagaaggggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaattcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggaggtgaaggctggcatggagcgggaactggaaaacatcatccaggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgagctgtggacctctcgggcaactctgtgggtgtgggggccctgggtgaatgctgctgcccctgctggcagccaccttgagacctcaccgggcctgtgatatttgctctcctgaactctcactcaatcctcttcctctcctctgtggcttttcctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagtcgttttaccctcttctattgaattgccttgggatttccttctccctttccctgcccaccctgtcccctacaatttgtgcttctgagttgaggagccttcacctctgttgctgaggaaatggtagaatgctgcctatcacctccagcacaatcccagtgaaaaaggtgtgaagcacccaccatgttcttgaacaatcaggtttctaaataaacaactggaccatc

SEQ ID NO: 21219 - DNA, 2246 bp, Homo sapiens
aagaaggggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaagttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgtagactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggaggtgaaggctggcatggagcgggaactggaaaacatcatccaggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgagctgtggacctctcgggcaactctgtgggtgtgggggccctgggtgaatgctgctgcccctgctggcagccaccttgagacctcaccgggcctgtgatatttgctctcctgaactctcactcaatcctcttcctctcctctgtggcttttcctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagtcgttttaccctcttctattgaattgccttgggatttccttctccctttccctgcccaccctgtc

SEQ ID NO: 21220 - DNA, 2691 bp, Homo sapiens
agggcggaaacagattctctgcataagaaggggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggaggtgaaggctggcatggagcgggaactggaaaacatcatccaggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacagaggaggatcctgagcacagagtccgggtccgggtcaccaagctccgtctcggaggccctaatcaggatctgactgtcctcgagatgaaacgggaaaacccacagctgaaacaaatcgaggggctggtgaaggagctgctggagagggagggactcacagctgcagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgagctgtggacctctcgggcaactctgtgggtgtgggggccctgggtgaatgctgctgcccctgctggcagccaccttgagacctcaccgggcctgtgatatttgctctcctgaactctcactcaatcctcttcctctcctctgtggcttttcctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagtcgttttaccctcttctattgaattgccttgggatttccttctccctttccctgcccaccctgtcccctacaatttgtgcttctgagttgaggagccttcacctctgttgctgaggaaatggtagaatgctgcctatcacctccagcacaatcccagtgaaaaaggtgtgaagcacccaccatgttcttgaacaatcaggtttctaaataaacaactggaccatc

SEQ ID NO: 21221 - DNA, 2457 bp, Homo sapiens
gaaggggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgagctgtggacctctcgggcaactctgtgggtgtgggggccctgggtgaatgctgctgcccctgctggcagccaccttgagacctcaccgggcctgtgatatttgctctcctgaactctcactcaatcctcttcctctcctctgtggcttttcctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagtcgttttaccctcttctattgaattgccttgggatttccttctccctttccctgcccaccctgtcccctacaatttgtgcttctgagttgaggagccttcacctctgttgctgaggaaatggtagaatgctgcctatcacctccagcacaatcccagtgaaaaaggtgtgaagcacccaccatgttcttgaacaatcaggtttctaaataaacaactggaccatcaa

SEQ ID NO: 21222 - DNA, 2135 bp, Homo sapiens
ctgaccaatcacggacagcgattgatatttctaatcgtcgtgatccacctccccaggaccttggagccacgtttacaaataggaatagggtacgtgggagggatagaacgtacagccaataaaatcatgtggcgccgatgggcgtgttgaggccgctgcctggcttagggcggaaacagattctctgcataagaaggggaacgaaagatggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaaggcctccaagcagcatcgtcttaaacgctaccacagccagacctatggcaatgggtccaagtgcgaccttaatgggaggccccgggaggccgaggttcggttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggaggtgaaggctggcatggagcgggaactggaaaacatcatccaggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctga

SEQ ID NO: 21223 - DNA, 3651 bp, Homo sapiens
aatgtctcaggaacctacgacatactcccttttcctattcctttttctgagccatggagtgtcgagttatacagtgccaaattccaggcaggatttgcatccattgttgcaaaacatggcggaagaaataatagatggaagctatctgaatgcactgctggatctcatacagtttcaaagctcccacgtgtggacggatgacctgtcccacagagtcctggcctatctgaattcccggaatgttgccttcaccatccccagcctgcaggcagccgtggaaaaccacctggagcagcgtctgcaccagccccagaagctgctggaggacctgaggaagacagacgcccagcagttccgcactgccatgaaatgcctcttagaagacaagaaggacggcttggacctgaaagacatcatcatcgacttaggagagattcgagaacgagccttgcagagccctggcgtgaaccgcagcctgtttctcatcacactggagaggtgtttccagatgctgaactccctggagtgtgtggagatcctgggcaaggtgctgagggggtcctcagggagctttctccagccagacatcacagagcggctccctcgggacctgcgcgaggatgcctttaagaacctatctgcagtgttcaaagatctctacgacaaaacctcggctcattcccagagagctctctattcctggatgactggaatactgcagacatcctccaatgccactgatgactctgcttcatgggtcagtgcggaacacttatgggttttgggcagatacatggttcacctatcgtttgaagaaattacgaaaattagtcctatagaaattgggctgtttatcagctatgacaacgccaccaagcagctggacatggtctatgacatcacacctgagctggcccaggcgtttctggagaggatcagctcctccaactttaacatgaggaatacctccaccatccacaggcaagcgcatgagctctgggccttggagccctttcccaagatgctggggctgctggtttgtttctacaatgacctggaattgctggatgccactgtggctcaagtcctgctttaccagatgatcaagtgcagccacctgaggggcttccaggctggcgtccagaagctcaaagcagaactcctggacattgccatggagaaccagaccctcaatgagaccctgggttctttgtcggatgcagttgtaggtttgacctacagccaactggaatccctctcccccgaggctgtgcacggagccatctccaccctcaaccaggtctcaggttgggccaagagccaggtcatcatcttgtctgccaaatacttggcccatgagaaggtgctgtctttctacaatgtcagccagatgggcgcactgctggctggggtcagcacccaggccttctgcagcatgaaacgcaaggacatctcgcaggtcctgagaagtgccgtctcccagtatgtatccgacttgtcacctgcccagcagcaaggtatcctcagcaagatggtccaagcggaagacactgccccaggcatcgtggagatacaaggggctttctttaaggaagtgtctctctttgatttaaggaggcaacctggattcaactctacagtcctgaaggataaggaacttggaaggagccaggctctgttcctgtatgagcttctgttaaagaccaccagaaggcctgaggagcttttgagtgctgggcagctggtcaaaggcgtgacctgctcacacattgatgccatgagcactgacttctttctggcccatttccaggattttcagaacaacttcgccctgctttcaccctatcaggttaattgtttggcgtggaaatactgggaagtttccagattgtctatgccacctttcctcttggctgcactcccggcccgctacctggcttctgtcccagcctcccagtgtgtgccctttctgatcagcctggggaagagctggttggactccttggttttagattcccacaaaaagacttcagtcctcaggaaagtgcagcagtgcctggacgactccattgctgatgagtacactgtggacatcatggggaacctgctgtgtcacttgccggcagccatcatcgacagggggatctcccccagggcttgggcgactgctctacacggcctcagagactgcccagacctcaaccctgagcaaaaggctgcagtgaggctcaagctcctgggacagtatggactccctcagcactggacagccgagaccacgaaggacttgggaccctttctagtacttttctcaggagatgaattaagctctatagccacaaagtttcctgagatccttctgcaagcagcttccaagatggccaggaccctgcccactaaagaattcctctgggctgtctttcagtctgttcggaacagcagtgataagatccccagctatgaccctatgcctggttgccatggagtcgtggccccctcttctgatgacatcttcaagttggccgaagccaacgcctgctgggccctggaggacctgcggtgcatggaggaagacacattcatcaggaccgtggaactgctgggagctgtccagggtttcagccggcctcagctgatgaccctgaaggagaaagcaatacaggtttgggacatgccatcttactggagagaacaccatatcgtctccctggggcgcattgctctggctcttaatgagagtgagctggagcagctggacctcagctccatagacactgtggcttccctaagctggcaaacagaatggaccccgggacaggctgaatccattttgcaagggtacctggatgattcaggatacagtatccaggacctgaagagctttcatttggtaggacttggtgcaaccctgtgtgctataaacatcactgaaatcccacttataaagatctcagaattcagggtggtagtggccagaattgggaccctgctctgcagcacacatgtcttagccgagtttaagaggaaggctgaagttgtgtttggggatcccactgagtggaccagttctgtcttgcaggagcttgggaccattgcagctggattaactaaggcagagctccggatgcttgacaaggatttgatgccatatttccagccatcagcaataaaatgccttcctgatgagatattcaaagagctgtccgcggagcagatcgcctccctgggtccggagaacgccgcggcggtgacccacgcccagcgccggcggctcagtccactgcagctgcagagcctccagcaggcgctagatggcgccaagactcactcctggcaggacgcgcccgctagcgccggtcccactagaacctcatcctcgcgttctcccgcaggagctctccagtcgtggggtctttggcttggttgtcccctgctggttctaatggccaagctcctgtggtgagtggcctgagcgcatcgtcctgtgttgccccaagcagctggccaacatgtgtagagacaggatgctccagatggtgggacacccttccctggatccagaccctcatctagggcagggaaaccctggggccttgatggtgaaaatgcaccccaaatgaaaaataattattaaaaatgatcttgcaaatt

SEQ ID NO: 21224 - DNA, 1835 bp, Homo sapiens
cccagagcagtttgggtagaggccaggggtggagctcaacatcctacaatgcgtaggacagcaccactacacagaggtacctggtcgaaaatgtcaataatactgagggcccgctacctggcttctgtcccagcctcccagtgtgtgccctttctgatcagcctggggaagagctggttggactccttggttttagattcccacaaaaagacttcagtcctcaggaaagtgcagcagtgcctggacgactccattgctgatgagtacactgtggacatcatggggaacctgctgtgtcacttgccggcagccatcatcgacagggggatctcccccagggcttgggcgactgctctacacggcctcagagactgcccagacctcaaccctgagcaaaaggctgcagtgaggctcaagctcctgggacagtatggactccctcagcactggacagccgagaccacgaaggacttgggaccctttctagtacttttctcaggagatgaattaagctctatagccacaaagtttcctgagatccttctgcaagcagcttccaagatggccaggaccctgcccactaaagaattcctctgggctgtctttcagtctgttcggaacagcagtgataagatccccagctatgaccctatgcctggttgccatggagtcgtggccccctcttctgatgacatcttcaagttggccgaagccaacgcctgctgggccctggaggacctgcggtgcatggaggaagacacattcatcaggaccgtggaactgctgggagctgtccagggtttcagccggcctcagctgatgaccctgaaggagaaagcaatacaggtttgggacatgccatcttactggagagaacaccatatcgtctccctggggcgcattgctctggctcttaatgagagtgagctggagcagctggacctcagctccatagacactgtggcttccctaagctggcaaacagaatggaccccgggacaggctgaatccattttgcaagggtacctggatgattcaggatacagtatccaggacctgaagagctttcatttggtaggacttggtgcaaccctgtgtgctataaacatcactgaaatcccacttataaagatctcagaattcagggtggtagtggccagaattgggaccctgctctgcagcacacatgtcttagccgagtttaagaggaaggctgaagttgtgtttggggatcccactgagtggaccagttctgtcttgcaggagcttgggaccattgcagctggattaactaaggcagagctccggatgcttgacaaggatttgatgccatatttccagccatcagcaataaaatgccttcctgatgagatattcaaagagctgtccgcggagcagatcgcctccctgggtccggagaacgccgcggcggtgacccacgcccagcgccggcggctcagtccactgcagctgcagagcctccagcaggcgctagatggcgccaagactcactcctggcaggacgcgcccgctagcgccggtcccactagaacctcatcctcgcgttctcccgcaggagctctccagtcgtggggtctttggcttggttgtcccctgctggttctaatggccaagctcctgtggtgagtggcctgagcgcatcgtcctgtgttgccccaagcagctggccaacatgtgtagagacaggatgctccagatggtgggacacccttccctggatccagaccctcatctagggcagggaaaccctggggccttgatggtgaaaatgcaccccaaatgaaaaataattattaaaaatgatcttgcaaatt

SEQ ID NO: 21225 - DNA, 3466 bp, Homo sapiens
ttcgcctgtattttgctcctgcgctggtagcttgggtttgggcacagtgccatctggggttctaaacttcctggacaaaggccagctgctgctgatgggaaactcaatcacctacagggaccaggcagccgtggaaaaccacctggagcagcgtctgcaccagccccagaagctgctggaggacctgaggaagacagacgcccagcagttccgcactgccatgaaatgcctcttagaagacaagaaggacggcttggacctgaaagacatcatcatcgacttaggagagattcgagaacgagccttgcagagccctggcgtgaaccgcagcctgtttctcatcacactggagaggtgtttccagatgctgaactccctggagtgtgtggagatcctgggcaaggtgctgagggggtcctcagggagctttctccagccagacatcacagagcggctccctcgggacctgcgcgaggatgcctttaagaacctatctgcagtgttcaaagatctctacgacaaaacctcggctcattcccagagagctctctattcctggatgactggaatactgcagacatcctccaatgccactgatgactctgcttcatgggtcagtgcggaacacttatgggttttgggcagatacatggttcacctatcgtttgaagaaattacgaaaattagtcctatagaaattgggctgtttatcagctatgacaacgccaccaagcagctggacatggtctatgacatcacacctgagctggcccaggcgtttctggagaggatcagctcctccaactttaacatgaggaatacctccaccatccacaggctggggctgctggtttgtttctacaatgacctggaattgctggatgccactgtggctcaagtcctgctttaccagatgatcaagtgcagccacctgaggggcttccaggctggcgtccagaagctcaaagcagaactcctggacattgccatggagaaccagaccctcaatgagaccctgggttctttgtcggatgcagttgtaggtttgacctacagccaactggaatccctctcccccgaggctgtgcacggagccatctccaccctcaaccaggtctcaggttgggccaagagccaggtcatcatcttgtctgccaaatacttggcccatgagaaggtgctgtctttctacaatgtcagccagatgggcgcactgctggctggggtcagcacccaggccttctgcagcatgaaacgcaaggacatctcgcaggtcctgagaagtgccgtctcccagtatgtatccgacttgtcacctgcccagcagcaaggtatcctcagcaagatggtccaagcggaagacactgccccaggcatcgtggagatacaaggggctttctttaaggaagtgtctctctttgatttaaggaggcaacctggattcaactctacagtcctgaaggataaggaacttggaaggagccaggctctgttcctgtatgagcttctgttaaagaccaccagaaggcctgaggagcttttgagtgctgggcagctggtcaaaggcgtgacctgctcacacattgatgccatgagcactgacttctttctggcccatttccaggattttcagaacaacttcgccctgctttcaccctatcaggttaattgtttggcgtggaaatactgggaagtttccagattgtctatgccacctttcctcttggctgcactcccggcccgctacctggcttctgtcccagcctcccagtgtgtgccctttctgatcagcctggggaagagctggttggactccttggttttagattcccacaaaaagacttcagtcctcaggaaagtgcagcagtgcctggacgactccattgctgatgagtacactgtggacatcatggggaacctgctgtgtcacttgccggcagccatcatcgacagggggatctcccccagggcttgggcgactgctctacacggcctcagagactgcccagacctcaaccctgagcaaaaggctgcagtgaggctcaagctcctgggacagtatggactccctcagcactggacagccgagaccacgaaggacttgggaccctttctagtacttttctcaggagatgaattaagctctatagccacaaagtttcctgagatccttctgcaagcagcttccaagatggccaggaccctgcccactaaagaattcctctgggctgtctttcagtctgttcggaacagcagtgataagatccccagctatgaccctatgcctggttgccatggagtcgtggccccctcttctgatgacatcttcaagttggccgaagccaacgcctgctgggccctggaggacctgcggtgcatggaggaagacacattcatcaggaccgtggaactgctgggagctgtccagggtttcagccggcctcagctgatgaccctgaaggagaaagcaatacaggtttgggacatgccatcttactggagagaacaccatatcgtctccctggggcgcattgctctggctcttaatgagagtgagctggagcagctggacctcagctccatagacactgtggcttccctaagctggcaaacagaatggaccccgggacaggctgaatccattttgcaagggtacctggatgattcaggatacagtatccaggacctgaagagctttcatttggtaggacttggtgcaaccctgtgtgctataaacatcactgaaatcccacttataaagatctcagaattcagggtggtagtggccagaattgggaccctgctctgcagcacacatgtcttagccgagtttaagaggaaggctgaagttgtgtttggggatcccactgagtggaccagttctgtcttgcaggagcttgggaccattgcagctggattaactaaggcagagctccggatgcttgacaaggatttgatgccatatttccagccatcagcaataaaatgccttcctgatgagatattcaaagagctgtccgcggagcagatcgcctccctgggtccggagaacgccgcggcggtgacccacgcccagcgccggcggctcagtccactgcagctgcagagcctccagcaggcgctagatggcgccaagactcactcctggcaggacgcgcccgctagcgccggtcccactagaacctcatcctcgcgttctcccgcaggagctctccagtcgtggggtctttggcttggttgtcccctgctggttctaatggccaagctcctgtggtgagtggcctgagcgcatcgtcctgtgttgccccaagcagctggccaacatgtgtagagacaggatgctccagatggtgggacacccttccctggatccagaccctcatctagggcagggaaaccctggggccttgatggtgaaaatgcaccccaaatgaaaaataattattaaaaatgatcttgcaaatta

SEQ ID NO: 21226 - DNA, 2703 bp, Homo sapiens
ccccattccttggtctcgtctgagcagttaggttccgcctgtggttgcacatttggttcatctgaggatgttcaggctggggctgctggtttgtttctacaatgacctggaattgctggatgccactgtggctcaagtcctgctttaccagatgatcaagtgcagccacctgaggggcttccaggctggcgtccagaagctcaaagcagaactcctggacattgccatggagaaccagaccctcaatgagaccctgggttctttgtcggatgcagttgtaggtttgacctacagccaactggaatccctctcccccgaggctgtgcacggagccatctccaccctcaaccaggtctcaggttgggccaagagccaggtcatcatcttgtctgccaaatacttggcccatgagaaggtgctgtctttctacaatgtcagccagatgggcgcactgctggctggggtcagcacccaggccttctgcagcatgaaacgcaaggacatctcgcaggtcctgagaagtgccgtctcccagtatgtatccgacttgtcacctgcccagcagcaaggtatcctcagcaagatggtccaagcggaagacactgccccaggcatcgtggagatacaaggggctttctttaaggaagtgtctctctttgatttaaggaggcaacctggattcaactctacagtcctgaaggataaggaacttggaaggagccaggctctgttcctgtatgagcttctgttaaagaccaccagaaggcctgaggagcttttgagtgctgggcagctggtcaaaggcgtgacctgctcacacattgatgccatgagcactgacttctttctggcccatttccaggattttcagaacaacttcgccctgctttcaccctatcaggttaattgtttggcgtggaaatactgggaagtttccagattgtctatgccacctttcctcttggctgcactcccggcccgctacctggcttctgtcccagcctcccagtgtgtgccctttctgatcagcctggggaagagctggttggactccttggttttagattcccacaaaaagacttcagtcctcaggaaagtgcagcagtgcctggacgactccattgctgatgagtacactgtggacatcatggggaacctgctgtgtcacttgccggcagccatcatcgacagggggatctcccccagggcttgggcgactgctctacacggcctcagagactgcccagacctcaaccctgagcaaaaggctgcagtgaggctcaagctcctgggacagtatggactccctcagcactggacagccgagaccacgaaggacttgggaccctttctagtacttttctcaggagatgaattaagctctatagccacaaagtttcctgagatccttctgcaagcagcttccaagatggccaggaccctgcccactaaagaattcctctgggctgtctttcagtctgttcggaacagcagtgataagatccccagctatgaccctatgcctggttgccatggagtcgtggccccctcttctgatgacatcttcaagttggccgaagccaacgcctgctgggccctggaggacctgcggtgcatggaggaagacacattcatcaggaccgtggaactgctgggagctgtccagggtttcagccggcctcagctgatgaccctgaaggagaaagcaatacaggtttgggacatgccatcttactggagagaacaccatatcgtctccctggggcgcattgctctggctcttaatgagagtgagctggagcagctggacctcagctccatagacactgtggcttccctaagctggcaaacagaatggaccccgggacaggctgaatccattttgcaagggtacctggatgattcaggatacagtatccaggacctgaagagctttcatttggtaggacttggtgcaaccctgtgtgctataaacatcactgaaatcccacttataaagatctcagaattcagggtggtagtggccagaattgggaccctgctctgcagcacacatgtcttagccgagtttaagaggaaggctgaagttgtgtttggggatcccactgagtggaccagttctgtcttgcaggagcttgggaccattgcagctggattaactaaggcagagctccggatgcttgacaaggatttgatgccatatttccagccatcagcaataaaatgccttcctgatgagatattcaaagagctgtccgcggagcagatcgcctccctgggtccggagaacgccgcggcggtgacccacgcccagcgccggcggctcagtccactgcagctgcagagcctccagcaggcgctagatggcgccaagactcactcctggcaggacgcgcccgctagcgccggtcccactagaacctcatcctcgcgttctcccgcaggagctctccagtcgtggggtctttggcttggttgtcccctgctggttctaatggccaagctcctgtggtgagtggcctgagcgcatcgtcctgtgttgccccaagcagctggccaacatgtgtagagacaggatgctccagatggtgggacacccttccctggatccagaccctcatctagggcagggaaaccctggggccttgatggtgaaaatgcaccccaaatgaaaaataattattaaaaatgatcttgcaaatt

SEQ ID NO: 21227 - DNA, 3610 bp, Homo sapiens
aatgtctcaggaacctacgacatactcccttttcctattcctttttctgagccatggagtgtcgagttatacagtgccaaattccaggcaggatttgcatccattgttgcaaaacatggcggaagaaataatagatggaagctatctgaatgcactgctggatctcatacagtttcaaagctcccacgtgtggacggatgacctgtcccacagagtcctggcctatctgaattcccggaatgttgccttcaccatccccagcctgcaggcagccgtggaaaaccacctggagcagcgtctgcaccagccccagaagctgctggaggacctgaggaagacagacgcccagcagttccgcactgccatgaaatgcctcttagaagacaagaaggacggcttggacctgaaagacatcatcatcgacttaggagagattcgagaacgagccttgcagagccctggcgtgaaccgcagcctgtttctcatcacactggagaggtgtttccagatgctgaactccctggagtgtgtggagatcctgggcaaggtgctgagggggtcctcagggagctttctccagccagacatcacagagcggctccctcgggacctgcgcgaggatgcctttaagaacctatctgcagtgttcaaagatctctacgacaaaacctcggctcattcccagagagctctctattcctggatgactggaatactgcagacatcctccaatgccactgatgactctgcttcatgggtcagtgcggaacacttatgggttttgggcagatacatggttcacctatcgtttgaagaaattacgaaaattagtcctatagaaattgggctgtttatcagctatgacaacgccaccaagcagctggacatggtctatgacatcacacctgagctggcccaggcgtttctggagaggatcagctcctccaactttaacatgaggaatacctccaccatccacaggctggggctgctggtttgtttctacaatgacctggaattgctggatgccactgtggctcaagtcctgctttaccagatgatcaagtgcagccacctgaggggcttccaggctggcgtccagaagctcaaagcagaactcctggacattgccatggagaaccagaccctcaatgagaccctgggttctttgtcggatgcagttgtaggtttgacctacagccaactggaatccctctcccccgaggctgtgcacggagccatctccaccctcaaccaggtctcaggttgggccaagagccaggtcatcatcttgtctgccaaatacttggcccatgagaaggtgctgtctttctacaatgtcagccagatgggcgcactgctggctggggtcagcacccaggccttctgcagcatgaaacgcaaggacatctcgcaggtcctgagaagtgccgtctcccagtatgtatccgacttgtcacctgcccagcagcaaggtatcctcagcaagatggtccaagcggaagacactgccccaggcatcgtggagatacaaggggctttctttaaggaagtgtctctctttgatttaaggaggcaacctggattcaactctacagtcctgaaggataaggaacttggaaggagccaggctctgttcctgtatgagcttctgttaaagaccaccagaaggcctgaggagcttttgagtgctgggcagctggtcaaaggcgtgacctgctcacacattgatgccatgagcactgacttctttctggcccatttccaggattttcagaacaacttcgccctgctttcaccctatcaggttaattgtttggcgtggaaatactgggaagtttccagattgtctatgccacctttcctcttggctgcactcccggcccgctacctggcttctgtcccagcctcccagtgtgtgccctttctgatcagcctggggaagagctggttggactccttggttttagattcccacaaaaagacttcagtcctcaggaaagtgcagcagtgcctggacgactccattgctgatgagtacactgtggacatcatggggaacctgctgtgtcacttgccggcagccatcatcgacagggggatctcccccagggcttgggcgactgctctacacggcctcagagactgcccagacctcaaccctgagcaaaaggctgcagtgaggctcaagctcctgggacagtatggactccctcagcactggacagccgagaccacgaaggacttgggaccctttctagtacttttctcaggagatgaattaagctctatagccacaaagtttcctgagatccttctgcaagcagcttccaagatggccaggaccctgcccactaaagaattcctctgggctgtctttcagtctgttcggaacagcagtgataagatccccagctatgaccctatgcctggttgccatggagtcgtggccccctcttctgatgacatcttcaagttggccgaagccaacgcctgctgggccctggaggacctgcggtgcatggaggaagacacattcatcaggaccgtggaactgctgggagctgtccagggtttcagccggcctcagctgatgaccctgaaggagaaagcaatacaggtttgggacatgccatcttactggagagaacaccatatcgtctccctggggcgcattgctctggctcttaatgagagtgagctggagcagctggacctcagctccatagacactgtggcttccctaagctggcaaacagaatggaccccgggacaggctgaatccattttgcaagggtacctggatgattcaggatacagtatccaggacctgaagagctttcatttggtaggacttggtgcaaccctgtgtgctataaacatcactgaaatcccacttataaagatctcagaattcagggtggtagtggccagaattgggaccctgctctgcagcacacatgtcttagccgagtttaagaggaaggctgaagttgtgtttggggatcccactgagtggaccagttctgtcttgcaggagcttgggaccattgcagctggattaactaaggcagagctccggatgcttgacaaggatttgatgccatatttccagccatcagcaataaaatgccttcctgatgagatattcaaagagctgtccgcggagcagatcgcctccctgggtccggagaacgccgcggcggtgacccacgcccagcgccggcggctcagtccactgcagctgcagagcctccagcaggcgctagatggcgccaagactcactcctggcaggacgcgcccgctagcgccggtcccactagaacctcatcctcgcgttctcccgcaggagctctccagtcgtggggtctttggcttggttgtcccctgctggttctaatggccaagctcctgtggtgagtggcctgagcgcatcgtcctgtgttgccccaagcagctggccaacatgtgtagagacaggatgctccagatggtgggacacccttccctggatccagaccctcatctagggcagggaaaccctggggccttgatggtgaaaatgcaccccaaatgaaaaataattattaaaaatgatcttgcaaatta

SEQ ID NO: 21228 - DNA, 1782 bp, Homo sapiens
agcatcattcatccagctgcactccagtggagccttcacggagtccgttccagttgctgcctaagccccatcctttgttctcctgctatgattgcgtttctcctcaccagtgtgctgatgatcccccatgccggaggccatcctctggacactccacatcttccacaggagctgcctccaggactcccaaacaatatcaatatcactttcttcagtgggatgtttaaaaatgtggaaagtgtggctgaaatttttgattgcctgggcccccacttcacctggctgcaggctgtcttcaccaatttccctgtgctgatccagtttgtcaatggtatgaagtgtgtggctggtctctgcccccgagactttgaagactatggttgcacctgcaggtttgagatggaagggttgcctgtggatgaatctgacagctgctgcttccagcaccgcaggtgctatgaggaggccgctgagatggactgtctccaagaccccgccaaacttagcacagaggtcaattgtgtcagcaagaagatcatatgtgagtccaaggacaactgtgagcacctgctgtgtacctgtgataaggctgccatagagtgcttggctcgatccagcctcaactcttccctgaaccttctggacacctccttctgcctggctcagactccagagacaaccatcaaggaagacttgacaacacttctgcccagagtggttcctgtggagcccacagacaccagcctgacagccctttcaggagaagaagcaggccacgatcaggaaggagtgggagctgctagggctacgtcccctccaggatctgcagagatagttgcaacaagggttacagctaaaattgtaacccttgtccctgctggcattaaatctctggggctggcagtgtcatctgttgaaaatgatcctgaggagaccactgaaaaagcctgtgacagattcaccttcctgcacctgggaagtggggacaacatgcaggtgatgccacagcttggagagatgctcttttgtctgacatcccggtgcccggaggaatttgagtcttatggctgttactgtggacaagaaggaagaggcgagccaagggatgacctagacaggtgctgcttgtcccatcactgctgcctagagcaagtgagaaggctgggctgcctgcttgagaggcttccttggtcaccggtggtgtgtgtggatcatacgcccaagtgtgggggccaaagcctgtgtgagaagttgctctgtgcctgtgaccagacggcagctgagtgcatgacctctgcctcctttaaccaaagcctcaagtccccaagcagactcgggtgccctgggcagccagcagcctgtgaagacagcctgcaccctgtgcccgcagcccccaccctgggctccagctctgaggaggacagcgaggaggaccctccacaggaggacctcggcagagccaagaggtttctgcggaagtcactgggtcccttggggatcgggcctcttcatggaagatagatgcccagagaaaatggctaacaccttcagtagcgtggctcctgctccaccttcagctctttatctctcagcctcctctgtcccttggagccttcttcccttcctttaactcagaggcggggagggaacagaggccgtgagccctgcccatgcctcatcagctgtggtcacctcacaagccaatgtacacttggagaaggcacaccatggtacctccatgctcctttagtgcactgtggaagctcaataaatactccaatc

SEQ ID NO: 21229 - DNA, 1830 bp, Homo sapiens
agcatcattcatccagctgcactccagtggagccttcacggagtccgttccagttgctgcctaagccccatcctttgttctcctgctatgattgcgtttctcctcaccagtgtgctgatgatcccccatgccggaggccatcctctggacactccacatcttccacaggagctgcctccaggactcccaaacaatatcaatatcactttcttcagtgggatgtttaaaaatgtggaaagtgtggctgaaatttttgattgcctgggcccccacttcacctggctgcaggctgtcttcaccaatttccctgtgctgatccagtttgtcaatggtatgaagtgtgtggctggtctctgcccccgagactttgaagactatggttgcacctgcaggtttgagatggaagggttgcctgtggatgaatctgacagctgctgcttccagcaccgcaggtgctatgaggaggccgctgagatggactgtctccaagaccccgccaaacttagcacagaggtcaattgtgtcagcaagaagatcatatgtgagtccaaggacaactgtgagcacctgctgtgtacctgtgataaggctgccatagagtgcttggctcgatccagcctcaactcttccctgaaccttctggacacctccttctgcctggctcagactccagagacaaccatcaaggaagacttgacaacacttctgcccagagtggttcctgtggagcccacagacaccagcctgacagccctttcaggagaagtggctgcagagactgaggctgacagactgatcactctctccaagaaaaaagcaggccacgatcaggaaggagtgggagctgctagggctacgtcccctccaggatctgcagagatagttgcaacaagggttacagctaaaattgtaacccttgtccctgctggcattaaatctctggggctggcagtgtcatctgttgaaaatgatcctgaggagaccactgaaaaagcctgtgacagattcaccttcctgcacctgggaagtggggacaacatgcaggtgatgccacagcttggagagatgctcttttgtctgacatcccggtgcccggaggaatttgagtcttatggctgttactgtggacaagaaggaagaggcgagccaagggatgacctagacaggtgctgcttgtcccatcactgctgcctagagcaagtgagaaggctgggctgcctgcttgagaggcttccttggtcaccggtggtgtgtgtggatcatacgcccaagtgtgggggccaaagcctgtgtgagaagttgctctgtgcctgtgaccagacggcagctgagtgcatgacctctgcctcctttaaccaaagcctcaagtccccaagcagactcgggtgccctgggcagccagcagcctgtgaagacagcctgcaccctgtgcccgcagcccccaccctgggctccagctctgaggaggacagcgaggaggaccctccacaggaggacctcggcagagccaagaggtttctgcggaagtcactgggtcccttggggatcgggcctcttcatggaagatagatgcccagagaaaatggctaacaccttcagtagcgtggctcctgctccaccttcagctctttatctctcagcctcctctgtcccttggagccttcttcccttcctttaactcagaggcggggagggaacagaggccgtgagccctgcccatgcctcatcagctgtggtcacctcacaagccaatgtacacttggagaaggcacaccatggtacctccatgctcctttagtgcactgtggaagctcaataaatactccaatc

SEQ ID NO: 21230 - DNA, 7156 bp, Homo sapiens
atcggaggggggtcgggaggaggaggaggaggcagcggcagagaagagagaggcgtgtgagccgtgctccaccggctagctccttcccgctgctcctgcctggcagtgccaggcagcccacaccagcatggccttgctcatccacctcaagacagtctcggagctgcggggcaggggcgaccggatcgccaaagtgactttccgagggcaatccttctactctcgggtcctggagaactgtgaggatgtggctgactttgatgagacatttcggtggccggtggccagcagcatcgacagaaatgagatgctggagattcaggttttcaactacagcaaagtcttcagcaacaagctcatcgggaccttccgcatggtgctgcagaaggtggtagaggagagccatgtggaggtgactgacacgctgattgatgacaacaatgctatcatcaagaccagcctgtgcgtggaggtccggtatcaggccactgacggcacagtgggctcctgggacgatggggacttcctgggagatgagtctcttcaagaggaagagaaggacagccaagagacggatggactgctcccaggctcccggcccagctcccggcccccaggagagaagagcttccggagagccgggaggagcgtgttctccgccatgaagctcggcaaaaaccggtctcacaaggaggagccccaaagaccagatgaaccggcggtgctggagatggaagaccttgaccatctggccattcggctaggagatggactggatcccgactcggtgtctctagcctcagtcacagctctcaccactaatgtctccaacaagcgatctaagccagacattaagatggagccaagtgctgggcggcccatggattaccaggtcagcatcacggtgatcgaggcccggcagctggtgggcttgaacatggaccctgtggtgtgcgtggaggtgggtgacgacaagaagtacacatccatgaaggagtccactaactgcccctattacaacgagtacttcgtcttcgacttccatgtctctccggatgtcatgtttgacaagatcatcaagatttcggtgattcactccaagaacctgctgcgcagtggcaccctggtgggctccttcaaaatggacgtgggaaccgtgtactcgcagccagagcaccagttccatcacaagtgggccatcctgtctgaccccgatgacatctcctcggggctgaagggctacgtgaagtgtgacgttgccgtggtgggcaaaggggacaacatcaagacgccccacaaggccaatgagaccgacgaagatgacattgaggggaacttgctgctccccgagggggtgccccccgaacgccagtgggcccggttctatgtgaaaatttaccgagcagaggggctgccccgtatgaacacaagcctcatggccaatgtaaagaaggctttcatcggtgaaaacaaggacctcgtggacccctacgtgcaagtcttctttgctggccagaagggcaagacttcagtgcagaagagcagctatgagcccctgtggaatgagcaggtcgtctttacagacctcttccccccactctgcaaacgcatgaaggtgcagatccgagactcggacaaggtcaacgacgtggccatcggcacccacttcattgacctgcgcaagatttctaatgacggagacaaaggcttcctgcccacactgggcccagcctgggtgaacatgtacggctccacacgtaactacacgctgctggatgagcatcaggacctgaacgagggcctgggggagggtgtgtccttccgggcccggctcctgctgggcctggctgtggagatcgtagacacctccaaccctgagctcaccagctccacagaggtgcaggtggagcaggccacgcccatctcggagagctgtgcaggtaaaatggaagaattctttctctttggagccttcctggaggcctcaatgatcgaccggagaaacggagacaagcccatcacctttgaggtcaccataggcaactatgggaacgaagttgatggcctgtcccggccccagcggcctcggccccggaaggagccgggggatgaggaagaagtagacctgattcagaacgcaagtgatgacgaggccggtgatgccggggacctggcctcagtctcctccactccaccaatgcggccccaggtcaccgacaggaactacttccatctgccctacctggagcgaaagccctgcatctacatcaagagctggtggccggaccagcgccgccgcctctacaatgccaacatcatggaccacattgccgacaagctggaagaaggcctgaacgacatacaggagatgatcaaaacggagaagtcctaccctgagcgtcgcctgcggggcgtcctggaggagctgagctgtggctgctgccgcttcctctccctcgctgacaaggaccagggccactcatcccgcaccaggcttgaccgggagcgcctcaagtcctgcatgagggagctggaaaacatggggcagcaggccaggatgctgcgggcccaggtgaagcggcacacggtgcgggacaagctgaggctgtgccagaacttcctgcagaagctgcgcttcctggcggacgagccccagcacagcattcccgacatcttcatctggatgatgagcaacaacaagcgtgtcgcctatgcccgtgtgccctccaaggacctgctcttctccatcgtggaggaggagactggcaaggactgcgccaaggtcaagacgctcttccttaagctgccagggaagcggggcttcggctcggcaggctggacagtgcaggccaaggtggagctgtacctgtggctgggcctcagcaaacagcgcaaggagttcctgtgcggcctgccctgtggcttccaggaggtcaaggcagcccagggcctgggcctgcatgccttcccacccgtcagcctggtctacaccaagaagcaggcgttccagctccgagcgcacatgtaccaggcccgcagcctctttgccgccgacagcagcggactctcagacccctttgcccgcgtcttcttcatcaatcagagtcagtgcacagaggtgctgaatgagaccctgtgtcccacctgggaccagatgctggtgttcgacaacctggagctctatggtgaagctcatgagctgagggacgatccgcccatcattgtcattgaaatctatgaccaggattccatgggcaaagctgacttcatgggccggaccttcgccaaacccctggtgaagatggcagacgaggcgtactgcccaccccgcttcccacctcagctcgagtactaccagatctaccgtggcaacgccacagctggagacctgctggcggccttcgagctgctgcagattggaccagcagggaaggctgacctgccccccatcaatggcccggtggacgtggaccgaggtcccatcatgcccgtgcccatgggcatccggcccgtgctcagcaagtaccgagtggaggtgctgttctggggcctacgggacctaaagcgggtgaacctggcccaggtggaccggccacgggtggacatcgagtgtgcagggaagggggtgcagtcgtccctgatccacaattataagaagaaccccaacttcaacaccctcgtcaagtggtttgaagtggacctcccagagaacgagctgctgcacccgcccttgaacatccgtgtggtggactgccgggccttcggtcgctacacactggtgggctcccatgccgtcagctccctgcgacgcttcatctaccggcccccagaccgctcggcccccagctggaacaccacggtcaggcttctccggcgctgccgtgtgctgtgcaatgggggctcctcctctcactccacaggggaggttgtggtgactatggagccagaggtacccatcaagaaactggagaccatggtgaagctggacgcgacttctgaagctgttgtcaaggtggatgtggctgaggaggagaaggagaagaagaagaagaagaagggcactgcggaggagccagaggaggaggagccagacgagagcatgctggactggtggtccaagtactttgcctccattgacaccatgaaggagcaacttcgacaacaagagccctctggaattgacttggaggagaaggaggaagtggacaataccgagggcctgaaggggtcaatgaagggcaaggagaaggcaagggctgccaaagaggagaagaagaagaaaactcagagctctggctctggccaggggtccgaggcccccgagaagaagaaacccaagattgatgagcttaaggtataccccaaagagctggagtccgagtttgataactttgaggactggctgcacactttcaacttgcttcggggcaagaccggggatgatgaggatggctccaccgaggaggagcgcattgtgggacgcttcaagggctccctctgcgtgtacaaagtgccactcccagaggacgtgtcccgggaagccggctacgactccacctacggcatgttccagggcatcccgagcaatgaccccatcaatgtgctggtccgagtctatgtggtccgggccacggacctgcaccctgctgacatcaacggcaaagctgacccctacatcgccatccggctaggcaagactgacatccgcgacaaggagaactacatctccaagcagctcaaccctgtctttgggaagtcctttgacatcgaggcctccttccccatggaatccatgctgacggtggctgtgtatgactgggacctggtgggcactgatgacctcattggggaaaccaagatcgacctggagaaccgcttctacagcaagcaccgcgccacctgcggcatcgcccagacctactccacacatggctacaatatctggcgggaccccatgaagcccagccagatcctgacccgcctctgcaaagacggcaaagtggacggcccccactttgggccccctgggagagtgaaggtggccaaccgcgtcttcactgggccctctgagattgaggacgagaacggtcagaggaagcccacagacgagcatgtggcgctgttggccctgaggcactgggaggacatcccccgcgcaggctgccgcctggtgccagagcatgtggagacgaggccgctgctcaaccccgacaagccgggcatcgagcagggccgcctggagctgtgggtggacatgttccccatggacatgccagcccctgggacgcctctggacatctcacctcggaagcccaagaagtacgagctgcgggtcatcatctggaacacagatgaggtggtcttggaggacgacgacttcttcacaggggagaagtccagtgacatcttcgtgagggggtggctgaagggccagcaggaggacaagcaggacacagacgtccactaccactccctcactggcgagggcaacttcaactggcgctacctgttccccttcgactacctggcggcggaggagaagatcgtcatctccaagaaggagtccatgttctcctgggacgagaccgagtacaagatccccgcgcggctcaccctgcagatctgggatgcggaccacttctccgctgacgacttcctgggggccatcgagctggacctgaaccggttcccgcggggcgcaaagacagccaagcagtgcaccatggagatggccaccggggaggtggacgtgcccctcgtgtccatcttcaagcaaaagcgcgtcaaaggctggtggcccctcctggcccgcaatgagaacgatgagtttgagctcacgggcaaggtggaggctgagctgcatttactgacagcagaggaggcagagaagaacccagtgggcctggcccgcaatgaacctgaccccctagagaaacccaaccggcccgacacgagcttcatctggttcctgaaccctctcaagtcggctcgctacttcttgtggcacacgtatcgctggctgctcctcaaactgttgctgctcctgctgctgctcctcctcctcgccctgttcctctactctgtgcctggctacctggtcaagaaaatcctcggggcctgagcccagtggcctcctggccggcccgacacggccttcgtctggttcctcaaccctctcaagtccatcaagtacctcatctgcacccggtacaagtggctcatcatcaagatcgtgctggcgctgttggggctgctcatgttggggctcttcctctacagcctccctggctacatggtcaaaaagctccttggggcatgaaggccgccagctcccgccagccgctccccagccctgccgcatttcctttcagtggcttggactctttcccatctcccctggggagcctgaggagcccagcgtccactcttcatgccttgggccgagcctgcctcctgcttgcgggggccgcctgtcctcactgccccaggctgcggcttgcccagtcccgcccctctgacccctgcctgtgggctggggagccttggatggggtggggacctggaatgggtctctcttgccccacctggctgaggcgccacccttcttcaggcccaggctccagaggaagactcctgaaaccctccccaggtcttccaagtacaggattgaagctttagtgaaattaaccaaggaccatgggtcagtgcccagggctttaaaaagaatgaacgagcaaaaggtatccccgccgtgacccctgcagatagcaccggtctttgatccgcagcaggggccagaccctgcccacaagtcccagcgcggctgcttctgccactgctgggctccacttggctcctctcacttcccagggggtcgcctgtcctgcctgtgggtttccatggcttcccagagctccctctgccccagccagcgcctccaggcccagctgaggagctgtgagaagcagcagaggggactccccatcccgggcacaccctgtcctcccacccctgcccccttgcccttccagccctttcagctgcagctgggagctggcccgtcaagtgctgcccctgcctgtgtctgggtttctgttggctgtttttcttttcttgagtggtgatttttctctaaataaaagaagtcaagcactga

SEQ ID NO: 21231 - DNA, 4954 bp, Homo sapiens
ccgtgagttctgcccaggccctgtgagctcaccagagccacagactcacagcccagaggtggcttcttccttcaggaactgaagaacccccatgaacaccaacatctccaggttctgagaacagaacctgggaaattgatgacttcctcatgatgaccgatactcaggatggccctagcgagagctcccagatcatgaggaagaaggcctgaacgacatacaggagatgatcaaaacggagaagtcctaccctgagcgtcgcctgcggggcgtcctggaggagctgagctgtggctgctgccgcttcctctccctcgctgacaaggaccagggccactcatcccgcaccaggcttgaccgggagcgcctcaagtcctgcatgagggagctggaaaacatggggcagcaggccaggatgctgcgggcccaggtgaagcggcacacggtgcgggacaagctgaggctgtgccagaacttcctgcagaagctgcgcttcctggcggacgagccccagcacagcattcccgacatcttcatctggatgatgagcaacaacaagcgtgtcgcctatgcccgtgtgccctccaaggacctgctcttctccatcgtggaggaggagactggcaaggactgcgccaaggtcaagacgctcttccttaagctgccagggaagcggggcttcggctcggcaggctggacagtgcaggccaaggtggagctgtacctgtggctgggcctcagcaaacagcgcaaggagttcctgtgcggcctgccctgtggcttccaggaggtcaaggcagcccagggcctgggcctgcatgccttcccacccgtcagcctggtctacaccaagaagcaggcgttccagctccgagcgcacatgtaccaggcccgcagcctctttgccgccgacagcagcggactctcagacccctttgcccgcgtcttcttcatcaatcagagtcagtgcacagaggtgctgaatgagaccctgtgtcccacctgggaccagatgctggtgttcgacaacctggagctctatggtgaagctcatgagctgagggacgatccgcccatcattgtcattgaaatctatgaccaggattccatgggcaaagctgacttcatgggccggaccttcgccaaacccctggtgaagatggcagacgaggcgtactgcccaccccgcttcccacctcagctcgagtactaccagatctaccgtggcaacgccacagctggagacctgctggcggccttcgagctgctgcagattggaccagcagggaaggctgacctgccccccatcaatggcccggtggacgtggaccgaggtcccatcatgcccgtgcccatgggcatccggcccgtgctcagcaagtaccgagtggaggtgctgttctggggcctacgggacctaaagcgggtgaacctggcccaggtggaccggccacgggtggacatcgagtgtgcagggaagggggtgcagtcgtccctgatccacaattataagaagaaccccaacttcaacaccctcgtcaagtggtttgaagtggacctcccagagaacgagctgctgcacccgcccttgaacatccgtgtggtggactgccgggccttcggtcgctacacactggtgggctcccatgccgtcagctccctgcgacgcttcatctaccggcccccagaccgctcggcccccagctggaacaccacgggggaggttgtggtgactatggagccagaggtacccatcaagaaactggagaccatggtgaagctggacgcgacttctgaagctgttgtcaaggtggatgtggctgaggaggagaaggagaagaagaagaagaagaagggcactgcggaggagccagaggaggaggagccagacgagagcatgctggactggtggtccaagtactttgcctccattgacaccatgaaggagcaacttcgacaacaagagccctctggaattgacttggaggagaaggaggaagtggacaataccgagggcctgaaggggtcaatgaagggcaaggagaaggcaagggctgccaaagaggagaagaagaagaaaactcagagctctggctctggccaggggtccgaggcccccgagaagaagaaacccaagattgatgagcttaaggtataccccaaagagctggagtccgagtttgataactttgaggactggctgcacactttcaacttgcttcggggcaagaccggggatgatgaggatggctccaccgaggaggagcgcattgtgggacgcttcaagggctccctctgcgtgtacaaagtgccactcccagaggacgtgtcccgggaagccggctacgactccacctacggcatgttccagggcatcccgagcaatgaccccatcaatgtgctggtccgagtctatgtggtccgggccacggacctgcaccctgctgacatcaacggcaaagctgacccctacatcgccatccggctaggcaagactgacatccgcgacaaggagaactacatctccaagcagctcaaccctgtctttgggaagtcctttgacatcgaggcctccttccccatggaatccatgctgacggtggctgtgtatgactgggacctggtgggcactgatgacctcattggggaaaccaagatcgacctggagaaccgcttctacagcaagcaccgcgccacctgcggcatcgcccagacctactccacacatggctacaatatctggcgggaccccatgaagcccagccagatcctgacccgcctctgcaaagacggcaaagtggacggcccccactttgggccccctgggagagtgaaggtggccaaccgcgtcttcactgggccctctgagattgaggacgagaacggtcagaggaagcccacagacgagcatgtggcgctgttggccctgaggcactgggaggacatcccccgcgcaggctgccgcctggtgccagagcatgtggagacgaggccgctgctcaaccccgacaagccgggcatcgagcagggccgcctggagctgtgggtggacatgttccccatggacatgccagcccctgggacgcctctggacatctcacctcggaagcccaagaagtacgagctgcgggtcatcatctggaacacagatgaggtggtcttggaggacgacgacttcttcacaggggagaagtccagtgacatcttcgtgagggggtggctgaagggccagcaggaggacaagcaggacacagacgtccactaccactccctcactggcgagggcaacttcaactggcgctacctgttccccttcgactacctggcggcggaggagaagatcgtcatctccaagaaggagtccatgttctcctgggacgagaccgagtacaagatccccgcgcggctcaccctgcagatctgggatgcggaccacttctccgctgacgacttcctgggggccatcgagctggacctgaaccggttcccgcggggcgcaaagacagccaagcagtgcaccatggagatggccaccggggaggtggacgtgcccctcgtgtccatcttcaagcaaaagcgcgtcaaaggctggtggcccctcctggcccgcaatgagaacgatgagtttgagctcacgggcaaggtggaggctgagctgcatttactgacagcagaggaggcagagaagaacccagtgggcctggcccgcaatgaacctgaccccctagagaaacccaaccggcccgacacgagcttcatctggttcctgaaccctctcaagtcggctcgctacttcttgtggcacacgtatcgctggctgctcctcaaactgttgctgctcctgctgctgctcctcctcctcgccctgttcctctactctgtgcctggctacctggtcaagaaaatcctcggggcctgagcccagtggcctcctggccggcccgacacggccttcgtctggttcctcaaccctctcaagtccatcaagtacctcatctgcacccggtacaagtggctcatcatcaagatcgtgctggcgctgttggggctgctcatgttggggctcttcctctacagcctccctggctacatggtcaaaaagctccttggggcatgaaggccgccagctcccgccagccgctccccagccctgccgcatttcctttcagtggcttggactctttcccatctcccctggggagcctgaggagcccagcgtccactcttcatgccttgggccgagcctgcctcctgcttgcgggggccgcctgtcctcactgccccaggctgcggcttgcccagtcccgcccctctgacccctgcctgtgggctggggagccttggatggggtggggacctggaatgggtctctcttgccccacctggctgaggcgccacccttcttcaggcccaggctccagaggaagactcctgaaaccctccccaggtcttccaagtacaggattgaagctttagtgaaattaaccaaggaccatgggtcagtgcccagggctttaaaaagaatgaacgagcaaaaggtatccccgccgtgacccctgcagatagcaccggtctttgatccgcagcaggggccagaccctgcccacaagtcccagcgcggctgcttctgccactgctgggctccacttggctcctctcacttcccagggggtcgcctgtcctgcctgtgggtttccatggcttcccagagctccctctgccccagccagcgcctccaggcccagctgaggagctgtgagaagcagcagaggggactccccatcccgggcacaccctgtcctcccacccctgcccccttgcccttccagccctttcagctgcagctgggagctggcccgtcaagtgctgcccctgcctgtgtctgggtttctgttggctgtttttcttttcttgagtggtgatttttctctaaataaaagaagtcaagcactga

SEQ ID NO: 21232 - DNA, 4756 bp, Homo sapiens
ccgtgagttctgcccaggccctgtgagctcaccagagccacagactcacagcccagaggtggcttcttccttcaggaactgaagaacccccatgaacaccaacatctccaggttctgagaacagaacctgggaaattgatgacttcctcatgatgaccgatactcaggatggccctagcgagagctcccagatcatgaggaagaaggcctgaacgacatacaggagatgatcaaaacggagaagtcctaccctgagcgtcgcctgcggggcgtcctggaggagctgagctgtggctgctgccgcttcctctccctcgctgacaaggaccagggccactcatcccgcaccaggcttgaccgggagcgcctcaagtcctgcatgagggagctggaaaacatggggcagcaggccaggatgctgcgggcccaggtgaagcggcacacggtgcgggacaagctgaggctgtgccagaacttcctgcagaagctgcgcttcctggcggacgagccccagcacagcattcccgacatcttcatctggatgatgagcaacaacaagcgtgtcgcctatgcccgtgtgccctccaaggacctgctcttctccatcgtggaggaggagactggcaaggactgcgccaaggtcaagacgctcttccttaagctgccagggaagcggggcttcggctcggcaggctggacagtgcaggccaaggtggagctgtacctgtggctgggcctcagcaaacagcgcaaggagttcctgtgcggcctgccctgtggcttccaggaggtcaaggcagcccagggcctgggcctgcatgccttcccacccgtcagcctggtctacaccaagaagcaggcgttccagctccgagcgcacatgtaccaggcccgcagcctctttgccgccgacagcagcggactctcagacccctttgcccgcgtcttcttcatcaatcagagtcagtgcacagaggtgctgaatgagaccctgtgtcccacctgggaccagatgctggtgttcgacaacctggagctctatggtgaagctcatgagctgagggacgatccgcccatcattgtcattgaaatctatgaccaggattccatgggcaaagctgacttcatgggccggaccttcgccaaacccctggtgaagatggcagacgaggcgtactgcccaccccgcttcccacctcagctcgagtactaccagatctaccgtggcaacgccacagctggagacctgctggcggccttcgagctgctgcagattggaccagcagggaaggctgacctgccccccatcaatggcccggtggacgtggaccgaggtcccatcatgcccgtgcccatgggcatccggcccgtgctcagcaagtaccgagtggaggtgctgttctggggcctacgggacctaaagcgggtgaacctggcccaggtggaccggccacgggtggacatcgagtgtgcagggaagggggtgcagtcgtccctgatccacaattataagaagaaccccaacttcaacaccctcgtcaagtggtttgaagtggacctcccagagaacgagctgctgcacccgcccttgaacatccgtgtggtggactgccgggccttcggtcgctacacactggtgggctcccatgccgtcagctccctgcgacgcttcatctaccggcccccagaccgctcggcccccagctggaacaccacgggggaggttgtggtgactatggagccagaggtacccatcaagaaactggagaccatggtgaagctggacgcgacttctgaagctgttgtcaaggtggatgtggctgaggaggagaaggagaagaagaagaagaagaagggcactgcggaggagccagaggaggaggagccagacgagagcatgctggactggtggtccaagtactttgcctccattgacaccatgaaggagcaacttcgacaacaagagccctctggaattgacttggaggagaaggaggaagtggacaataccgagggcctgaaggggtcaatgaagggcaaggagaaggcaagggctgccaaagaggagaagaagaagaaaactcagagctctggctctggccaggggtccgaggcccccgagaagaagaaacccaagattgatgagcttaaggtataccccaaagagctggagtccgagtttgataactttgaggactggctgcacactttcaacttgcttcggggcaagaccggggatgatgaggatggctccaccgaggaggagcgcattgtgggacgcttcaagggctccctctgcgtgtacaaagtgccactcccagaggacgtgtcccgggaagccggctacgactccacctacggcatgttccagggcatcccgagcaatgaccccatcaatgtgctggtccgagtctatgtggtccgggccacggacctgcaccctgctgacatcaacggcaaagctgacccctacatcgccatccggctaggcaagactgacatccgcgacaaggagaactacatctccaagcagctcaaccctgtctttgggaagtcctttgacatcgaggcctccttccccatggaatccatgctgacggtggctgtgtatgactgggacctggtgggcactgatgacctcattggggaaaccaagatcgacctggagaaccgcttctacagcaagcaccgcgccacctgcggcatcgcccagacctactccacacatggctacaatatctggcgggaccccatgaagcccagccagatcctgacccgcctctgcaaagacggcaaagtggacggcccccactttgggccccctgggagagtgaaggtggccaaccgcgtcttcactgggccctctgagattgaggacgagaacggtcagaggaagcccacagacgagcatgtggcgctgttggccctgaggcactgggaggacatcccccgcgcaggctgccgcctggtgccagagcatgtggagacgaggccgctgctcaaccccgacaagccgggcatcgagcagggccgcctggagctgtgggtggacatgttccccatggacatgccagcccctgggacgcctctggacatctcacctcggaagcccaagaagtacgagctgcgggtcatcatctggaacacagatgaggtggtcttggaggacgacgacttcttcacaggggagaagtccagtgacatcttcgtgagggggtggctgaagggccagcaggaggacaagcaggacacagacgtccactaccactccctcactggcgagggcaacttcaactggcgctacctgttccccttcgactacctggcggcggaggagaagatcgtcatctccaagaaggagtccatgttctcctgggacgagaccgagtacaagatccccgcgcggctcaccctgcagatctgggatgcggaccacttctccgctgacgacttcctgggggccatcgagctggacctgaaccggttcccgcggggcgcaaagacagccaagcagtgcaccatggagatggccaccggggaggtggacgtgcccctcgtgtccatcttcaagcaaaagcgcgtcaaaggctggtggcccctcctggcccgcaatgagaacgatgagtttgagctcacgggcaaggtggaggctgagctgcatttactgacagcagaggaggcagagaagaacccagtgggcctggcccgcaatgaacctgaccccctagagaaacccaaccggcccgacacggccttcgtctggttcctcaaccctctcaagtccatcaagtacctcatctgcacccggtacaagtggctcatcatcaagatcgtgctggcgctgttggggctgctcatgttggggctcttcctctacagcctccctggctacatggtcaaaaagctccttggggcatgaaggccgccagctcccgccagccgctccccagccctgccgcatttcctttcagtggcttggactctttcccatctcccctggggagcctgaggagcccagcgtccactcttcatgccttgggccgagcctgcctcctgcttgcgggggccgcctgtcctcactgccccaggctgcggcttgcccagtcccgcccctctgacccctgcctgtgggctggggagccttggatggggtggggacctggaatgggtctctcttgccccacctggctgaggcgccacccttcttcaggcccaggctccagaggaagactcctgaaaccctccccaggtcttccaagtacaggattgaagctttagtgaaattaaccaaggaccatgggtcagtgcccagggctttaaaaagaatgaacgagcaaaaggtatccccgccgtgacccctgcagatagcaccggtctttgatccgcagcaggggccagaccctgcccacaagtcccagcgcggctgcttctgccactgctgggctccacttggctcctctcacttcccagggggtcgcctgtcctgcctgtgggtttccatggcttcccagagctccctctgccccagccagcgcctccaggcccagctgaggagctgtgagaagcagcagaggggactccccatcccgggcacaccctgtcctcccacccctgcccccttgcccttccagccctttcagctgcagctgggagctggcccgtcaagtgctgcccctgcctgtgtctgggtttctgttggctgtttttcttttcttgagtggtgatttttctctaaataaaagaagtcaagcactga

SEQ ID NO: 21233 - DNA, 231 bp, Homo sapiens
gaggcagagaagaacccagtgggcctggcccgcaatgaacctgaccccctagagaaacccaaccggcccgacacggccttcgtctggttcctcaaccctctcaagtccatcaagtacctcatctgcacccggtacaagtggctcatcatcaagatcgtgctggcgctgggctgctcatgttggggccctctacagcctccctggctacatggtcaaaaagctccttggggc

SEQ ID NO: 21234 - DNA, 340 bp, Homo sapiens
ggacttcctgggagatgagtctcttcaagaggaagagaaggacagccaagagacggatggactgctcccaggctcccggcccagctcccggcccccaggagagaagagcttccggagcaaaggcagagagaagaccaagggaggcagagatgacgagcacaaagccgggaggagcgtgttctccgccatgaagctcggcaaaaaccggtctcacaaggaggagccccaaagaccagatgaaccggcggtgctggagatggaagaccttgaccatctggccattcggctaggagatggactggatcccgactcggtgtctctagcctcagtcacagctctc

SEQ ID NO: 21235 - DNA, 5108 bp, Homo sapiens
ccgtgagttctgcccaggccctgtgagctcaccagagccacagactcacagcccagaggtggcttcttccttcaggaactgaagaacccccatgaacaccaacatctccaggttctgagaacagaacctgggaaattgatgacttcctcatgatgaccgatactcaggatggccctagcgagagctcccagatcatgaggtccctcactcccctgatcaacagggaggaggcatttggggaggctggggaggcggggctgtggcccagcatcacccacactcctgattcacaggaagaaggcctgaacgacatacaggagatgatcaaaacggagaagtcctaccctgagcgtcgcctgcggggcgtcctggaggagctgagctgtggctgctgccgcttcctctccctcgctgacaaggaccagggccactcatcccgcaccaggcttgaccgggagcgcctcaagtcctgcatgagggagctggaaaacatggggcagcaggccaggatgctgcgggcccaggtgaagcggcacacggtgcgggacaagctgaggctgtgccagaacttcctgcagaagctgcgcttcctggcggacgagccccagcacagcattcccgacatcttcatctggatgatgagcaacaacaagcgtgtcgcctatgcccgtgtgccctccaaggacctgctcttctccatcgtggaggaggagactggcaaggactgcgccaaggtcaagacgctcttccttaagctgccagggaagcggggcttcggctcggcaggctggacagtgcaggccaaggtggagctgtacctgtggctgggcctcagcaaacagcgcaaggagttcctgtgcggcctgccctgtggcttccaggaggtcaaggcagcccagggcctgggcctgcatgccttcccacccgtcagcctggtctacaccaagaagcaggcgttccagctccgagcgcacatgtaccaggcccgcagcctctttgccgccgacagcagcggactctcagacccctttgcccgcgtcttcttcatcaatcagagtcagtgcacagaggtgctgaatgagaccctgtgtcccacctgggaccagatgctggtgttcgacaacctggagctctatggtgaagctcatgagctgagggacgatccgcccatcattgtcattgaaatctatgaccaggattccatgggcaaagctgacttcatgggccggaccttcgccaaacccctggtgaagatggcagacgaggcgtactgcccaccccgcttcccacctcagctcgagtactaccagatctaccgtggcaacgccacagctggagacctgctggcggccttcgagctgctgcagattggaccagcagggaaggctgacctgccccccatcaatggcccggtggacgtggaccgaggtcccatcatgcccgtgcccatgggcatccggcccgtgctcagcaagtaccgagtggaggtgctgttctggggcctacgggacctaaagcgggtgaacctggcccaggtggaccggccacgggtggacatcgagtgtgcagggaagggggtgcagtcgtccctgatccacaattataagaagaaccccaacttcaacaccctcgtcaagtggtttgaagtggacctcccagagaacgagctgctgcacccgcccttgaacatccgtgtggtggactgccgggccttcggtcgctacacactggtgggctcccatgccgtcagctccctgcgacgcttcatctaccggcccccagaccgctcggcccccagctggaacaccacggtcaggcttctccggcgctgccgtgtgctgtgcaatgggggctcctcctctcactccacaggggaggttgtggtgactatggagccagaggtacccatcaagaaactggagaccatggtgaagctggacgcgacttctgaagctgttgtcaaggtggatgtggctgaggaggagaaggagaagaagaagaagaagaagggcactgcggaggagccagaggaggaggagccagacgagagcatgctggactggtggtccaagtactttgcctccattgacaccatgaaggagcaacttcgacaacaagagccctctggaattgacttggaggagaaggaggaagtggacaataccgagggcctgaaggggtcaatgaagggcaaggagaaggcaagggctgccaaagaggagaagaagaagaaaactcagagctctggctctggccaggggtccgaggcccccgagaagaagaaacccaagattgatgagcttaaggtataccccaaagagctggagtccgagtttgataactttgaggactggctgcacactttcaacttgcttcggggcaagaccggggatgatgaggatggctccaccgaggaggagcgcattgtgggacgcttcaagggctccctctgcgtgtacaaagtgccactcccagaggacgtgtcccgggaagccggctacgactccacctacggcatgttccagggcatcccgagcaatgaccccatcaatgtgctggtccgagtctatgtggtccgggccacggacctgcaccctgctgacatcaacggcaaagctgacccctacatcgccatccggctaggcaagactgacatccgcgacaaggagaactacatctccaagcagctcaaccctgtctttgggaagtcctttgacatcgaggcctccttccccatggaatccatgctgacggtggctgtgtatgactgggacctggtgggcactgatgacctcattggggaaaccaagatcgacctggagaaccgcttctacagcaagcaccgcgccacctgcggcatcgcccagacctactccacacatggctacaatatctggcgggaccccatgaagcccagccagatcctgacccgcctctgcaaagacggcaaagtggacggcccccactttgggccccctgggagagtgaaggtggccaaccgcgtcttcactgggccctctgagattgaggacgagaacggtcagaggaagcccacagacgagcatgtggcgctgttggccctgaggcactgggaggacatcccccgcgcaggctgccgcctggtgccagagcatgtggagacgaggccgctgctcaaccccgacaagccgggcatcgagcagggccgcctggagctgtgggtggacatgttccccatggacatgccagcccctgggacgcctctggacatctcacctcggaagcccaagaagtacgagctgcgggtcatcatctggaacacagatgaggtggtcttggaggacgacgacttcttcacaggggagaagtccagtgacatcttcgtgagggggtggctgaagggccagcaggaggacaagcaggacacagacgtccactaccactccctcactggcgagggcaacttcaactggcgctacctgttccccttcgactacctggcggcggaggagaagatcgtcatctccaagaaggagtccatgttctcctgggacgagaccgagtacaagatccccgcgcggctcaccctgcagatctgggatgcggaccacttctccgctgacgacttcctgggggccatcgagctggacctgaaccggttcccgcggggcgcaaagacagccaagcagtgcaccatggagatggccaccggggaggtggacgtgcccctcgtgtccatcttcaagcaaaagcgcgtcaaaggctggtggcccctcctggcccgcaatgagaacgatgagtttgagctcacgggcaaggtggaggctgagctgcatttactgacagcagaggaggcagagaagaacccagtgggcctggcccgcaatgaacctgaccccctagagaaacccaaccggcccgacacgagcttcatctggttcctgaaccctctcaagtcggctcgctacttcttgtggcacacgtatcgctggctgctcctcaaactgttgctgctcctgctgctgctcctcctcctcgccctgttcctctactctgtgcctggctacctggtcaagaaaatcctcggggcctgagcccagtggcctcctggccggcccgacacggccttcgtctggttcctcaaccctctcaagtccatcaagtacctcatctgcacccggtacaagtggctcatcatcaagatcgtgctggcgctgttggggctgctcatgttggggctcttcctctacagcctccctggctacatggtcaaaaagctccttggggcatgaaggccgccagctcccgccagccgctccccagccctgccgcatttcctttcagtggcttggactctttcccatctcccctggggagcctgaggagcccagcgtccactcttcatgccttgggccgagcctgcctcctgcttgcgggggccgcctgtcctcactgccccaggctgcggcttgcccagtcccgcccctctgacccctgcctgtgggctggggagccttggatggggtggggacctggaatgggtctctcttgccccacctggctgaggcgccacccttcttcaggcccaggctccagaggaagactcctgaaaccctccccaggtcttccaagtacaggattgaagctttagtgaaattaaccaaggaccatgggtcagtgcccagggctttaaaaagaatgaacgagcaaaaggtatccccgccgtgacccctgcagatagcaccggtctttgatccgcagcaggggccagaccctgcccacaagtcccagcgcggctgcttctgccactgctgggctccacttggctcctctcacttcccagggggtcgcctgtcctgcctgtgggtttccatggcttcccagagctccctctgccccagccagcgcctccaggcccagctgaggagctgtgagaagcagcagaggggactccccatcccgggcacaccctgtcctcccacccctgcccccttgcccttccagccctttcagctgcagctgggagctggcccgtcaagtgctgcccctgcctgtgtctgggtttctgttggctgtttttcttttcttgagtggtgatttttctctaaataaaagaagtcaagcactga

SEQ ID NO: 21236 - DNA, 4992 bp, Homo sapiens
aggagacttccgagcccgtctctccctccatcctccagctgctgcccctgtagcccaggagcccatactgaggccccagggcctccgctcccatcttcttctcttccagctgctgcctgcccagcaggccaggtcttcgtgaactgcagcgacctgcacacggacctggagctgagcagggagaggacgtgtgagcagcaactgctgaacctgagcgtgtcagcccgtggcccctgcctctcgggctgcgcctgtccccagggtctgctcagacacggggatgcatgtttcctgccagaggagtgcccctgcacttggaaggggaaggagtatttccctggggaccaggtgatgtctccttgccatacctgagcacatcagatgtcagcttctctgtgattgtagagaatgtgaactgctacagctctggcatgatctgcaggaaatttatttccatcaacgttgggaactcactcattgtctttgatgatgactccggaaatcctagtccagagagcttcctggatgacaagcaggaggtccacacatggcgagtgggatttttcacactggtgcatttcccacaggagcacatcaccctcttgtgggaccagagaaccacagtgcacgtccaggctgggcctcagtggcagggccagctggcgggcctctgtgggaactttgacttaaaaaccatcaatgagatgaggaccccggagaacctagagctaactaacccccaggagtttggcagcagttgggctgcagttgagtgcccagacaccctcgatcctcgggatatgtgtgtcctgaatcctctccgagaaccatttgccaagaaggagtgcagcatcctgctcagtgaggtgtttgagatctgccaccctgtggttgatgtcacttggttttactcaaactgcctgacagacacatgtggctgcagccagggtggtgactgtgagtgcttctgtgccagcgtctccgcttatgcccaccagtgttgccagcatggggtggctgttgactggcgaaccccccgcctctgcctgctaggtaagggcccctatcagctatccagcttggcagccggtggtgctctggtgggcatgaaggcggtgggcgatgacatagtcctagtgaggacagaggatgtggcgccagcagacattgtgagcttcctgctgacagctgctctgtacaaggccaaggcccatgacccagatgtggtgtccctggaggcagcagacagacccaacttcttccttcacgtcacagccaacgggtctctggagctggctaagtggcagggccgtgacaccttccaacagcatgcctccttcttgctgcaccgggggacacggcaggcaggcctggtggccctggagtccctggccaagcccagctccttcctctatgtgtcgggcgcggtgctggccctgcggctgtacgaacacacagaggtgttccgccggggcacactcttccgccttctggatgccaagccctcgggggctgcctaccccatctgcgagtggcgctacgatgcctgtgccagcccctgcttccaaacctgccgggacccacgggcagccagctgccgggacgtacccagggtagaaggctgtgtccctgtgtgccccaccccccaggtcctggatgaagtcacacagagatgtgtctacttggaggactgtgtggagccagcagtttgggttcccacagaggcccttggcaatgagaccctccctcccagtcaagggttgcccactcccagtgatgaggagccacagctgtcacaggaaagccccaggacccccacccacaggccagccctcaccccagctgccccactcaccacagccctgaacccaccagtgacagccactgaggagccagtggtgtctccaggccccacccagaccaccctgcagcagccactggagctcactgcatctcaactccccgccggccccacggagtccccagccagcaagggagtgactgccagcctcctggccatcccccatacaccagagtcctcatccctccctgttgcactgcagacacccacacctggcatggtgtcaggtgccatggagacaacaagggtgactgtgatctttgcaggaagccctaacatcacagtctcctcccggtcgccccctgcccctcgcttcccgctcatgaccaaggctgtgacagtccgaggccatggctccttgcctgttaggacgacacccccacagccctccttgacagcaagtccctcctccagacctgtggcttcccctggagccatctccaggtcccccacctcctcgggatcccacaaggctgtgctgacacctgcagtaactaaggtcataagcaggacaggggtcccccagcccacccaggcccagagtgcttcaagtcccagcacccctctaactgtggctggaacagcagcagaacaggttcctgtcagtccccttgcaaccaggagcttggagatagtgctatccacagagaagggcgaagccgggcacagccagcccatgggctcgcctgcctccccacagccacacccactcccctctgcaccaccccgcccagcccagcataccaccatggccaccaggtctccagctctgcccccagagaccccagctgccgccagcctgtcaacagccactgatgggctggcagccacacccttcatgtcccttgagtcaactcgtccctcccagctcctctctggcctgcctcccgacaccagcctgcccctggccaaggtgggcacatctgccccagtggccacacccggccccaaagcctctgtcatcaccactccactccagccacaggccacgactctgcctgctcagacacttagcccagtactgcctttcactccagcagcaatgacccaggcgcacccacccactcacatagcacccccagcagcaggcacagctccaggcctgctgctgggagccacattgccaacctctggagtcctgcctgtggctgagggcacggcctccatggtatctgttgtcccacgaaagagcaccacagggaaggtggccatcctatccaagcaagtgtctctgcccacttccatgtatggttctgcagagggtgggcccacagagctcacgcctgctacgagccaccctctcacgcccttggtggctgagcccgagggagcccaggcaggcacagctctgccagtgcccacatcctatgccctgagccgtgtctcagccaggacggccccccaagacagcatgctggttctgttgcctcagctggctgaggcccatggaacctcggcagggcctcacctggcagcagagccggtggacgaggccaccacagaaccatctgggcgctcagccccagccctgagcatcgtagagggtttggcggaggctttggcaactaccactgaggccaatacatccaccacctgtgttccaatcgccgagcaggactgcgtccgccacatctgcctggagggccagctgattcgcgtgaatcagtcccagcactgtccccagggtgctgctccccctcgctgtgggatcctgggcctcgccgtgcgggtgggtggggaccgctgctgcccactctgggagtgtgcctgccggtgctcaatcttccctgacctgagcttcgtgaccttcgatgggagccacgtagctctgttcaaggaggccatctacatcctcagccagagcccagatgaaatgctcaccgtccatgtactggactgcaaaagtgccaacctggggcacctgaactggcccccgttctgtctggtgatgttgaacatgactcacttggcccatcaggtcactattgatcgcttcaaccgaaaggtgactgtggacttgcagcctgtgtggccaccggtgagcaggtatggattcagaattgaggacacaggccacatgtacatgatcctgactccctcagacatccagatccagtggctccacagctcaggactcatgatcgtggaggccagcaaaaccagcaaggcccagggccatggcctgtgcggtatctgtgatggagatgcagccaatgaccttaccctgaaggatggctcagtggtgggtggggctgaggaccctgctccctttctggacagctggcaggtgcccagctccctgacctcagtgggccagacccgcttccgcccagacagctgcgccacaactgactgctcgccctgccttcgcatggtgtccaaccgcaccttcagtgcctgccaccgctttgtgcctccggagtcattctgtgagctgtggatccgggacaccaagtacgtgcagcagccctgcgtggccctgactgtgtacgtggccatgtgccacaaatttcatgtgtgcatcgagtggcggcgctctgactactgccccttcctgtgctccagcgactccacataccaggcatgtgtgacagcctgtgagccacccaagacatgccaggatgggatactagggcctctggacccagagcactgccaggtgctgggcgagggctgcgtctgctccgagggcaccatcttacaccggcgccactctgcactctgcatcccggaggccaagtgcgcctgtggtgactgtccagactccatccccgaatgtcaagaaggggaggcgctcactgtgcacaggaataccacggaactctgctgccctctgtaccagtgtgtgtgtgagaacttccgctgtccccaagtgcagtgtggcctgggcactgccctggtggaggtgtggagccccgaccgctgctgcccctacaaatcctgtggataaaagaaggaaaaagcaagtttcccattccaaagagggtttccgtcttaaaaagtccttactgcggccgggcacggtggctcacacctgtaatcccagcactttgagaggccaaggcgggtggatcatgaggtcaggagttcaagaccagcctggccaagacggtgaaaccctgtgtctactg

SEQ ID NO: 21237 - DNA, 8778 bp, Homo sapiens
atgggagtcctggcgtctgcgctctgctggctgctttgtgtctggctgccctggggtgagcaggcagccgagtccctgcgggtgcagcgcctcggtgagagggttgtggactcagggaggtcgggggctcgaggaatgagaaacgttaaaggaatgaggaatgggcccgcgcagactcgtgtttcctccagcagcagccaccaggaggcgacccttgccatgggggacaaggctacagtcgtgggaggccagcaggctgaagccccagactccgtggccatgtcttcctgggaaaggcggctccatcgggccaagtgtgcaccatcctacttgttctcctgcttcaatggaggcgagtgtgtgcacccagccttctgtgactgcagacgcttcaatgccactggaccgcgctgccagatggtgtacaatgccggccctgagagggacagcatttgccgggcgtgggggcagcaccacgtggagacatttgatgggctctactactacctctccggaaagggcagctacaccctggtgggtcgccatgagcccgagggacagagcttctccatccaggtacacaatgacccgcagtgtggctcttcaccctacacctgctccagggctgtcagcctcttctttgtgggtgagcaggagatccatctggccaaggaggtcacccatggaggcatgagggtccaactgccacatgtcatggggagcgcgcgtctgcagcagcttgccggctatgtcatcgtgcggcatcagtcagccttcacactggcctgggatggtgcctcggctgtctacatcaagatgagtccagagcttctgggctggacccatgggctgtgtgggaacaacaatgctgaccccaaggatgatctggtgaccagctctgggaagctgactgacgacgtggttgagtttgtgcacagctggcaggagcaggcccctaaccagcctccagggcccacaacttcctccctgcctcgcccaccgtgcctacagcagaacccaggaaccatgcagggcgtgtacgagcagtgtgaggctctactgcggcccccctttgacgcctgccacgcctacgtcagccctctgcccttcacagccagttgtaccagtgatctctgccaatcaatgggtgatgtagccacctggtgccgggcactggcggagtatgcccgggcgtgtgcccaggcagggcggcccttgcaaggctggaggacccagctccggcaatgcactgtgcactgcaaggagaaggcctttacctacaatgagtgcatcgcctgctgccctgcctcctgccatccccgggcatcctgtgtggacagtgagatcgcctgtgtggacggctgctattgccccaatgggctcatcttcgaggatgggggctgcgtggcaccagctgagtgtccctgtgagtttcacgggactctgtacccacctggctctgtggtgaaggaagactgcaatacttgcacatgcacctcaggcaagtgggagtgcagcacagctgtctgcccagctgagtgctcagtgactggtgacattcacttcacaacctttgatggccgccggtacacgttccccgccacatgtcagtacatcctggccaagagccgctcttcgggcaccttcaccgtgacattgcagaatgccccatgtggcctgaaccaagatggagcctgtgtccagtcagtgtcagtgattctgcaccaggaccctcggaggcaggtgaccctgacccaggcaggggatgtccttctgtttgaccagtacaagatcatcccgccatacacagatgatgcctttgagatccgtaggctgtcctccgtgttcctgcgggtgaggacgaacgtgggcgtgcgggtgctctacgaccgtgaagggctccgactgtacctgcaagtggaccagcgatgggtggaggataccgtgggcctctgcggcaccttcaatggcaacacgcaggatgacttcctgtctccagtgggtgtacctgagagcaccccacaactttttggcaattcctggaaaacactttctgcttgctccccgctggtctctggctcccctctggacccctgcgatgtgcacctgcaagccgcctcctactcagtgcaggcctgcagcgtgctcacgggggagatgtttgcgccctgctctgcgttcctgagccccgtgccctactttgagcagtgccgcagggatgcctgccgctgcgggcagccctgcctgtgcgccacactggcccactacgcccacctgtgccggcgccatgggctccccgttgatttccgcgcccgcctgccagcctgtgcactgtcctgtgaggcctccaaggagtatagcccctgcgtggccccgtgtggacgtacctgccaggacctggccagccctgaggcctgtggggttgatggtggcgatgacctgagcagagacgagtgtgtggagggctgtgcctgcccaccggacacctatctggacacccaggctgacctctgtgtcccccggaaccagtgctcctgccacttccagggagtggactatccccccggagacagtgacatcccatccctgggccactgccactgcaaagatggagtcatgagctgtgatagcagagccccagctgctgcctgcccagcaggccaggtcttcgtgaactgcagcgacctgcacacggacctggagctgagcagggagaggacgtgtgagcagcaactgctgaacctgagcgtgtcagcccgtggcccctgcctctcgggctgcgcctgtccccagggtctgctcagacacggggatgcatgtttcctgccagaggagtgcccctgcacttggaaggggaaggagtatttccctggggaccaggtgatgtctccttgccatacctgtgtgtgccagcggggctcattccagtgcaccctgcacccttgcgcctccacctgcactgcctatggggaccggcattaccgcacgtttgatgggctcccgtttgacttcgtgggggcatgcaaagtgcacctggtcaagagcacatcagatgtcagcttctctgtgattgtagagaatgtgaactgctacagctctggcatgatctgcaggaaatttatttccatcaacgttgggaactcactcattgtctttgatgatgactccggaaatcctagtccagagagcttcctggatgacaagcaggaggtccacacatggcgagtgggatttttcacactggtgcatttcccacaggagcacatcaccctcttgtgggaccagagaaccacagtgcacgtccaggctgggcctcagtggcagggccagctggcgggcctctgtgggaactttgacttaaaaaccatcaatgagatgaggaccccggagaacctagagctaactaacccccaggagtttggcagcagttgggctgcagttgagtgcccagacaccctcgatcctcgggatatgtgtgtcctgaatcctctccgagaaccatttgccaagaaggagtgcagcatcctgctcagtgaggtgtttgagatctgccaccctgtggttgatgtcacttggttttactcaaactgcctgacagacacatgtggctgcagccagggtggtgactgtgagtgcttctgtgccagcgtctccgcttatgcccaccagtgttgccagcatggggtggctgttgactggcgaaccccccgcctctgcccgtatgactgtgacttctttaacaaagtgctaggtaagggcccctatcagctatccagcttggcagccggtggtgctctggtgggcatgaaggcggtgggcgatgacatagtcctagtgaggacagaggatgtggcgccagcagacattgtgagcttcctgctgacagctgctctgtacaaggccaaggcccatgacccagatgtggtgtccctggaggcagcagacagacccaacttcttccttcacgtcacagccaacgggtctctggagctggctaagtggcagggccgtgacaccttccaacagcatgcctccttcttgctgcaccgggggacacggcaggcaggcctggtggccctggagtccctggccaagcccagctccttcctctatgtgtcgggcgcggtgctggccctgcggctgtacgaacacacagaggtgttccgccggggcacactcttccgccttctggatgccaagccctcgggggctgcctaccccatctgcgagtggcgctacgatgcctgtgccagcccctgcttccaaacctgccgggacccacgggcagccagctgccgggacgtacccagggtagaaggctgtgtccctgtgtgccccaccccccaggtcctggatgaagtcacacagagatgtgtctacttggaggactgtgtggagccagcagtttgggttcccacagaggcccttggcaatgagaccctccctcccagtcaagggttgcccactcccagtgatgaggagccacagctgtcacaggaaagccccaggacccccacccacaggccagccctcaccccagctgccccactcaccacagccctgaacccaccagtgacagccactgaggagccagtggtgtctccaggccccacccagaccaccctgcagcagccactggagctcactgcatctcaactccccgccggccccacggagtccccagccagcaagggagtgactgccagcctcctggccatcccccatacaccagagtcctcatccctccctgttgcactgcagacacccacacctggcatggtgtcaggtgccatggagacaacaagggtgactgtgatctttgcaggaagccctaacatcacagtctcctcccggtcgccccctgcccctcgcttcccgctcatgaccaaggctgtgacagtccgaggccatggctccttgcctgttaggacgacacccccacagccctccttgacagcaagtccctcctccagacctgtggcttcccctggagccatctccaggtcccccacctcctcgggatcccacaaggctgtgctgacacctgcagtaactaaggtcataagcaggacaggggtcccccagcccacccaggcccagagtgcttcaagtcccagcacccctctaactgtggctggaacagcagcagaacaggttcctgtcagtccccttgcaaccaggagcttggagatagtgctatccacagagaagggcgaagccgggcacagccagcccatgggctcgcctgcctccccacagccacacccactcccctctgcaccaccccgcccagcccagcataccaccatggccaccaggtctccagctctgcccccagagaccccagctgccgccagcctgtcaacagccactgatgggctggcagccacacccttcatgtcccttgagtcaactcgtccctcccagctcctctctggcctgcctcccgacaccagcctgcccctggccaaggtgggcacatctgccccagtggccacacccggccccaaagcctctgtcatcaccactccactccagccacaggccacgactctgcctgctcagacacttagcccagtactgcctttcactccagcagcaatgacccaggcgcacccacccactcacatagcacccccagcagcaggcacagctccaggcctgctgctgggagccacattgccaacctctggagtcctgcctgtggctgagggcacggcctccatggtatctgttgtcccacgaaagagcaccacagggaaggtggccatcctatccaagcaagtgtctctgcccacttccatgtatggttctgcagagggtgggcccacagagctcacgcctgctacgagccaccctctcacgcccttggtggctgagcccgagggagcccaggcaggcacagctctgccagtgcccacatcctatgccctgagccgtgtctcagccaggacggccccccaagacagcatgctggttctgttgcctcagctggctgaggcccatggaacctcggcagggcctcacctggcagcagagccggtggacgaggccaccacagaaccatctgggcgctcagccccagccctgagcatcgtagagggtttggcggaggctttggcaactaccactgaggccaatacatccaccacctgtgttccaatcgccgagcaggactgcgtccgccacatctgcctggagggccagctgattcgcgtgaatcagtcccagcactgtccccagggtgctgctccccctcgctgtgggatcctgggcctcgccgtgcgggtgggtggggaccgctgctgcccactctgggagtgtgcctgccggtgctcaatcttccctgacctgagcttcgtgaccttcgatgggagccacgtagctctgttcaaggaggccatctacatcctcagccagagcccagatgaaatgctcaccgtccatgtactggactgcaaaagtgccaacctggggcacctgaactggcccccgttctgtctggtgatgttgaacatgactcacttggcccatcaggtcactattgatcgcttcaaccgaaaggtgactgtggacttgcagcctgtgtggccaccggtgagcaggtatggattcagaattgaggacacaggccacatgtacatgatcctgactccctcagacatccagatccagtggctccacagctcaggactcatgatcgtggaggccagcaaaaccagcaaggcccagggccatggcctgtgcggtatctgtgatggagatgcagccaatgaccttaccctgaaggatggctcagtggtgggtggggctgaggaccctgctccctttctggacagctggcaggtgcccagctccctgacctcagtgggccagacccgcttccgcccagacagctgcgccacaactgactgctcgccctgccttcgcatggtgtccaaccgcaccttcagtgcctgccaccgctttgtgcctccggagtcattctgtgagctgtggatccgggacaccaagtacgtgcagcagccctgcgtggccctgactgtgtacgtggccatgtgccacaaatttcatgtgtgcatcgagtggcggcgctctgactactgccccttcctgtgctccagcgactccacataccaggcatgtgtgacagcctgtgagccacccaagacatgccaggatgggatactagggcctctggacccagagcactgccaggtgctgggcgagggctgcgtctgctccgagggcaccatcttacaccggcgccactctgcactctgcatcccggaggccaagtgcgcctgcactgacagcatgggggtgccgagggccctgggggagacctggaacagctccctcagcggctgctgccagcaccagtgccaagccccagacaccattgtcccggtggatctgggctgccccagtccccgccctgagagctgcctgcgattcggggaggtggccttgctcctacccaccaaggacccctgctgcctggggactgtctgtgtgtgtaaccagactctgtgtgagggtctcgcccccacatgccgcccaggccaccgcctcctcacccacttccaggaggactcctgctgccccagctacagctgtgagtgtgacccagatctctgtgaggcagagctggtccccagctgccgacaggaccagatcctgatcacgggccgcctgggggactcctgctgcacctcctacttctgcgcctgtggtgactgtccagactccatccccgaatgtcaagaaggggaggcgctcactgtgcacaggaataccacggaactctgctgccctctgtaccagtgtgtgtgtgagaacttccgctgtccccaagtgcagtgtggcctgggcactgccctggtggaggtgtggagccccgaccgctgctgcccctacaaatcctgtgaatgtgactgtgacacaatcccggtgccccggtgccatctgtgggagaaatcccagctggatgaggagttcatgcacagcgtggagaatgtgtgtggctgcgccaagtacgagtgtgtgaaggccccggtgtgtctgagccgcgagctgggtgtgatgcagcccggccagacagtggtggagctctcagcagatggcgtgtgccacacctcccgctgcaccaccgtgctcgaccctctcaccaacttctaccagatcaacaccacctccgtgctctgtgacatccactgtgaggcgaaccaggagtacgagcacccgcgggacctcgctgcctgctgcggctcctgcaggaacgtgtcctgtctcttcaccttccccaatggcaccacctccctgttcttgcccggggcatcctggatcgcagactgcgcccgccaccactgcagcagcacgcccctgggtgccgtgctggtccgctctcccataagctgcccaccgctcaatgagactgagtgtgccaaggttgggggttccgtggtaccttccttggaaggatgctgcaggacctgtaaggaggatgggcgctcctgcaagaaggtgaccatccgcatgaccatccgcaagaatgaatgcaggagcagcacccctgtgaacctagtgtcctgcgatgggaggtgcccatccgccagcatctacaactacaacatcaacacctatgcccgattctgcaagtgctgccgtgaggtgggcctgcagcggcgctctgtgcagctcttctgtgccaccaatgccacctgggtgccctatacagtgcaggagcccaccgactgtgcctgccagtggtcctga

SEQ ID NO: 21238 - DNA, 1477 bp, Homo sapiens
ccccgcttccagtcagagttcaagttaaaacagaaaaaaggaagatggcaagaatattgttacttttcctcccgggtcttgtggctgtatgtgctgtgcatggaatatttatggaccgtctagcttccaagaagctctgtgcagatgatgagtgtgtctatactatttctctggctagtgctcaagaagattataatgccccggactgtagattcattaacgttaaaaaagggcagcagatctatgtgtactcaaagctggtaaaagaaaatggagctggagaattttgggctggcagtgtttatggtgatggccaggacgagatgggagtcgtgggttatttccccaggaacttggtcaaggaacagcgtgtgtaccaggaagctaccaaggaagttcccaccacggatattgacttcttctgcgagtaataaattagttaaaactgcaaatagaaagaaaacaccaaaaataaagaaaagagcaaaagtggccaaaaaatgcatgtctgtaattttggactgacgttttaagaatttgttaccttacagaagagcaagggcttaggggttggaggtggcagataaaagaggattttcaactcaaatcttgtttcctgctggcctggtctgcccacgagctagagcggggaaatgttgagctcaaatgggtaaattgagaccagaaaattattttttcaacctagagaatctcctcttacagggggatgcatataacagatcatgtatgtgtagttatttctaagtagtaattcttcccagctctttgatttgccatatataaaataggtgggtcgtatgtcttccctttagacatgatgttttctactcatttgtctctctggccaattgaattattaataaaaggtctgtattatcaaagagtattctagtatttttgttacttttaatatttgatgccttttggaggtaaagctgttgggggaagaagagtttttggacccatagatgtttggatgatgtctctaatttgtcatttagaaaaatctcaaaaatgatttcagttgaataacttgccttctaaatgatcaatttacttctcccccaattttaaagaagtatgtgtatatttaataggggaaggtagtttatggaaatatttttaatggaatagttttcccttaatatgtatccttgctggatattattcaagctgcaagtcatcaaaagacccagaaaaaaaaaagtctgtaggttattttctctacttctatttcaactttgaatttcctcttcctgtgcaaattcctctagtcaagtgtgatatatcaagaaatctgaggaggatgcaggttttgtggtcctgatgggcccacaagtttttctatatttaactggaaatatgctttgattttgtgttattaatataattcttttgatgtagtcatgagtttttctttgtttgcatataattaaaatgcctctacttaatgtca

SEQ ID NO: 21239 - DNA, 3111 bp, Homo sapiens
aggaatttggccgggacccgggcgctattcgcggctgctgactcgcggcggccggctgcctttcgctcatctctattctggggccgttgggtcaccgcgctccgccggccccctcccccgggcccggagggtgtgtcccccgctccggggctcgccgcgcctataaggggccgagcggcgggcagggacatgcagctctacagcagcgtctgcacccactaccccgccggggccccgggtcccacggccgccgcccccgcgccacccgccgccgctacccccttcaaggtctcgctgcagcccccgggagccgccggcgccgcgcccgagcccgagaccggtgagtgccagcccgccgcggccgccgagcaccgggaagccgccgctgtccccgccgccaagatgcccgccttctcctcctgcttcgaggtggtgtccggggccgccgcgcccgcctccgccgccgccggcccgcccggcgcgtcctgcaagccgccgctgccgccgcactacacgtccaccgcacagatcaccgtgcgggccctgggcgccgacaggctcctgctgcacgggcccgatcccgttcccggcgccgcgggctccgccgctgccccgcgcggccgctgcctcctgctcgccccggcgcccgcagccccggtcccgccgcggcggggctcctcggcctggctcctggaggagctgctgcggcccgactgccccgagcccgcgggcttggacgcgacacgggaggggcccgatcggaacttccgactgagcgagcaccgccaggccctggccgccgccaagcaccgaggccccgcggcgaccccggggagccccgatcccggccccggtccgtggggcgaagagcacttggcggagaggggccccaggggctgggagaggggcggcgatcgctgcgacgcgcccggtggggacgcggcgcggaggcccgacccagaggccgaggcaccccccgccgggagcatcgaggccgccccgagtagtgcggcggagccggtgatcgtctccaggtcggatcccagagacgagaagctggccctatacctggccgaggtggagaagcaggacaagtatctgcggcagaggaataagtaccgattccacatcattccagacggcaactgcctctaccgagctgtcagcaagacggtgtatggggaccagagcctgcaccgggagttgagggagcagacggtgcactacatcgccgaccatctcgaccacttcagccccctgattgagggcgacgtgggggagtttatcatcgctgctgcccaagacggggcatgggccgggtacccggagttgctggccatggggcagatgctgaatgtgaatatccatttaactactggagggaggctggagagtcccacggtgtctaccatgattcattatttgggcccagaggattccctgaggcctagtatttggctcagttggctcagtaacggacactatgatgctgtatttgatcactcctatcctaacccagagtacgacaactggtgcaaacaaactcaagtgcaaaggaaacgcgacgaagaacttgccaaatctatggccatatccttgtctaaaatgtatattgaacaaaatgcatgctcttgaaatgtctcaaaaccttacaccctgggaataattgcatatataacttgtgtttggagaatcacatgaactttaatcagggtaatagcactttcaaacttgctagtagattttactgtaggtgtaatgccttaatcatctttttgaatgttttctcagagctggaggttgctgggcacctaaatgatgtttcatgatagctttgggtgattttactgctatttataatttgctgtataaagtgagcattacttaatttgcaagctgatttctcacagtgtaaatttgttcattcctggtagtctattttctataaaaatgtatttttgcacaacatttttaaaaactggtgtaccttcatctatgacgtgttccattttgacaaacagctttcaggcgtaaatccagagaagtgctttatatgaaatgtattattttgaacagagtttgtgatttggtagttattttatgttgttgaaatttgaatttcacaattcttagataattatttcaaatggatattgatgcattcttgttaccagatgtttggcccattccattttgatgaaacagagctgttgttttggaagtcattatttttctagaaatggcgaatcttttaaagaaaattacttaatggaaggttgtgggaaggtgtttttttgtgttttttttttggtttttgttttgtttttcctcttttaagggatagtagcaggtcttacttgaatgaaagtctgatatttgctgatggcagaatgattattctgtaccctggttgatgtgtagagtagattgtctggtgctctcagttgtttttatttacatttgtcacgttgttgtaagagaatgttaacatggtataaaactctgtgacaagataagcctcctgctttatataacttcttgaatccagctaagagatttataaactaatggcataaatgtctggagccaaccttggcagttatagcaggagaacactgtcttaatatttctttacattctttcaaaaggcaaaataggattgccctgtattgatgtagaaatgtctgtaaacagagcttgtatggtttgctgggtcaaacaatgtttccaacttaaaatcaatctcattgccactttaactacttttagtcatatttattaagtaatgcagtttgtactttttttattttgtaacattttgtgatttttttgtacaaaactgtatttgtacaatagagcaattcccagctgatggaatgaatgaataaaatgcaaaattatacttttacaatgcctttttggatagagtggtttttaaattgtgatgtttgtaggaaactttcttgcatgtatgcatgtacacaattttttttttccataaagatgccacagcaatagagaggtttcctaaattatcacatgaagaggataggctaatcatgagtaatttcaaaggataagtctgaataaaatataatttaaaagtggagt

SEQ ID NO: 21240 - DNA, 6397 bp, Homo sapiens
catgtcccgaaagcaggcggcgaagagccggccgggcagcggcagccggaaagccgaggccgagcgcaagcgggacgagcgggcggcgcgccgggccctggccaaggagcggcggaatcggccggagtctggcggcggcggcggctgcgaggaggagttcgtcagcttcgccaaccagctgcaggccctggggctgaagctgcgggaggtgccgggggacggcaattgcttgttcagagctcttggtgatcaattggagggacactcacgaaatcatctcaagcacagacaggagacagtggactacatgataaagcagcgggaagattttgaaccctttgtagaagatgacattccttttgagaagcatgtggccagtttggcaaagcctggtacttttgctggcaatgatgcaattgtagcctttgcaagaaatcatcagttgaatgtagtgattcatcaacttaatgcccctttgtggcagattcgtggtacagagaaaagcagcgtgagggagttacacatcgcatatcggtatggagagcactacgacagtgttcggaggatcaatgacaactcagaggcacctgcacatctccagacggattttcagatgcttcatcaagatgaatcaaataaaagagaaaagatcaagacaaagggaatggactctgaagacgacctgagagatgaagtagaggatgctgtccagaaagtttgtaatgcaactggatgttcagattttaatttaatagtccagaacctggaagctgaaaattataatattgaatctgcaataattgccgtgcttcggatgaaccaagggaagagaaataatgcagaagagaatcttgagcccagtggtcgagtgctgaagcagtgtggccctttgtgggaggagggtggcagtggtgccagaatctttggaaatcagggcttaaatgaaggcaggaccgaaaacaataaggcacaggccagccctagtgaagaaaacaaagcaaataaaaaccagctcgcaaaggtcacaaacaaacagaggcgagaacagcagtggatggagaagaagaagcggcaggaggagaggcaccgccacaaagccctggagagcagaggtagccacagggacaataacagaagcgaagcagaggcgaacacgcaggtcaccttggtgaagaccttcgccgctctcaacatctgactctttggcctcttgggagttgtaagaagcggctggaaaaggattgctgtgtgctagactttccagtgaggccgtccttttataaaacgcaacacaaccaacgaagcccacacatgagctcacacactgagttagtttcgttcaagctgcctctttttttgttcgaagttttattagtgatatgttggtgttttatgaaaatgcagtgaggccattcatattctgtaatacaaaattaaaatactgagttttaggggcagatagttaggtcaggaaaaaccttttaagtggtggctttatttgccctgaaaatcagacttcagtgaccctaggatctttccttaacatttggggtgagttttgctgtaattgttcatgagtagtttagaataattgttagaaattcagaatgacaagtttccttagtttctctttcattctcaaacagatatatagggtagcttataaatgatctccaactcaggaatatgctttgatttacttctaatccaagttactcagaaaataattcaggaattgttttcccaaagttacgtgagggttgtggcctgcagtcaggatggaaattaaccgcatttctctccttcctgattctgatgttatttcagatgggatgcaggtgctgttagttcatttgcactcaagccatatgataaatgcagctgactgttaattaggcctggccttgttgggaagttgatagtggtgttgggtttttggtatttgtttcctgacagtggggagatggcatgttactgcttgtgatacagttctggaattctgatagtgtgtagagcagggtctatagttgtaacaggagacgaactcctggggttttgcctaagaggagtctaaagaattatgtttttataggagaagcctggaagaataaggtttttcatgttcgcattttaaataacgattttcttcccttctgttgtagacttagatgccttcagagagatacgtggtaacttgaccttataggtcgctaaacttagtattgtggaaattaaatcttataaaatgctacatttatttctttttatttaagccctgtttggcatttcaaagttgggaaaactccagcatctgctggaagttgttggaccagcagggttggttgacttaggttggaccagcagagaagagaacatactttggttgaggccttcgaatcactcttcagttctgaaatagacagacttgagcagtggagagacgtctttcctaaaactgagttaggtggatgtgaacttaagaactataacgtatgaggcagcccatcttggatcatctttgtcttttgggacctaatacttgggcaaataattgatgctgagttgaaaggtaaattattagttatcttccccacccctcgcatttcagaattataaaaattcggaggcaaattgaaaactaaaatgtttggtaggccctggagtcgccagattgtctttatcaccaggcctttggctttcttcagtttcactggtatcttttggttttgtttttgactttggtggctttttgtagttggagcatcagtagtctcttggaattgctcctaggacattgtggtttaggtttcttcctgggtacagtacattgtaaaatttagcagattaaaaaaagtacacagcattttttttctgtgcacgtcgcagagtcctgagcttgaggctgtgttactctactcattccaaacgaatgaaagatctctgttgccttactctaaggaagtgggatcgagtgcgttaggatctatggttgtcttggttttcaactctgggcagattcctgactggctgagtgtttctgaatgaagatgttttcctgtctgttttgtactgcttgagtgcagaggccagatcctctcagaaagataagattgtatgccagaaattcagattagcagtcagcttaagagagacttattgtcagaagtagtagaattgctttatttacttggttaatgaaggtggccttgggccctattgggttttagaagttttagaagctgctaaaaagttattaaagaatattgggaacatttattttttaaattacctaattctggtaataggcttcagcatttctggagtataataatggtggtttaaaaaactaatcaaacggctttagtaattttactactggtttcacagcttttcagttacagttggtctgtttagtgtgttaattattaggaatcgggtacatgcatccaacttcagtgataccttctagctaatggtttcaatttagacttcactgcctcagtctcactgggtacatgagaaggttggaatcaacatgcttagttgcctcagtgggcacttgaaaattccttcactggcagcccgagtggaggcccagtatgtctagtcctgggatgactgttgtcagcagctgttactctagtacaggtgctcctgtgaactctttattaggaactgaatgtgtcttaacctctgtgttacatcttggctggcagagatttatgttacatgagattgtcttggtagcttgtagtgtggtcaggagaaaggggatggagcagtggtgcatagctgcttactgctcttataaacggtatataaaggttttacggattttgaaaatatttttttttagaggtcaaaataaataccattttagtggcaacagctttgaactagagaggtagatgtattaaagcagcatagaaccataacttctagataatgtagttgccactaggagatattagaaagttagaatgtatgtgtgtatttagtttttcaataataatgaacatacactttcaggagcaaagtatggttgagaaattgtggcagaaagaattttaaatgttagtcgaagttgtctgtagtttctttattaagctctgaaaacacttccaatgccagtttgattctgagggcttgggaagtgggatctcccttgtggagcagctggagctggctgggagggagcctctccatgggtaatttattatgcctgccctgcttcccccagggagctgcttcagtgtgaaatgatgtgattgtcgggggtggggtgggaggagggccaccttcagtcggggagttgctcacatattacacaggtagcatcaggtggacttcagcgctgaactgtactagtagtgagtccctgtagtcaatgtgcaatttctctaattctgagaaactctgtagactctgcctgggttttactgggtcagcatagaatgctatcagtttacctctgtgaaatattcagtcagttgaaggaaacttggattcctagtcagaggtgactaaaagttaccctgaccaaaaggatctctgcggggggaagagaatggagcttcctgattttaatgtgttgcgtcagtggccctcttcgactcccgttttgggtagatgcgtagctcttcactttcttacctcaaggctctgtctagccatgttaaatctttagactcagtctgatgccgtttttctgttttgccattctcattattcacagctttcagaacaagtgttgctaaaactccggggcctttgacagttgttctgaggtgatttaataatggactttttataagttatgttttcctggctctaaagtaaatttttttttttttttttttgagacagagtcttgctttgttgcccaggctggagtgtggtggggcaatctcggctcactgcaacctccacctcccgggttcaagcgattctcctgcctcagcctcctgagtagctgggattacaggtgtgtgccaccatgcttggctaatttttgtatttttagtagagacggggtttcaccatgttagccaggctggtctcaaactcctgaccttgtgatctgcccgcctcagcctcccaaagtgctaggattacgggtgtgagcaaccctgcccggccagtaaattgtatttttttaatgacatcattgatttgaagatctagatggcataaattacgacgtctgccatcgcatattagaaaggggacagtcatatttgtaacgtggagagaacacggagcaccagtcaccacgtgcacttaggatgcagagcttaccgcacaccgctgatggggacctccggaaagagcggtgccttgtggttggcctggaagttctctcccaaggtgaaattcctttaaaacctcaggctctgacctatgtctttgaagcagctgctttgtagagtccctctctttactgtcctcgttaggactgttttgtggttccatgaaaatgtttagcatccttgcagaattacttgagaaggggctggtaccagtgtaaagaatctatttctgtaaaactacgaacttttgcatagggaatttattctaagcaggtcatagccgtgatccagagctgctgctgctcactgccagtccttgcggctggcggcgattgccggacagactctctgtggcctggctctcatccttggcgtgtcagcctgcggcaggctgccagccatccatgacaatcatgtgagctcagccacagacctcagctggcggtttgatccctggcaggtccctcgagcagtactggtaagaggcttcacacattttcccactcttacagttcatttttcatagtaggaagggcccttggcctccccagtgcctcttccagagcctccaccagcactaagctcagaggaaagaagaaaagggccaggagtcagacgtcacacccgggggctcccctttcccatgtagaagtgttggcatgcgtcagtctcctttacagaggggtggatgtatccgtggaggaggggccttctctctttctaattgcactatacttgttctagcttcagtctggagatacttaagacctccatggggtcgtgatccatagacttagcaagtcttgccttatctatggagctcgatggtgagaattgtgaccattgtctgatgtccatagttccttccccctagattgtttctttccacggattgtgttcatctgaaccattttattttttatttaccaaagtactgtacttggctatttgcagtgttttcaaaaccaaatgtttctttttttgtgtttttaatcttcgatacttggtgcaatagaagctgcaaagatgtgccactttatctatgaaatggagttttgtataccaataaattctagtttaaaaacaaa

SEQ ID NO: 21241 - DNA, 938 bp, Homo sapiens
cccattgtaacgccggagtgggacgctgctttgcgtctgaaaggtgcaaattgaaactcgaaagcccgcaaattaacggggtgtctctctcctgatgaagaggtattgcactctcagtctcgccatgttgaagtcagaatggcctgtattcactatcttcgagagaacagagagaaatttgaagcgtttatagaaggatcatttgaagaatatttaaagcgtttggaaaatccacaggaatgggtaggacaagtggaaataagtgccctttctcttatgtacaggaaagattttataatttatcgggaaccaaatgtttctccttcacaagtaacagaaaataattttcctgaaaaggtgttactgtgtttttcaaatggaaatcattatgatattgtgtatcccataaagtataaagaaagctctgctatgtgtcagtctctcctttatgaattgctgtatgagaaggtatttaaaactgatgttagtaaaattgtgatggaactagacacgttggaagtagctgatgaagataacagtgaaatatcagattcagaggatgacagttgcaagtaagaatgaaatcctaaaatacctttcttagtgccatacaaggaaagttaagtaaatgtctttacatttcagtaaatgtctttctataacatatattgaggtattaatggtattcataaaatacagcagtctgctgaagtttctttatccctgtcactaattttacctaatttctattatgggactgtttgttttgaaagttggtgtttttggttgatgagaatttacgtctgcaatctagatgcatatttgtagaataaatttggtcctacctatatgtgtgtgtattgtaaaattttaaagttaacttgtcaattgttcacatacccagtaatgaaataaaatggccgtttggatttccttca

SEQ ID NO: 21242 - DNA, 3829 bp, Homo sapiens
ggcagggcttccctatgcgcccggagagcgcggaccgctgcctcgggccgccgccgcctgccgccgctcgcggagcccgagccccagcccgagccgccgcctgccccaggccggggcgtcgagcagccggcggcctggccatgtggggctagccctcgccgcgcctggcctgcagcaggaccagcaacatggaggctgccgtcggcgtccccgacggcggggaccagggcggcgcggggccccgcgaggacgcgacgcccatggacgcctatctgcggaaactgggcttgtatcggaaactggtcgccaaggacgggtcgtgcctgttccgggccgtggcggagcaggtattgcactctcagtctcgccatgttgaagtcagaatggcctgtattcactatcttcgagagaacagagagaaatttgaagcgtttatagaaggatcatttgaagaatatttaaagcgtttggaaaatccacaggaatgggtaggacaagtggaaataagtgccctttctcttatgtacaggaaagattttataatttatcgggaaccaaatgtttctccttcacaagtaacagaaaataattttcctgaaaaggtgttactgtgtttttcaaatggaaatcattatgatattgtgtatcccataaagtataaagaaagctctgctatgtgtcagtctctcctttatgaattgctgtatgagaaggtatttaaaactgatgttagtaaaattgtgatggaactagacacgttggaagtagctgatgaagataacagtgaaatatcagattcagaggatgacagttgcaagagtaagactgctgctgctgctgctgatgtgaatggatttaaacctttgtcaggcaatgagcagctgaagaacaatgggaactctactagcctgcctttgtctagaaaggttcttaagtcactcaatcctgcagtctatagaaatgtggaatatgaaatttggctgaagtctaaacaagctcagcaaaaacgtgattattccattgctgctggcttacaatatgaagttggagacaaatgtcaagttaggttggatcacaatggaaaatttttgaatgcagatgttcaaggaattcattctgagaatggaccagttttggttgaagaactgggaaagaagcacacatcaaagaacctcaaggcacctcccccagaaagctggaacacagtgtcagggaagaagatgaaaaaaccttccacttctggacaaaatttccattctgatgtggattacagagggccaaagaatccaagcaagccaataaaagccccatcagcactacctcctcgactgcagcatccttcaggagtaagacaacatgcgttctctagtcattcttcagggtcacagtctcagaaattctccagtgagcacaaaaatcttagccggacaccttcacagatcataagaaaacctgatcgtgaaagagttgaggattttgatcacacaagtcgagaatctaactatttcggcctttccccagaagagcgcagagagaagcaagctatagaagaatcccgtttactctatgagattcagaacagagatgaacaggctttcccagccctttccagctcatcagtcaatcagtcagcttctcagagtagcaatccatgtgtccagagaaaatcatcacatgtaggtgatagaaaaggaagcaggcggagaatggatacagaagaacgaaaagacaaagactctattcatggacatagtcagttggataaaagacccgaaccaagcacattggagaatattactgatgataaatatgcaacagtttcatcaccatcaaagtcaaagaagttagagtgcccttctcctgcggaacaaaagccagcagaacatgtgtctttgtcaaatccagctccccttctagtttctccagaggtacatctaactcctgcggtgccttctttaccagccactgtgccagcctggccaagtgaacctacaacttttggaccaacaggtgtccctgctccaattcccgttttgtcagtgacacagactttgaccactggacctgattcagctgtatcccaagctcatttaacaccctctccagttcctgtgtcaatacaggcagttaaccagcccttgatgcctttgcctcagacattgagcctttatcaagacccactctatcctgggtttccttgtaatgaaaagggagatcgagccattgtaccaccttattcactgtgtcagactggggaggacctacctaaagataagaatattcttcgattcttcttcaatcttggtgtgaaggcatacagttgtcctatgtgggccccacattcttacctgtaccctctgcaccaggcctacctggcagcctgcaggatgtacccaaaggtccctgtccctgtttatcctcataatccctggttccaagaggctcctgctgctcagaatgaaagtgattgtacctgtactgatgcccactttcctatgcagactgaggccagtgttaatggtcaaatgccacagccagagattggaccgccgacattttcttcacctctggttatccctccatctcaggtgtctgaaagtcatggacaattgtcttaccaggctgatcttgaatctgagacccctgggcagcttctgcatgctgattatgaagagtcactaagtggcaagaatatgttcccccagccatcttttggacccaatccattcttaggcccagttcctattgcacctcctttctttcctcatgtttggtatgggtacccttttcagggattcatagaaaatccagtaatgaggcagaatattgtcctgccctctgatgaaaaaggagaattggatctgtctctggaaaatctggatctgtctaaagattgtggttcagtttcaacagtagatgagtttccagaagccaggggtgaacatgtacattctctccctgaagcaagtgtgagcagtaagccggacgaaggccggacagagcaatcttcccagacacgaaaggcagatacggcattggcttccatccctcctgtagcagagggaaaggctcatcctcccactcagattctaaacagagagagagaaactgtgcctgttgaacttgaacctaaaaggaccattcaaagcctgaaagaaaaaacagaaaaagtaaaagatcctaagactgctgctgatgtggtcagccctggggccaactctgttgatagcagagtgcaaagaccaaaagaagagagttcagaagatgaaaatgaagtgtctaatattttgagaagtggtagatccaagcagttctataatcaaacttatggaagcaggaagtacaaaagtgattggggctattctggtaggggtggatatcaacatgtgagaagtgaggagtcctggaaaggacagccaagcagaagtcgggatgaaggttatcagtaccatcgaaatgtcagagggcgaccatttaggggagataggaggagatcagggatgggagatggccataggggacagcacacttgatggttgttgccgaagtattttctaacagaaactcttaggtggaatgtttctgaaggctttaaaaaaaatacaataaagtaaaaaccgcagttggaactctttcctctccccagccccccttaccttcactcccatactggacaagacattttggacatgagttcaagggggcaggttaattcctggcattgccagttttcttcattcagaatctgtttgttgatcaagtgactgtccccgtaaaaagtagaagataagtttgttaaagtattttttataaacagcttaatataaaa

SEQ ID NO: 21243 - DNA, 7069 bp, Homo sapiens
cccattgtaacgccggagtgggacgctgctttgcgtctgaaaggtgcaaattgaaactcgaaagcccgcaaattaacggggtgtctctctcctgatgaagaggtattgcactctcagtctcgccatgttgaagtcagaatggcctgtattcactatcttcgagagaacagagagaaatttgaagcgtttatagaaggatcatttgaagaatatttaaagcgtttggaaaatccacaggaatgggtaggacaagtggaaataagtgccctttctcttatgtacaggaaagattttataatttatcgggaaccaaatgtttctccttcacaagtaacagaaaataattttcctgaaaaggtgttactgtgtttttcaaatggaaatcattatgatattgtgtatcccataaagtataaagaaagctctgctatgtgtcagtctctcctttatgaattgctgtatgagaaggtatttaaaactgatgttagtaaaattgtgatggaactagacacgttggaagtagctgatgaagataacagtgaaatatcagattcagaggatgacagttgcaagagtaagactgctgctgctgctgctgatgtgaatggatttaaacctttgtcaggcaatgagcagctgaagaacaatgggaactctactagcctgcctttgtctagaaaggttcttaagtcactcaatcctgcagtctatagaaatgtggaatatgaaatttggctgaagtctaaacaagctcagcaaaaacgtgattattccattgctgctggcttacaatatgaagttggagacaaatgtcaagttaggttggatcacaatggaaaatttttgaatgcagatgttcaaggaattcattctgagaatggaccagttttggttgaagaactgggaaagaagcacacatcaaagaacctcaaggcacctcccccagaaagctggaacacagtgtcagggaagaagatgaaaaaaccttccacttctggacaaaatttccattctgatgtggattacagagggccaaagaatccaagcaagccaataaaagccccatcagcactacctcctcgactgcagcatccttcaggagtaagacaacatgcgttctctagtcattcttcagggtcacagtctcagaaattctccagtgagcacaaaaatcttagccggacaccttcacagatcataagaaaacctgatcgtgaaagagttgaggattttgatcacacaagtcgagaatctaactatttcggcctttccccagaagagcgcagagagaagcaagctatagaagaatcccgtttactctatgagattcagaacagagatgaacaggctttcccagccctttccagctcatcagtcaatcagtcagcttctcagagtagcaatccatgtgtccagagaaaatcatcacatgtaggtgatagaaaaggaagcaggcggagaatggatacagaagaacgaaaagacaaagactctattcatggacatagtcagttggataaaagacccgaaccaagcacattggagaatattactgatgataaatatgcaacagtttcatcaccatcaaagtcaaagaagttagagtgcccttctcctgcggaacaaaagccagcagaacatgtgtctttgtcaaatccagctccccttctagtttctccagaggtacatctaactcctgcggtgccttctttaccagccactgtgccagcctggccaagtgaacctacaacttttggaccaacaggtgtccctgctccaattcccgttttgtcagtgacacagactttgaccactggacctgattcagctgtatcccaagctcatttaacaccctctccagttcctgtgtcaatacaggcagttaaccagcccttgatgcctttgcctcagacattgagcctttatcaagacccactctatcctgggtttccttgtaatgaaaagggagatcgagccattgtaccaccttattcactgtgtcagactggggaggacctacctaaagataagaatattcttcgattcttcttcaatcttggtgtgaaggcatacagttgtcctatgtgggccccacattcttacctgtaccctctgcaccaggcctacctggcagcctgcaggatgtacccaaaggtccctgtccctgtttatcctcataatccctggttccaagaggctcctgctgctcagaatgaaagtgattgtacctgtactgatgcccactttcctatgcagactgaggccagtgttaatggtcaaatgccacagccagagattggaccgccgacattttcttcacctctggttatccctccatctcaggtgtctgaaagtcatggacaattgtcttaccaggctgatcttgaatctgagacccctgggcagcttctgcatgctgattatgaagagtcactaagtggcaagaatatgttcccccagccatcttttggacccaatccattcttaggcccagttcctattgcacctcctttctttcctcatgtttggtatgggtacccttttcagggattcatagaaaatccagtaatgaggcagaatattgtcctgccctctgatgaaaaaggagaattggatctgtctctggaaaatctggatctgtctaaagattgtggttcagtttcaacagtagatgagtttccagaagccaggggtgaacatgtacattctctccctgaagcaagtgtgagcagtaagccggacgaaggccggacagagcaatcttcccagacacgaaaggcagatacggcattggcttccatccctcctgtagcagagggaaaggctcatcctcccactcagattctaaacagagagagagaaactgtgcctgttgaacttgaacctaaaaggaccattcaaagcctgaaagaaaaaacagaaaaagtaaaagatcctaagactgctgctgatgtggtcagccctggggccaactctgttgatagcagagtgcaaagaccaaaagaagagagttcagaagatgaaaatgaagtgtctaatattttgagaagtggtagatccaagcagttctataatcaaacttatggaagcaggaagtacaaaagtgattggggctattctggtaggggtggatatcaacatgtgagaagtgaggagtcctggaaaggacagccaagcagaagtcgggatgaaggttatcagtaccatcgaaatgtcagagggcgaccatttaggggagataggaggagatcagggatgggagatggccataggggacagcacacttgatggttgttgccgaagtattttctaacagaaactcttaggtggaatgtttctgaaggctttaaaaaaaatacaataaagtaaaaaccgcagttggaactctttcctctccccagccccccttaccttcactcccatactggacaagacattttggacatgagttcaagggggcaggttaattcctggcattgccagttttcttcattcagaatctgtttgttgatcaagtgactgtccccgtaaaaagtagaagataagtttgttaaagtattttttataaacagcttaatataaaacattatagatttagtgtttggcttttttccttataagtttataagtttgatttcagatgttggaaatgtgtgctttatagtgtttactaaagtgacaagaaaatataccatttgacacactatagattccaaacataacgttgcaccaaatagaaatgtatattttattatgcaatgccttagtcataaactgggctcaaacaattctcagcctaaaacactgttgtcttttaaaatgcttccaacccaaaggcctttcatctcaatatctgtcaaacttgaataatgtcttctctttaatattcacataaggcagcctattaactgtgtcttagcaatgttgtatatagttcttttaatattcataaggtatatttttgaattttggtatttgttgagattgcatagaagaatagtaggaaatccaatgaaatggctgtttccaccaagaattcttagcactggtgtaaatatcatggtgcctactcgaaagaaatgtagatgctatgcattttgaaaataatctgcatcagttagaactgcagaagtttttttaatgccactttaacactaatgcactgacagattctaaatattttgtgagaagaaatgttaaaaatttttagcttgacaggtttctagagttgttttcttcctcccccccccccccgcaccattggttgtgtatcactttcactttacacttgcatgttctacttgtcagggctggaactattgtatagaagataatatgattgtgacttctagttcttttctagaggatgctgctagaaaatggttttgctttgtattttatagcttgttacccttaggtaggtaacatcttacattctgttttcttccagtctttgcagtattcactagaggttccctttgcatgttgcactctgttctcatttggagattgaactctgaattaacacagtattcattcatctgtgttattttgtaaaaataactgtagcttatattctttatttgtgcataccaatgtgaaaatccactcttttattatgttgagattatcttctgatcaggaagtttgagtgctatgcaaataacatagtagtaatttctctttgcatgccatgtgtaatatacctagccaaaaccagatgcggtgactttctttttttgtaaagcaaattacttaagaaaatacaattcacttgaatttgacaaactgaaacagatgggttttctgggttctctgataacctatgggaatgtttggatgccagttgggctagtgaatcgccactgtactgtaataatggttatttacctctgtgctgttttaattacctaacgtctgtgtaactgctgatttgagtagtgattagcatttagataatgtaacaggattttagagagcactttgaaagataacattttattatgatggtgctaggtaaaaaattgtaaagactgggatggttgtgtggaaaacttttcttgagagaacctattgaaaggaatttgttgtcaccttcttaactagaatagttgttgaaggtaccgcttaagccatttttttcttaacatcggtggctcagttaaggaatgagaagatagagggtcctccactttcagctcatgcttttttatgtaggactagcttacctgattttaatgaaaatcacattttgatacaaacaccagatttgaaagttcaatgtgtttgatctcaggagtccaaaataagttgttgcttctagtgtcctgcattttattgactggggtttgatctcagcttctgaaaatgtttaaaaattggaaggaaatactactcatatcttcattgtcactttgtcttacctcaattgagtaacagaatatagctcctgaaggaaacactgatttgctttctgtttcccatatctcacctctaggatatgatggaagaagtgcttgaaagagaattttagcagatggtacttttctcagtgacctctggaataaaagaactgacttttgatagttttaaaattaatctttgcatgaaggttggtttcgctttttttcctttaagtttgtttttaaatgtattagtccaggggattttgccttatgctgaggtcaaactaaggataagcaagcttttgtccttcattttaactgttatgtcatactgttatgttgacatatttctttataagagaatagaggcaaaagtatagaactgaggatcatttgtatttttgagttggaaattatgaaacttcaccatattatgatcatacatattttgaagaacagactgaccaaagctcacctgttttttgtgttaggtgctttggctgaacttgattccagcccccttttccctttggtgttgtgtatgtctcttcatttcctctcaaatcttcaactcttgccccatgtctccttggcagcaggatgctggcatctgtgtagtcctcatactgtttactgataacccacaaattcattttcatggcagacctaagctcagaccctgccttgtcctggcaagcataggttttcccagaccacaatgctgatatatcttatttaatgcagactgtattcttgcagcgtgttgtttcctttgtgactcaaggttgaattaaaatgcctgtgaactgcaaacttgcttatgattgacttggtgcaataaagttcctttctaaccatttctggtttagaaaacattcagccatcctagaaactagcaatatttatttttgcctctttcgttttaccttcatttttagatgaggtaaatgttttgtcttttacttaagggtactaagcaaggtccactctagtgtagctgaagagaatgcatatttggctacactatttctgtttactgtattttgcttcctactttatgtctaaatgctattgtttgtttaaaatcctaataatgtctcatttccaatatgttattttcagataactaaggttttgctactaatgtcagccatttactctcccactaattgggattattttttaaaagaggtctttctccccgaaatacaagttttagaaaatcttagaagaggggtgggtgcatgtcttaatgctgggaagcggcaactttggggttgaacttacttgaatggattaaaaattgcattgtgttacagagctagaaaattttatgtatgaaaaacgataatagccttacactgagtacaaataatactttaagagcatgtgaagatgtgatcatttgtgatgttacttgtaaaaaaaagtatatatacatatcttttgaagtgttaaaaggaaactagtactttatattctttatcatatcactttttgtaagtgttgaatatattcctgtttatttttctatgttctgttttgtagccttaagaagtgtttcaaacatatctgaatgtataaaataagagtaaatgccctacatggtgtgatgctgcattatatataaaactgtgtgcatatattaaattttgtctcttgat

SEQ ID NO: 21244 - DNA, 543 bp, Homo sapiens
aaattaacggggtgtctctctcctgatgaagagtgttgctgtggggtatgttcacagccacccactgcctccggtccttattgttagtaggtattgcactctcagtctcgccatgttgaagtcagaatggcctgtattcactatcttcgagagaacagagagaaatttgaagcgtttatagaaggatcatttgaagaatatttaaagcgtttggaaaatccacaggaatgggtaggacaagtggaaataagtgccctttctcttatgtacaggaaagattttataatttatcgggaaccaaatgtttctccttcacaagtaacagaaaataattttcctgaaaaggtgttactgtgtttttcaaatggaaatcattatgatattgtgtatcccataaagtataaagaaagctctgctatgtgtcagtctctcctttatgaattgctgtatgagaaggtatttaaaactgatgttagtaaaattgtgatggaactagacacgttggaagtagctgatgaagataacagtgaaatatcagattca

SEQ ID NO: 21245 - DNA, 864 bp, Homo sapiens
ttacactaagaactctttgttacatcaggtattgcactctcagtctcgccatgttgaagtcagaatggcctgtattcactatcttcgagagaacagagagaaatttgaagcgtttatagaaggatcatttgaagaatatttaaagcgtttggaaaatccacaggaatgggtaggacaagtggaaataagtgccctttctcttatgtacaggaaagattttataatttatcgggaaccaaatgtttctccttcacaagtaacagaaaataattttcctgaaaaggtgttactgtgtttttcaaatggaaatcattatgatattgtgtatcccataaagtataaagaaagctctgctatgtgtcagtctctcctttatgaattgctgtatgagaaggtatttaaaactgatgttagtaaaattgtgatggaactagacacgttggaagtagctgatgaagataacagtgaaatatcagattcagaggatgacagttgcaagtaagaatgaaatcctaaaatacctttcttagtgccatacaaggaaagttaagtaaatgtctttacatttcagtaaatgtctttctataacatatattgaggtattaatggtattcataaaatacagcagtctgctgaagtttctttatccctgtcactaattttacctaatttctattatgggactgtttgttttgaaagttggtgtttttggttgatgagaatttacgtctgcaatctagatgcatatttgtagaataaatttggtcctacctatatgtgtgtgtattgtaaaattttaaagttaacttgtcaattgttcacatacccagtaatgaaataaaatggccgtttggatttccttca

SEQ ID NO: 21246 - DNA, 2740 bp, Homo sapiens
ccgggttctctcccggcgtgccccgcgccgggtttgttggggggtactcggcagtgcagccatgactatactccccaaaaagaagccgccgcctcccgacgccgaccccgccaacgagccgccgccgcccgggccgatgcccccggcgccgcggcgcggcggaggtgtgggcgtgggcggcggcggcacgggcgtgggcggcggcgatcgcgaccgtgactccggcgtcgtgggggcccgtccgcgagcttcgccaccgcctcaaggcccgctaccaggaccgccgggcgctcttcatcgctgggcgctggccgtgccgcctggtgcagtggcgggtccccggccacaacaggcttctccacctccttgcgggggcccaggtggtcccggcggcggtcccggcgacgcgctgggcgcagcggcggcgggtgtgggtgccgcgggcgtggtggtgggtgtgggtggtgccgtaggcgtgggcggctgctgctccgggcctgggcacagcaagcggcgacgtcaagctcccggggttggcgcggttggcgggggcagtcccgagcgtgaggaggtcggcgcaggctacaacagtgaggacgagtatgaggcggctgcagcacgcatcgaggctatggaccctgccactgtcgagcagcaggagcattggtttgaaaaggccctacgagacaagaagggcttcatcatcaagcagatgaaggaggatggcgcctgtctcttccgggctgtagctgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacaggtacttctgcagtggaacccatcaacacattccatgggatacatcaaaacgaggacgaacccattcgtgttagctaccatcggaatatccactataattcagtggtgaatcctaacaaggccaccattggtgtggggctgggcctgccatcattcaaaccagggtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccagtactcctgctctccggtgccacctcaccttctttggcttcttccctcttgcctccttctgttctttctgctctcccctcttttccctcctcctcacttccctctggctagcccacccctgcactctctctcattgccgctgccactatcacctgtctctctgccagctgatgtgccctgttgccccccaccccatcccgcacagaaccatccctgcattccacaggggactcgggcaagggtgccgaagatagacaagaggcacacagagacagaccaactggcagccaggcagccccagaggagagagacattcagacagaggaaagtctccctgcccctcattccttccaagatgagaaaaacttgccgccaccccccgacactgatgccagggaggtgggaggaagaagtgggaaatttcccttcccagtacccccaagaacgtctgagccttcaatgttgaattttttctttattaaaattacttttatcttataaaatcaactaatcaaaaatgatatagacgacagcactggctctgtgaaggtggcatctttctgggcaggcaggccatggggcatggaggagggtgcaaagatatgggttgctgtcttctggcctccagctgcatggaggccggcccagggtctagggtgtgcactgggcaagggcagggcggcaggtgtcaggccggcttggacaatgaaaccctgaccttgctgcattccttttgcttccaccaccactagcttctttggaatcttggggtgggggtcatctttggggattatggctgccacccgggatttgagtgtagggagtgtgggagcagccttggcagatggggcacccgtgccctgcaggtgttgacaagatccgccatctgtaatgtccttggcacaataaaaccaaatgtcagtttc

SEQ ID NO: 21247 - DNA, 2692 bp, Homo sapiens
tttgttggggggtactcggcagtgcagccatgactatactccccaaaaagaagccgccgcctcccgacgccgaccccgccaacgagccgccgccgcccgggccgatgcccccggcgccgcggcgcggcggaggtgtgggcgtgggcggcggcggcacgggcgtgggcggcggcgatcgcgaccgtgactccggcgtcgtgggggcccgtccgcgagcttcgccaccgcctcaaggcccgctaccaggaccgccgggcgctcttcatcgctgggcgctggccgtgccgcctggtgcagtggcgggtccccggccacaacaggcttctccacctccttgcgggggcccaggtggtcccggcggcggtcccggcgacgcgctgggcgcagcggcggcgggtgtgggtgccgcgggcgtggtggtgggtgtgggtggtgccgtaggcgtgggcggctgctgctccgggcctgggcacagcaagcggcgacgtcaagctcccggggttggcgcggttggcgggggcagtcccgagcgtgaggaggtcggcgcaggctacaacagtgaggacgagtatgaggcggctgcagcacgcatcgaggctatggaccctgccactgtcgagcagcaggagcattggtttgaaaaggccctacgagacaagaagggcttcatcatcaagcagatgaaggaggatggcgcctgtctcttccgggctgtagctgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacagaacccatcaacacattccatgggatacatcaaaacgaggacgaacccattcgtgttagctaccatcggaatatccactataattcagtggtgaatcctaacaaggccaccattggtgtggggctgggcctgccatcattcaaaccagggtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccagtactcctgctctccggtgccacctcaccttctttggcttcttccctcttgcctccttctgttctttctgctctcccctcttttccctcctcctcacttccctctggctagcccacccctgcactctctctcattgccgctgccactatcacctgtctctctgccagctgatgtgccctgttgccccccaccccatcccgcacagaaccatccctgcattccacaggggactcgggcaagggtgccgaagatagacaagaggcacacagagacagaccaactggcagccaggcagccccagaggagagagacattcagacagaggaaagtctccctgcccctcattccttccaagatgagaaaaacttgccgccaccccccgacactgatgccagggaggtgggaggaagaagtgggaaatttcccttcccagtacccccaagaacgtctgagccttcaatgttgaattttttctttattaaaattacttttatcttataaaatcaactaatcaaaaatgatatagacgacagcactggctctgtgaaggtggcatctttctgggcaggcaggccatggggcatggaggagggtgcaaagatatgggttgctgtcttctggcctccagctgcatggaggccggcccagggtctagggtgtgcactgggcaagggcagggcggcaggtgtcaggccggcttggacaatgaaaccctgaccttgctgcattccttttgcttccaccaccactagcttctttggaatcttggggtgggggtcatctttggggattatggctgccacccgggatttgagtgtagggagtgtgggagcagccttggcagatggggcacccgtgccctgcaggtgttgacaagatccgccatctgtaatgtccttggcacaataaaaccaaatgtcagttt

SEQ ID NO: 21248 - DNA, 2682 bp, Homo sapiens
ccgggttctctcccggcgtgccccgcgccgggtttgttggggggtactcggcagtgcagccatgactatactccccaaaaagaagccgccgcctcccgacgccgaccccgccaacgagccgccgccgcccgggccgatgcccccggcgccgcggcgcggcggaggtgtgggcgtgggcggcggcggcacgggcgtgggcggcggcgatcgcgaccgtgactccggcgtcgtgggggcccgtccgcgagcttcgccaccgcctcaaggcccgctaccaggaccgccgggcgctcttcatcgctgggcgctggccgtgccgcctggtgcagtggcgggtccccggccacaacaggcttctccacctccttgcgggggcccaggtggtcccggcggcggtcccggcgacgcgctgggcgcagcggcggcgggtgtgggtgccgcgggcgtggtggtgggtgtgggtggtgccgtaggcgtgggcggctgctgctccgggcctgggcacagcaagcggcgacgtcaagctcccggggttggcgcggttggcgggggcagtcccgagcgtgaggaggtcggcgcaggctacaacagtgaggacgagtatgaggcggctgcagcacgcatcgaggctatggaccctgccactgtcgagcagcaggagcattggtttgaaaaggccctacgagacaagaagggcttcatcatcaagcagatgaaggaggatggcgcctgtctcttccgggctgtagctgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacagaacccatcaacacattccatgggatacatcaaaacgaggacgaacccattcgtgttagctaccatcggaatatccactataattcagtggtgaatcctaacaaggccaccattggtgtggggctgggcctgccatcattcaaaccagggtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccagggactcgggcaagggtgccgaagatagacaagaggcacacagagacagaccaactggcagccaggcagccccagaggagagagacattcagacagaggaaagtctccctgcccctcattccttccaagatgagaaaaacttgccgccaccccccgacactgatgccagggaggtgggaggaagaagtgggaaatttcccttcccagtacccccaagaacgtctgagccttcaatgttgaattttttctttattaaaattacttttatcttataaaatcaactaatcaaaaatgatatagacgacagcactggctctgtgaaggtggcatctttctgggcaggcaggccatggggcatggaggagggtgcaaagatatgggttgctgtcttctggcctccagctgcatggaggccggcccagggtctagggtgtgcactgggcaagggcagggcggcaggtgtcaggccggcttggacaatgaaaccctgaccttgctgcattccttttgcttccaccaccactagcttctttggaatcttggggtgggggtcatctttggggattatggctgccacccgggatttgagtgtagggagtgtgggagcagccttggcagatggggcacccgtgccctgcaggtgttgacaagatccgccatctgtaatgtccttggcacaataaaaccaaatgtcagtttccctgagcgactctgttctgtgtggggcaggggttgggcgggcctctgggcagaggatgcaatggcacggaccttggcttgacctcagaggtgtgaatgctctccagcagggtctgtctgggggcctggagtttgtatttgatttgctgcttattaaacctccttctggacctattgccactgg

SEQ ID NO: 21249 - DNA, 1493 bp, Homo sapiens
gtgacgctacaggggccagctatgctcccgggagtgttgatgttttccagtcattccggctgacagcgttcaagttggaatcctggaggggaggtgtttttcctgtcgtacgtgggacaggccacgctgtccgtccgcagtaccgacgcctgcagcaggagcattggtttgaaaaggccctacgagacaagaagggcttcatcatcaagcagatgaaggaggatggcgcctgtctcttccgggctgtagctgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacagaacccatcaacacattccatgggatacatcaaaacgaggacgaacccattcgtgttagctaccatcggaatatccactataattcagtggtgaatcctaacaaggccaccattggtgtggggctgggcctgccatcattcaaaccagggtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccagtactcctgctctccggtgccacctcaccttctttggcttcttccctcttgcctccttctgttctttctgctctcccctcttttccctcctcctcacttccctctggctagcccacccctgcactctctctcattgccgctgccactatcacctgtctctctgccagctgatgtgccctgttgccccccacccc

SEQ ID NO: 21250 - DNA, 2775 bp, Homo sapiens
atgactatactccccaaaaagaagccgccgcctcccgacgccgaccccggcggcacgggcgtgggcggcggcgatcgcgaccgtgactccggcgtcgtgggggcccgtccgcgagcttcgccaccgcctcaaggcccgctaccaggaccgccgggcgctcttcatcgctgggcgctggccgtgccgcctggtgcagtggcgggtccccggccacaacaggcttctccacctccttgcgggggcccaggtggtcccggcggcggtcccggcgacgcgctgggcgcagcggcggcgggtgtgggtgccgcgggcgtggtggtgggtgtgggtggtgccgtaggcgtgggcggctgctgctccgggcctgggcacagcaagcggcgacgtcaagctcccggggttggcgcggttggcgggggcagtcccgagcgtgaggaggtcggcgcaggctacaacagtgaggacgagtatgaggcggctgcagcacgcatcgaggctatggaccctgccactgtcgagcagcaggagcattggtttgaaaaggccctacgagacaagaagggcttcatcatcaagcagatgaaggaggatggcgcctgtctcttccgggctgtagctgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacagaacccatcaacacattccatgggatacatcaaaacgaggacgaacccattcgtgttagctaccatcggaatatccactataattcagtggtgaatcctaacaaggccaccattggtgtggggctgggcctgccatcattcaaaccagggtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccagtactcctgctctccggtgccacctcaccttctttggcttcttccctcttgcctccttctgttctttctgctctcccctcttttccctcctcctcacttccctctggctagcccacccctgcactctctctcattgccgctgccactatcacctgtctctctgccagctgatgtgccctgttgccccccaccccatcccgcacagaaccatccctgcattccacaggggactcgggcaagggtgccgaagatagacaagaggcacacagagacagaccaactggcagccaggcagccccagaggagagagacattcagacagaggaaagtctccctgcccctcattccttccaagatgagaaaaacttgccgccaccccccgacactgatgccagggaggtgggaggaagaagtgggaaatttcccttcccagtacccccaagaacgtctgagccttcaatgttgaattttttctttattaaaattacttttatcttataaaatcaactaatcaaaaatgatatagacgacagcactggctctgtgaaggtggcatctttctgggcaggcaggccatggggcatggaggagggtgcaaagatatgggttgctgtcttctggcctccagctgcatggaggccggcccagggtctagggtgtgcactgggcaagggcagggcggcaggtgtcaggccggcttggacaatgaaaccctgaccttgctgcattccttttgcttccaccaccactagcttctttggaatcttggggtgggggtcatctttggggattatggctgccacccgggatttgagtgtagggagtgtgggagcagccttggcagatggggcacccgtgccctgcaggtgttgacaagatccgccatctgtaatgtccttggcacaataaaaccaaatgtcagtttccctgagcgactctgttctgtgtggggcaggggttgggcgggcctctgggcagaggatgcaatggcacggaccttggcttgacctcagaggtgtgaatgctctccagcagggtctgtctgggggcctggagtttgtatttgatttgctgcttattaaacctccttctggacctattgccactgg

SEQ ID NO: 21251 - DNA, 2077 bp, Homo sapiens
ggcgtggtggtgggtgtgggtggtgccgtaggcgtgggcggctgctgctccgggcctgggcacagcaagcggcgacgtcaagctcccggggttggcgcggttggcgggggcagtcccgagcgtgaggaggtcggcgcaggctacaacagtgaggacgagtatgaggcggctgcagcacgcatcgaggctatggaccctgccactgtcgagcagcaggagcattggtttgaaaaggccctacgagacaagaagggcttcatcatcaagcagatgaaggaggatggcgcctgtctcttccgggctgtagctgaccaggtgtatggagaccaggacatgcatgaggttgtgcgaaagcattgcatggactatctgatgaagaatgccgactacttctccaactatgtcacagaggactttaccacctacattaacaggaagcggaaaaacaattgccatggcaaccacattgagatgcaggccatggcagagatgtacaaccgtcctgtggaggtgtaccagtacagcacaggtacttctgcagtggaacccatcaacacattccatgggatacatcaaaacgaggacgaacccattcgtgttagctaccatcggaatatccactataattcagtggtgaatcctaacaaggccaccattggtgtggggctgggcctgccatcattcaaaccagggtttgcagagcagtctctgatgaagaatgccataaaaacatcggaggagtcatggattgaacagcagatgctagaagacaagaaacgggccacagactgggaggccacaaatgaagccatcgaggagcaggtggctcgggaatcctacctgcagtggttgcgggatcaggagaaacaggctcgccaggtccgaggccccagccagccccggaaagccagcgccacatgcagttcggccacagcagcagcctccagtggcctggaggagtggactagccggtccccgcggcagcggagttcagcctcgtcacctgagcaccctgagctgcatgctgaattgggcatgaagcccccttccccaggcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccagggactcgggcaagggtgccgaagatagacaagaggcacacagagacagaccaactggcagccaggcagccccagaggagagagacattcagacagaggaaagtctccctgcccctcattccttccaagatgagaaaaacttgccgccaccccccgacactgatgccagggaggtgggaggaagaagtgggaaatttcccttcccagtacccccaagaacgtctgagccttcaatgttgaattttttctttattaaaattacttttatcttataaaatcaactaatcaaaaatgatatagacgacagcactggctctgtgaaggtggcatctttctgggcaggcaggccatggggcatggaggagggtgcaaagatatgggttgctgtcttctggcctccagctgcatggaggccggcccagggtctagggtgtgcactgggcaagggcagggcggcaggtgtcaggccggcttggacaatgaaaccctgaccttgctgcattccttttgcttccaccaccactagcttctttggaatcttggggtgggggtcatctttggggattatggctgccacccgggatttgagtgtagggagtgtgggagcagccttggcagatggggcacccgtgccctgcaggtgttgacaagatccgccatctgtaatgtccttggcacaataaaaccaaatgtcagtttccctga

SEQ ID NO: 21252 - DNA, 1689 bp, Homo sapiens
agcaaatttcaactcccgcttgccattcaacatcatggatgatccgaagagtgaacagcagcgcatactgcgccgccaccaacgcgagaggcaggagctgcaggcccagatccggagcttaaaaaactcggtccccaagaccgacaagacgaaaagaaagcagttgctccaagacgtggcccgcatggaggccgagatggctcagaagcaccggcaggagctggagaagttccaagacgacagtagcattgaatctgtcgtcgaagacctggccaagatgaatctggaaaaccggcctccccgctcctccaaagcccacagaaagagagaaagaatggagtccgaggagagggagcgccaggagagcatcttccaggctgagatgtcggagcacctggccggcttcaagcgcgaggaggaggagaagctcgccgccatcctgggagccaggggtctggagatgaaagcgatcccggccgacggccactgcatgtaccgcgccatccaagaccagctggtgttcagcgtgtctgtggagatgctgcgctgccgcaccgccagctacatgaagaagcacgtcgacgagttcctgcccttcttcagcaaccccgagaccagcgactccttcggctacgacgacttcatgatctactgcgacaacatcgtgcgcaccacggcatggggaggccagctggagctgagggccctgtcgcacgtcctgaagacccccatcgaggtgatccaggccgactcgcccaccttgatcatcggggaggagtacgtcaagaagccgatcatcctggtctacctgcgctatgcctacagcctcggcgagcactacaactccgtgacaccgctcgaggccggcgccgccgggggcgtgctcccgcgtctcctgtaggccccaaggcgctgagcagccccgggaaactgtcgccgtcgccgcatctcctcagtaggctcagtttattttccccttttgcttttctctgtttttcttttccttccttttaatcaaaactacccgcccccgccccgcccccgctttcctaaccttgctgctttcacagggtgggaaacgaaattcgagggaaattccccggaaatatgagggaaatctctgcattgcaccaccagaggggcataaatttgaaagttctaacctcttcttgcccttaagggtcttttacctccctcaccaactaagatttggtcatgttgcgtataacttcaccacaaaaatggaaatattggccgggcgcggtggctcacgcctgtaatcccagcactttgggaggccgaggcgggcggatcacgaggtcaggagttcgagaccagcctggccaacatggtgaaaccccacctctacaaaaaatacaaaaattagccgggcgtggtggcaggcacctgtagtcccagatactcgggaggctaaggcaggagaatcgcttgacgggaagcggaggttgcagtgagccgagatcgtgcctttgcactccagcgtggaagacagtgagactccgtctcaaaaaaatgaaaaattagccaggcaggttggcgggggcctgtaatcctagctacttggggtgctgaggcaggagaatcaactgaacccgggaggcggaggctgcagtgggccgggatcgtactactgcactccagcatggaagacagcgagactccgtctcc

SEQ ID NO: 21253 - DNA, 3298 bp, Homo sapiens
gcgcacgcgcagcaccccatttaagtttctcgtctttgcagtggctttgcttagatccggtgccgccttgaaggcggggctgggtcccagccgtagccaatggagccccgggtgagggttgaggggtggaaggtgcctactagccggtgcaggtttcttctagcgcgtgtgctggggtacctggtcgtcatggaggcggtattgaccgaagagcttgatgaggaagagcagctgctgagaaggcatcgcaaagagaagaaggagttgcaagccaaaattcagggcatgaagaatgctgttcccaagaatgacaagaagaggaggaagcaactcaccgaagatgtggccaagttggaaaaagaaatggaacagaaacatagagaggaactggagcaattgaagctgactactaaggagaataagatagattctgttgctgttaacatttcaaacttggtgcttgagaatcagccacctcggatatcaaaagcacaaaagagacgggaaaagaaagctgcattggaaaaggagcgagaagaacggatagctgaagctgaaattgaaaacttaacaggagccagacatatggaaagtgagaaacttgctcaaatattggcagctagacagttagaaattaaacagattccatctgatggccactgtatgtataaagccattgaagatcaactgaaagaaaaggattgtgctctgactgtggttgccttgagaagtcagaccgctgagtatatgcaaagccatgtggaagactttctgccatttttaacaaaccctaatacaggagatatgtatactccagaagaatttcagaagtactgtgaagatattgtaaacacagctgcatggggaggtcagcttgagctaagagctctgtctcacattttacaaacaccaatagagataatacaggcagattctcctcccattatagttggtgaagaatattcaaaaaaaccactaatacttgtatatatgagacatgcatatggcttaggagaacattataattcggttacacggttggtaaacatagttactgaaaattgcagctaatttatacaatgttgtacaattatgttttaatacagtgtgctgaactgagtatttctaccaagtgttgggttgttctaaatgctactgaaaaacacaactaccttatatcagttttatggcaaagctactaacaggtgtttttagaaatatgtcagagataaactttaaccagtgtcttcttagtggaattttaaaaatttgttaagttcattgtagagaacaccattcatagaccaagatggtcccctattagctgatattttcatttatgtaagatcctggacattctgttttgtgttggaacaaattttcaatgtttttaattctcccttttctgcctgttcctaaaaactttcaaaataaccatttcaatgtaatttgtcttgaagaagtttacccaatatctttgtcattgcaataatgtagtatggtgatggtcaatttaattattgcttataaaatgaacttgattgcagtaaccatggtatcgatgagactaatgcagtgaagctttattactaatatatatagccttatcaaagcaagctaagaagcttgctttaataattaataatttaaaaatatttatttagatgggattcagttgtttaaagaagtgagataaattcaaaggtaaataggtattctctgtcaaatttaaatctctaaagaattagagattagttttttatttgtgtataatttaaaaaagacctaataggttactgtctttttaatgcatttgttattctttcgtattttttaagcatcggactggagttagtaccatcatctcttgagtctttcataactacacatttttatatttccttttgtgttttctactttgctttccttgaaggaacaagcattttgtggcctttaccttgtgcaattttagggagtagcagtgtaaaaggtccaagaccacatttacttgaaattcttcctcttttctgatttgtcttaccagatatttcccttcttgcctcattctctaggatttgaataaaacctttgccacttattttattagccttattaatgtcacctttccttcaactcaaatatttgagaaattttatgttacatatatgaatgaagttgaaagctactgtttggaagctaagacttgtatagagtagttttgtatatgaatggttgttctagctcagatttcaggttactcacaacagtattctttctaagaggatatatacaaatgtctctcataatttatgtaaggaaatattatgaaaatgagacttttttagtttgatgtgtgtttcccaaactagagataaaactagtaagatttagtatcgtttataacatttgaatttttgctccatgagtacaactaatttttataagtaaatattgggtttatatgaaaaatggggtgtcagtcttttcacacgcccagcaggtaacaatgtgggaagctggcagggtcattgatagcaagtaagtacttcctgaaggctttccagttcaaaagattacaagccattctgcctgccaaacaaattatattctgaagatgcctgttttgtaacccttgatgtgaattttttggtgtctgaaatttacaaaagaatgaaattgaaattgtaaaacactaaatgctttgggtttattttgaagtaatctgttactttaaaatgtcaacattaggaagccataaaacaagatattatgaaacccagtattataaatgttatctacatctaaagtattttaaaataacttattggcagctttattctttttttccttacaagatttagaatctttttggttatatgtctatttttcaattttgttatatttttaatttaagtggccaatgtggttatgaacaagatttgtatggtcagcttctgttctttcctaaaacttcagataaatatcattttagctataacctaaaaaagtgtttaaataaaatgacagatgttaatttaaaagcagcatatgctaatttactttttcatatgatgatggtctaatggaagttacatatgctttcttttgtcctaactctgaaaagtatatgtcagagttctggaatatgtctttagccaagaattttattcacttaaatttgtttacaacttgtataaagcaaaaaagaatgtgtgtaactatagtgaacgcatagttttgcttatattatgtgatgtttgccaaaaaaagaataaaaaatgaatgaattaaatcaaca

SEQ ID NO: 21254 - DNA, 1631 bp, Homo sapiens
aaggtgcctactagccggtgcaggtttcttctagcgcgtgtgctggggtacctggtcgtcatggaggcggtattgaccgaagagcttgatgaggaagagcagctgctgagaaggcatcgcaaagagaagaaggagttgcaagccaaaattcagggcatgaagaatgctgttcccaagaatgacaagaagaggaggaagcaactcaccgaagatgtggccaagttggaaaaagaaatggaacagaaacatagagaggaactggagcaattgaagctgactactaaggagaataagatagattctgttgctgttaacatttcaaacttggtgcttgagaatcagccacctcggatatcaaaagcacaaaagagacgggtgcctggatagaaggagctctctgtgttgtccttggtccctgctctgctcttaccagctgtatggcctttggaaatctttctgcgtgctgtttcctcagaagaggaaaatgaggggttttggattagatgatatctaaggaaaagaaagctgcattggaaaaggagcgagaagaacggatagctgaagctgaaattgaaaacttaacaggagccagacatatggaaagtgagaaacttgctcaaatattggcagctagacagttagaaattaaacagattccatctgatggccactgtatgtataaagccattgaagatcaactgaaagaaaaggattgtgctctgactgtggttgccttgagaagtcagaccgctgagtatatgcaaagccatgtggaagactttctgccatttttaacaaaccctaatacaggagatatgtatactccagaagaatttcagaagtactgtgaagatattgtaaacacagctgcatggggaggtcagcttgagctaagagctctgtctcacattttacaaacaccaatagagataatacaggcagattctcctcccattatagttggtgaagaatattcaaaaaaaccactaatacttgtatatatgagacatgcatatggcttaggagaacattataattcggttacacggttggtaaacatagttactgaaaattgcagctaatttatacaatgttgtacaattatgttttaatacagtgtgctgaactgagtatttctaccaagtgttgggttgttctaaatgctactgaaaaacacaactaccttatatcagttttatggcaaagctactaacaggtgtttttagaaatatgtcagagataaactttaaccagtgtcttcttagtggaattttaaaaatttgttaagttcattgtagagaacaccattcatagaccaagatggtcccctattagctgatattttcatttatgtaagatcctggacattctgttttgtgttggaacaaattttcaatgtttttaattctcccttttctgcctgttcctaaaaactttcaaaataaccatttcaatgtaatttgtcttgaagaagtttacccaatatctttgtcattgcaataatgtagtatggtgatggtcaatttaattattgcttataaaatgaacttgattgcagtaaccatggtatcgatgagactaatgcagtgaagctttattactaatatatatagccttatcaaagcaagcta

SEQ ID NO: 21255 - DNA, 3042 bp, Homo sapiens
gttctctcgctcaggtctctgcatgtagttgtcacttgcagctccatttccatcacgtggtaaaatgccctttctcttctttcctgcagatggatggtttctagtgtgcttccaaaccccacctcggctgagtgttgggcagcacttctacatgatcctatgactcttgatatggacgcagtcctgtcagactttgttcggtccacgggggcagaacctggtctggccagagacctgctggaaggcaaaaactgggacctgacagccgctctgagcgactatgagcagctccgccaggtgcacacagccaatctgccacatgtgttcaatgaagggcggggtcccaagcagccagagcgagagccacagcccgggcacaaggtggagcgaccctgcctgcagaggcaggacgacattgcccaagaaaagcggctttcccgggggatttcccacgccagctcagccatcgtctccctggcccggtcccacgtggcaagtgaatgcaacaacgagcagttccccctggagatgccaatctacacattccagttgccagacctgagcgtgtacagcgaggatttcaggagcttcatcgagcgggacttgatcgagcaggcaacaatggtggctttggagcaggcaggtcgcctgaactggtggtccactgtgtgcacgagctgtaaacggcttcttcctctggccacaacaggggatgggaactgccttttacatgctgcttcactgggaatgtgggggtttcacgaccgggacctggtgttacggaaagctctctataccatgatgaggacgggagctgagagggaagccctgaagcggaggtggaggtggcagcagacgcagcagaataaggaggaggagtgggagcgggagtggacggagctgctgaagctggcctccagcgagccgcgcacacacttcagcaagaatggcggcacgggcgggggtgtggacaactctgaggaccccgtgtacgagagcctggaagagttccacgtttttgtcctagcccatatattaagaaggcccatcgttgttgtggcagatacaatgttaagagactcaggtggagaagcgttcgcacccatcccattcggagggatctacctgcccttggaggtccctcccaacagatgccactgctcgcctctggttctggcctatgatcaagcccatttctctgcccttgtgtccatggaacagagagaccagcaaagagaacaagccgtgatccccctgacggattctgagcacaagctgctgcctctgcactttgcagtggaccctggcaaggactgggagtgggggaaagacgacaacgataacgcccggctggcccaccttatcctgtcgctagaagccaagctgaaccttctgcacagctacatgaacgtgacgtggatccggatcccctccgagacacgggcgcccctggcacagccggagtctcccacggcctcggcaggggaggacgtgcagtccctggccgactcgctggactcggaccgcgattcggtgtgcagcaattctaacagcaataacggcaagaacggcaaggacaaggagaaggagaagcagcgcaaggagaaggacaagacgcgcgccgactccgtggccaacaagctgggcagcttcagcaagacgctgggcatcaagctgaagaaaaacatgggcggcctcggcggcctggtgcacggcaagatgggccgcgccaactccgccaatggcaagaacggggactcggccgagcggggcaaggagaagaaggccaagtcgcgcaagggcagcaaggaggagtctggtgcgtcggccagcacgtcgccgtcggaaaagaccacgccgtcgcccacagacaaggcagcgggcgcgtcgccggcggagaagggcggtgggccgcggggcgacgcctggaagtacagcacggatgtgaagctgagcctcaacatcctgcgcgccgccatgcagggggagcgcaagttcatcttcgccggcctgctgctcaccagccaccggcaccagttccacgaggagatgatcggctactacctgacgagcgcgcaggagcgcttcagcgccgagcaggagcagcggcgccgcgacgccgctactgcggccgccgctgccgccgccgccgccgccgccacggccaagcggccgccgcgcagaccggagacggagggcgtgccggtcccggagcgcgcctctccgggcccacccacgcagctggtgctcaagctcaaggagcggccgagccccgggcccgcggcagggcgtgcggcgcgggcggcggcgggcggcacggcctccccggggggaggcgcgcggcgtgcgagcgccagcggaccagtgcctggccgcagccccccggcgccagcgcgccagagcgtcatccacgtgcaggcgtcgggcgcgcgggacgaggcgtgcgcgccggccgtgggggcgctgcggccgtgcgccacgtacccgcagcagaaccgctcgctgtcgtcgcagagctacagcccggcgcgcgccgccgccctgcgcaccgtcaacacggtcgagtcgctggcgcgcgcggtgcccggggccctaccgggcgcggcggggacggcgggggcggccgagcacaagtcgcagacctacaccaacggcttcggcgccctgcgcgacggcctggagttcgccgacgccgacgcgccgaccgcgcgctcgaacggtgagtgcggccgtggcggcccggggccggtgcagcggcgctgccagcgcgagaactgtgcgttctacgggcgcgccgagaccgagcactactgctcctactgctaccgcgaggagctgcggcggcggcgcgaggcgcgcggggcccggccctgagcggcgcggcgcggcgcgggcggcgaggttctaccttcgaggatttcttttccattgtgtcggtgtcttttttacatgccctggtccaccggaaggccggcgcctcctctgtcagtgccgtgtacgtgtttggtcaaacgttcctaatggtgcctgaacctacactga

SEQ ID NO: 21256 - DNA, 3063 bp, Homo sapiens
gttctctcgctcaggtctctgcatgtagttgtcacttgcagctccatttccatcacgtggtaaaatgccctttctcttctttcctgcagatggatggtttctagtgtgcttccaaaccccacctcggctgagtgttgggcagcacttctacatgatcctatgactcttgatatggacgcagtcctgtcagactttgttcggtccacgggggcagaacctggtctggccagagacctgctggaaggcaaaaactgggacctgacagccgctctgagcgactatgagcagctccgccaggtgcacacagccaatctgccacatgtgttcaatgaagggcggggtcccaagcagccagagcgagagccacagcccgggcacaaggtggagcgaccctgcctgcagaggcaggacgacattgcccaagaaaagcggctttcccgggggatttcccacgccagctcagccatcgtctccctggcccggtcccacgtggcaagtgaatgcaacaacgagcagttccccctggagatgccaatctacacattccagttgccagacctgagcgtgtacagcgaggatttcaggagcttcatcgagcgggacttgatcgagcaggcaacaatggtggctttggagcaggcaggtcgcctgaactggtggtccactgtgtgcacgagctgtaaacggcttcttcctctggccacaacaggggatgggaactgccttttacatgctgcttcactgggaatgtgggggtttcacgaccgggacctggtgttacggaaagctctctataccatgatgaggacgggagctgagagggaagccctgaagcggaggtggaggtggcagcagacgcagcagaataaggagtcagggctggtgtacacagaggaggagtgggagcgggagtggacggagctgctgaagctggcctccagcgagccgcgcacacacttcagcaagaatggcggcacgggcgggggtgtggacaactctgaggaccccgtgtacgagagcctggaagagttccacgtttttgtcctagcccatatattaagaaggcccatcgttgttgtggcagatacaatgttaagagactcaggtggagaagcgttcgcacccatcccattcggagggatctacctgcccttggaggtccctcccaacagatgccactgctcgcctctggttctggcctatgatcaagcccatttctctgcccttgtgtccatggaacagagagaccagcaaagagaacaagccgtgatccccctgacggattctgagcacaagctgctgcctctgcactttgcagtggaccctggcaaggactgggagtgggggaaagacgacaacgataacgcccggctggcccaccttatcctgtcgctagaagccaagctgaaccttctgcacagctacatgaacgtgacgtggatccggatcccctccgagacacgggcgcccctggcacagccggagtctcccacggcctcggcaggggaggacgtgcagtccctggccgactcgctggactcggaccgcgattcggtgtgcagcaattctaacagcaataacggcaagaacggcaaggacaaggagaaggagaagcagcgcaaggagaaggacaagacgcgcgccgactccgtggccaacaagctgggcagcttcagcaagacgctgggcatcaagctgaagaaaaacatgggcggcctcggcggcctggtgcacggcaagatgggccgcgccaactccgccaatggcaagaacggggactcggccgagcggggcaaggagaagaaggccaagtcgcgcaagggcagcaaggaggagtctggtgcgtcggccagcacgtcgccgtcggaaaagaccacgccgtcgcccacagacaaggcagcgggcgcgtcgccggcggagaagggcggtgggccgcggggcgacgcctggaagtacagcacggatgtgaagctgagcctcaacatcctgcgcgccgccatgcagggggagcgcaagttcatcttcgccggcctgctgctcaccagccaccggcaccagttccacgaggagatgatcggctactacctgacgagcgcgcaggagcgcttcagcgccgagcaggagcagcggcgccgcgacgccgctactgcggccgccgctgccgccgccgccgccgccgccacggccaagcggccgccgcgcagaccggagacggagggcgtgccggtcccggagcgcgcctctccgggcccacccacgcagctggtgctcaagctcaaggagcggccgagccccgggcccgcggcagggcgtgcggcgcgggcggcggcgggcggcacggcctccccggggggaggcgcgcggcgtgcgagcgccagcggaccagtgcctggccgcagccccccggcgccagcgcgccagagcgtcatccacgtgcaggcgtcgggcgcgcgggacgaggcgtgcgcgccggccgtgggggcgctgcggccgtgcgccacgtacccgcagcagaaccgctcgctgtcgtcgcagagctacagcccggcgcgcgccgccgccctgcgcaccgtcaacacggtcgagtcgctggcgcgcgcggtgcccggggccctaccgggcgcggcggggacggcgggggcggccgagcacaagtcgcagacctacaccaacggcttcggcgccctgcgcgacggcctggagttcgccgacgccgacgcgccgaccgcgcgctcgaacggtgagtgcggccgtggcggcccggggccggtgcagcggcgctgccagcgcgagaactgtgcgttctacgggcgcgccgagaccgagcactactgctcctactgctaccgcgaggagctgcggcggcggcgcgaggcgcgcggggcccggccctgagcggcgcggcgcggcgcgggcggcgaggttctaccttcgaggatttcttttccattgtgtcggtgtcttttttacatgccctggtccaccggaaggccggcgcctcctctgtcagtgccgtgtacgtgtttggtcaaacgttcctaatggtgcctgaacctacactga

SEQ ID NO: 21257 - DNA, 724 bp, Homo sapiens
ggggaggagaggccaccgggaccgcgagcggcagctggggagggggccgcggagcccgagcgggagcaaaacagctgatctggttttcctttaaagcgagagaaaatggaagtcgggtagcggcgactgcggcgctgcgggctggcggagcggagcggcgcggcgcggcagagttctcaggcgctgtggtctcaccttccactggggcaacaatgggccatttccagcagggacggcgcagtgttggcctgcatgcctgactgccacacacctccagaatcaggtgtctgaaaagtggcagtgacgaaagaagagactctcccggccgaggccccagtgcatggagagaaggaagaaatcaatttcctaattggtaccatatacatcagatggatggtttctagtgtgcttccaaaccccacctcggctgagtgttgggcagcacttctacatgatcctatgactcttgatatggacgcagtcctgtcagactttgttcggtccacgggggcagaacctggtctggccagagacctgctggaaggcaaaaactgggacctgacagccgctctgagcgactatgagcagctccgccaggtgcacacagccaatctgccacatgtgttcaatgaagggcggggtcccaagcagccagagcgagagccacagcccgggcacaaggtggagcgaccctgcctgcagaggcaggacgacattgcccaag

SEQ ID NO: 21258 - DNA, 6352 bp, Homo sapiens
gggcaaaaagccactgggggaggccagtcccgatcagtcctttctggctccagctccagatcccgtgcggagcaacagctgcggtcgcagtctccaccaccgcctccacctccatcgccgtcgggggaggggccggccggaccccggggtcactgccgaggaatgaagagaggcggccgggccccgcgctccgccccggcctagggccttgccccgggagcccgcgagggtggaggcctgaattttgatctatgttctacctacatccagctggctgaaagtacttgaggatcacatgaccctggacatggatgctgttctgtcagattttgtccgttccacaggagcagagccagggctagcgcgagatctcctagaaggaaagaattgggatgtgaatgccgccctcagtgattttgaacagctacgtcaagtccatgctggaaacctacccccatcctttagtgaggggagtggtggctccaggacccctgaaaaagggttttctgacagagagcctactcgccctccccgacccatcctccagcggcaggatgacatcgttcaagaaaaacgcctgtctaggggcatctcccacgccagctccagcattgtttccctggcccggtcccatgtctcctccaatggtgggggtggggggagcaatgagcaccccctggaaatgcccatctgtgccttccagcttccagatctcactgtatacaatgaagacttccgcagcttcatagagagagacctcattgagcagtccatgctggttgccttggaacaggcagggcgtttgaactggtgggtgagtgtggatcccacctctcagaggctgcttcctttggcaactactggagatgggaactgcctcctgcatgcagcctcccttggaatgtggggtttccatgatcgggacttgatgctgcggaaagctttgtatgcactgatggagaagggagttgagaaggaagcgttgaaaaggcgctggaggtggcagcagacacagcagaataaagagtcagggctggtatacacagaagatgaatggcagaaggagtggaatgaactgatcaagcttgcctcaagtgaaccccgaatgcatctaggtaccaatggagccaactgtggtggggtggagagttctgaggagcctgtatatgagagccttgaagagtttcacgtctttgtccttgctcatgtgcttaggaggcccatagtcgtcgtggcagacaccatgctgagggactccggaggggaagcatttgcccctattccctttggaggaatctatctgcctttggaggtcccagccagccagtgtcaccgctcccctctggtgctcgcctatgatcaggcccacttttctgcactcgtgtccatggagcagaaggagaataccaaggaacaagctgtgatcccacttacagattcagagtataagctgctgcccttgcactttgctgtggaccctggaaagggctgggagtggggcaaagatgatagtgacaatgtccgattggccagtgtaattctgtccctagaggtcaaattgcatctgctgcatagctacatgaatgtgaagtggatcccactgtcctctgatgcacaggctcctctggcccagcctgagtcccccaccgcctcagctggagatgagccccggtccactcctgagtctggagactcagacaaggagtcagttggcagcagttccaccagcaacgagggcggccggcggaaggagaagtcaaagcgagatcgggagaaggacaagaagagagcagattctgtggctaacaaactgggcagctttggcaaaaccttgggcagcaagctcaagaagaacatggggggcctgatgcacagcaagggttcaaagcctggaggggtggggacagggttgggaggaagcagcggcactgagacactggagaagaagaagaaaaactcactgaagagctggaagggtggcaaggaggaggcagctggggatgggcctgtgtctgagaagcccccagctgagtctgttggtaacggagggagcaagtatagccaggaggtgatgcagagcctgagcattctgaggactgccatgcaaggggaggggaagtttatttttgttggaaccctgaagatgggtcaccgtcaccagtatcaggaggaaatgatccagcgctacctttctgatgctgaggagagattcctggcagaacagaagcagaaggaggcagagaggaagatcatgaatggaggaatagggggtggccctcctccagccaaaaagccagagccagatgctagggaagagcagccgaccggtcccccagcagagtccagggcaatggcattttccactggctaccctggggactttactatccctcggccgtctgggggcggagtccactgccaggaaccccggaggcagttggcagggggtccatgtgtcgggggcctaccaccatatgccaccttccccagacagtgccctcctgggcgaccctacccccaccaggacagcatcccttctctggagccaggcagccactctaaggatggacttcacaggggtgccttgttaccacccccctaccgagtggctgattcctatagcaatggctacagagagccccctgagccagatggatgggctggaggtctccggggccttcccccaactcagaccaaatgcaaacaaccgaactgcagcttctatggacaccctgagacaaacaacttctgttcctgttgttacagggaagaactgaggaggagggagcgggaaccggatggggagctcctggtgcacaggttctgaacgggtggaacactgaagggcaaggaggctaaacaaagttaagctcaactaattggctcatcaagaacacagtccccatgttgagggggaaaatgcagtaatgtttgtgggagcctggctggaaacttttaagtgtgtgcacacaggagtgctgccaggctggcaagagcaggtcggggctggatggcacctcaggggctgtactattcctctgcagagcttgacttgatgaggtttgaggtacaaggggaaaagatggcgattctgtcttataacctcctgggtcccatccagggacctaagagaaagtagcaggggaaggtttggtgtgtgggggtgggaggtgggcagaagtcttggggaggaatgggcaaaggaggttctcagtcaataaaaccaaagttctttaggttgggaaaaagcacatggtggagtgagaagtgtggaggggaagtgggaaattggacacatttgctattgatttgaattaagctagaaattaaggttggataaattcttccccttgaaggatctggaaagacaaggcagtaatgtgtcctcatgggtgcctgttaggaggtgggggtagtttaaatccgtttgtttagatgggaaagggaggaacttaagagggaaatccttttcctcttaaggtttatttccttccaagcagtcatatgtcatctgttacagtttgagaagagattgctgattaccccctgtcttttcctcatctaagtctttaattgtatttgtttaaagggaagagtgtggtgagaacagccgtcatgtgtgttgcattttctccaggtgaattggggcagagctgatctattttttaaccacagcaataaccatacgttggggtttgagtgcaccttgggaggggtgggaggacagacattttagccagaggctgtttcaaacaaaaccaaaaacctaagtagagcattacaggcctctgtggctgctgcgtttctgtagaaagcaacttattttattgacttttttttttaaggaaaagaaataaaaagaccccagcaagcaaaaacatttaaaaaatgatttttttccctcctacttaagtggttctttctccctttgctctacttttggagaatgaacttaacatcccggcttcttttgttaagccatagctgaccttaatctgtggttagtttattaaaataattaaaaatactttctaagaagagatatttttgatattaggactgatgttgaaacatataggggcaatttataaaaaggtagttagagaaatatattttagtgaactataaccacagagcacagatgactcccaatgagctgatctgtctttaggtttctccctttccctgacccttccctgttctctaggggctgggagtggggatgcggacacagtagggggagctccttcgcattttgcacaaagcacaagtctgaacagcctatgctctggccagagccatttctaagagctttaaaccggaagacctatcctgggccaattttcctttttctttatatttttttccgggaaaaaaagtcaactatgcaattgtatacactcccgggtgcatgtgaagaaggggaataagtgtacttatgtgtccagagtattaactggggctgtttttctgtgtttggatttctcttttgaggtatgtactcataacccatcccttggaacgtaatccccacatttgatctaaagcacttgagcgtgcatgcatgtgcgtgcgtgcatatgtgtgtgtgttttcctcctcggtagccagtcaagattgtccttgttggaaatgctcacggtttataaaggttattttctcctcaacaaactcagaagtcacctattttccaaatctgatttaataatttcctatggctattaattcttagggttttctttgaaaatagatttgtgttaaggaagcagtgagattccaaaggaagggatgtgtatatgtctaggcaggtctggaacctggtatgagatgagcactcccctaagttgcaaaatttaagggttactataaaactcattaatcaagatactataaaaaatgcagtatttaaaaaaattaatgcaaaaaatttatgttggataaaatagcgaaatcttacaggatctgacaggactgagattaggaggagggaagtgaggctgaattgaataagtatggggatgaatccttcttatttaaatttttgatacattgtccatcatagactttttacattaattgtgattttttaaaaatgttgcattaaaatagtatttatcttggttactgggttttttggcactccttaaattttgtgcccaaggtgagtgctttgctcacctcaccctagttacgtccctgtttctgtgatttgaacactagcgagaacaccactgtgtgcgcctccacccccatcacacaccaaacaacaggtggctcagacaccctgaatttgcacagctcacctagctttcctaatttaggccttcatatcatagaatggtggcctggaccaataggaatgaaaacagaccaggggttttcccagagaataaagccggaaaagttttgattctccactggactgctgtgtttggatttgatctgttgttagattctagttaacacttttgtttttaaaaactaaggacaaatgaacaaaaaaccttgtatcatgtttgtttttatttataagttagccaatcccaattccgtttgctttattttcaaataaaaaaagatggaaattttgaggggtggtctaggggtgaatatggtaaaatggggctttaggccttatagctttttattaagaaataaattattttttttatttgggagggtaactatttattgaggcattgaaaaacctctccattctaaggatgagagaccctgagacaatggatattttttataggagatagtgaagtttgttttgcttcattctttcggggagggttttggtgggatggggggaggtgaaggaataatgcctgggaaattaatatagattcagcttggtttgtggtattttgggaagatgagggaatagaagaggcaagcccatgtcgttactgggttggggagaaggaaagaaggggcatatggcctgcactcgaaatgggcagaaaaattccttagttaaggaggggtgtgtgagtgaagggggaaggtagaccctttaaccccaagtgagggatgatatcatctctcaggcttaaatttaagtgcacttagttcctttaatccagggcaactggggtacctactgaagtttttaatggagaggggagattttcagggttcttgtttttccctttttgatgttagacagtgctactccctccctgctgtgctctctgccccatctccaatggagtaagtattactgtaggataggcctccgcttctcccttaacctatgctgcatttattgaaagttacaagatttaaccagaagtttttcctccatactggtttttatcaacaaaataaaaagattatatccaaa

SEQ ID NO: 21259 - DNA, 1425 bp, Homo sapiens
ggcaaaaagccactgggggaggccagtcccgatcagtcctttctggctccagctccagatcccgtgcggagcaacagctgcggcctgaattttgatctatgttctacctacatccagctggctgaaagtacttgaggatcacatgaccctggacatggatgctgttctgtcagattttgtccgttccacaggagcagagccagggctagcgcgagatctcctagaaggaaagaattgggatgtgaatgccgccctcagtgattttgaacagctacgtcaagtccatgctggaaacctacccccatcctttagtgaggggagtggtggctccaggacccctgaaaaagggttttctgacagagagcctactcgccctccccgacccatcctccagcggcaggatgacatcgttcaagaaaaacgcctgtctaggggcatctcccacgccagctccagcattgtttccctggcccggtcccatgtctcctccaatggtgggggtggggggagcaatgagcaccccctggaaatgcccatctgtgccttccagcttccagatctcactgtatacaatgaagacttccgcagcttcatagagagagacctcattgagcagtccatgctggttgccttggaacaggcagggcgtttgaactggtgggtgagtgtggatcccacctctcagaggctgcttcctttggcaactactggagatgggaactgcctcctgcatgcagcctcccttggaatgtggggtttccatgatcgggacttgatgctgcggaaagctttgtatgcactgatggagaagggagttgagaaggaagcgttgaaaaggcgctggaggtggcagcagacacagcagaataaagagtcagggctggtatacacagaagatgaatggcagaaggagtggaatgaactgatcaagcttgcctcaagtgaaccccgaatgcatctaggtaccaatggagccaactgtggtggggtggagagttctgaggagcctgtatatgagagccttgaagagtttcacgtctttgtccttgctcatgtgcttaggaggcccatagtcgtcgtggcagacaccatgctgagggactccggaggggaagcatttgcccctattccctttggaggaatctatctgcctttggaggtcccagccagccagtgtcaccgctcccctctggtgctcgcctatgatcaggcccacttttctgcactcgtgtccatggagcagaaggagaataccaaggaacaagctgtgatcccacttacagattcagagtataagctgctgcccttgcactttgctgtggaccctggaaagggctgggagtggggcaaagatgatagtgacaatgtccgattggccagtgtaattctgtccctagaggtcaaattgcatctgctgcatagcta

SEQ ID NO: 21260 - DNA, 2801 bp, Homo sapiens
agcagaaagccaccgatcctgaaccagccgccggagccggagtggcgaccgggtgcggagtgggcaaaaagccactgggggaggccagtcccgatcagtcctttctggctccagctccagatcccgtgcggagcaacagctgcggtcgcagtctccaccaccgcctccacctccatcgccgtcgggggaggggccggccggaccccggggtcactgccgaggaatgaagagaggcggccgggccccgcgctccgccccggcctagggccttgccccgggagcccgcgagggtggaggcctgaattttgatctatgttctacctacatccagctggctgaaagtacttgaggatcacatgaccctggacatggatgctgttctgtcagattttgtccgttccacaggagcagagccagggctagcgcgagatctcctagaaggaaagaattgggatgtgaatgccgccctcagtgattttgaacagctacgtcaagtccatgctggaaacctacccccatcctttagtgaggggagtggtggctccaggacccctgaaaaagggttttctgacagagagcctactcgccctccccgacccatcctccagcggcaggatgacatcgttcaagaaaaacgcctgtctaggggcatctcccacgccagctccagcattgtttccctggcccggtcccatgtctcctccaatggtgggggtggggggagcaatgagcaccccctggaaatgcccatctgtgccttccagcttccagatctcactgtatacaatgaagacttccgcagcttcatagagagagacctcattgagcagtccatgctggttgccttggaacaggcagggcgtttgaactggtgggtgagtgtggatcccacctctcagaggctgcttcctttggcaactactggagatgggaactgcctcctgcatgcagcctcccttggaatgtggggtttccatgatcgggacttgatgctgcggaaagctttgtatgcactgatggagaagggagttgagaaggaagcgttgaaaaggcgctggaggtggcagcagacacagcagaataaagagtcagggctggtatacacagaagatgaatggcagaaggagtggaatgaactgatcaagcttgcctcaagtgaaccccgaatgcatctaggtaccaatggagccaactgtggtggggtggagagttctgaggagcctgtatatgagagccttgaagagtttcacgtctttgtccttgctcatgtgcttaggaggcccatagtcgtcgtggcagacaccatgctgagggactccggaggggaagcatttgcccctattccctttggaggaatctatctgcctttggaggtcccagccagccagtgtcaccgctcccctctggtgctcgcctatgatcaggcccacttttctgcactcgtgtccatggagcagaaggagaataccaaggaacaagctgtgatcccacttacagattcagagtataagctgctgcccttgcactttgctgtggaccctggaaagggctgggagtggggcaaagatgatagtgacaatgtccgattggccagtgtaattctgtccctagaggtcaaattgcatctgctgcatagctacatgaatgtgaagtggatcccactgtcctctgatgcacaggctcctctggcccagcctgagtcccccaccgcctcagctggagatgagccccggtccactcctgagtctggagactcagacaaggagtcagttggcagcagttccaccagcaacgagggcggccggcggaaggagaagtcaaagcgagatcgggagaaggacaagaagagagcagattctgtggctaacaaactgggcagctttggcaaaaccttgggcagcaagctcaagaagaacatggggggcctgatgcacagcaagggttcaaagcctggaggggtggggacagggttgggaggaagcagcggcactgagacactggagaagaagaagaaaaactcactgaagagctggaagggtggcaaggaggaggcagctggggatgggcctgtgtctgagaagcccccagctgagtctgttggtaacggagggagcaagtatagccaggaggtgatgcagagcctgagcattctgaggactgccatgcaaggggaggggaagtttatttttgttggaaccctgaagatgggtcaccgtcaccagtatcaggaggaaatgatccagcgctacctttctgatgctgaggagagattcctggcagaacagaagcagaaggaggcagagaggaagatcatgaatggaggaatagggggtggccctcctccagccaaaaagccagagccagatgctagggaagagcagccgaccggtcccccagcagagtccagggcaatggcattttccactggctaccctggggactttactatccctcggccgtctgggggcggagtccactgccaggaaccccggaggcagttggcagggggtccatgtgtcgggggcctaccaccatatgccaccttccccagacagtgccctcctgggcgaccctacccccaccaggacagcatcccttctctggagccaggcagccactctaaggatggacttcacaggggtgccttgttaccacccccctaccgagtggctgattcctatagcaatggctacagagagccccctgagccagatggatgggctggaggtctccggggccttcccccaactcagaccaaatgcaaacaaccggatggggagctcctggtgcacaggttctga

SEQ ID NO: 21261 - DNA, 1296 bp, Homo sapiens
gctgctccgcactgcagctatggtcgcatgcagtgcctgccgaagcccgcagcaggaatgctgccttcggtgattttaatttcacttttctacttctctcaataacaaaatccgcgtttcaaactccagggaaaagaaaacggaattggctccaggaggatctgcaatcaccaccgggaactttgggaggctgggaagatggagccaaaccaatgtgtggggtggagggctgttgccaaggcggggcaacgaggaggggctcgcttccgggaggacggcaattggcaacccggaagcggtcggtagtgcggcgctgtttaaagatggcggcggaggaacctcagcagcagaagcaggagccgctgggcagcgactccgaaggtgttaactgtctggcctatgatgaagccatcatggctcagcaggaccgaattcagcaagagattgctgtgcagaaccctctggtgtcagagcggctggagctctcggtcctatacaaggagtatgctgaagatgacaacatctatcaacagaagatcaaggacctccacaaaaagtactcgtacatccgcaagaccaggcctgacggcaactgtttctatcgggctttcggattctcccacttggaggcactgctggatgacagcaaggagttgcagcggttcaaggctgtgtctgccaagagcaaggaagacctggtgtcccagggcttcactgaattcacaattgaggatttccacaacacgttcatggacctgattgagcaggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggaggtggagcccatgtgcaaggagagcgaccacatccacatcattgcgctggcccaggccctcagcgtgtccatccaggtggagtacatggaccgcggcgagggcggcaccaccaatccgcacatcttccctgagggctccgagcccaaggtctaccttctctaccggcctggacactacgatatcctctacaaatagggctggctccagcccgctgctgccctgctgcccccctctgccaggcgctagacatgtacagaggtttttctgtggttgtaaatggtcctatttcacccccttcttcctgtcacatgacccccccccatgttttattaaagggggtgctggtggtgag

SEQ ID NO: 21262 - DNA, 1296 bp, Homo sapiens; identical to SEQ ID NO: 21261

SEQ ID NO: 21263 - DNA, 1729 bp, Homo sapiens
aattggcaacccggaagcggtcggtagtgcggcgctgtttaaagatggcggcggaggaacctcagcagcagaagcaggagccgctgggcagcgactccgaaggtgttaactgtctggcctatgatgaagccatcatggctcagcaggaccgaattcagcaagagattgctgtgcagaaccctctggtgtcagagcggctggagctctcggtcctatacaaggagtatgctgaagatgacaacatctatcaacagaagatcaaggacctccacaaaaagtactcgtacatccgcaagaccaggcctgacggcaactgtttctatcgggctttcggattctcccacttggaggcactgctggatgacagcaaggagttgcagcggttcaaggctgtgtctgccaagagcaaggaagacctggtgtcccagggcttcactgaattcacaattgaggatttccacaacacgttcatggacctgattgagcaggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggaggtggagcccatgtgcaaggagagcgaccacatccacatcattgcgctggcccaggccctcagcgtgtccatccaggtggagtacatggaccgcggcgagggcggcaccaccaatccgcacatcttccctgagggctccgagcccaaggtctaccttctctaccggcctggacactacgatatcctctacaaatagggctggctccagcccgctgctgccctgctgcccccctctgccaggcgctagacatgtacagaggtttttctgtggttgtaaatggtcctatttcacccccttcttcctgtcacatgacccccccccatgttttattaaagggggtgctggtggtgagccgtgtgtgcgtgtccctgctctgctgcccgcctggctgctctgtctgctgccccctccccccaggtgggtccccctgcttttcacctatctactcctgagcttccccaacaggagcaggtttgaggggccaggcctcttggaggcccctcctgcttcgttgggttctgcttccttcccttcttagctggctcaggggcttctatgggatcctggaagttccttagggacttgcccagggtcccagggccacccacacttcatctgctccctcataggccccacctccacgtcccggctgggccccagaccccagcttcctgccctccaccgggagtctgcatggttgggagtcctgggtggaggggcctttgtgaggctggacccggctcagggcaggtggaggagctgggcctcccacagggtgcccgggcagtgccatcctggtgggggagggcagccttcaaacgtgtggggtctacagtcctcaggtctaggcagggctgccggttctccacctccccatccgccccaggccccctgcctgtgcctgccttgcaccccctctgcttgggccacggtgtctctgcattgcctgcctttttgccttcacctcttttcttccccgccccctgcacattcggggtctcagcccccaggctgtgagctccttgggggcaggccctcaataaatgtgaactgctgctgccgcc

SEQ ID NO: 21264 - DNA, 1647 bp, Homo sapiens
gctgtttaaagatggcggcggaggaacctcagcagcagaagcaggagccgctgggcagcgactccgaaggtgttaactgtctggcctatgatgaagccatcatggctcagcaggaccgaattcagcaagaggacatgacagatccctgcctcctccagattgctgtgcagaaccctctggtgtcagagcggctggagctctcggtcctatacaaggagtatgctgaagatgacaacatctatcaacagaagatcaaggacctccacaaaaagtactcgtacatccgcaagaccaggcctgacggcaactgtttctatcgggctttcggattctcccacttggaggcactgctggatgacagcaaggagttgcagcggttcaaggctgtgtctgccaagagcaaggaagacctggtgtcccagggcttcactgaattcacaattgaggatttccacaacacgttcatggacctgattgagcaggtggagaagcagacctctgtcgccgacctgctggcctccttcaatgaccagagcacctccgactaccttgtggtctacctgcggctgctcacctcgggctacctgcagcgcgagagcaagttcttcgagcacttcatcgagggtggacggactgtcaaggagttctgccagcaggaggtggagcccatgtgcaaggagagcgaccacatccacatcattgcgctggcccaggccctcagcgtgtccatccaggtggagtacatggaccgcggcgagggcggcaccaccaatccgcacatcttccctgagggctccgagcccaaggtctaccttctctaccggcctggacactacgatatcctctacaaatagggctggctccagcccgctgctgccctgctgcccccctctgccaggcgctagacatgtacagaggtttttctgtggttgtaaatggtcctatttcacccccttcttcctgtcacatgacccccccccatgttttattaaagggggtgctggtggtgagccgtgtgtgcgtgtccctgctctgctgcccgcctggctgctctgtctgctgccccctccccccaggtgggtccccctgcttttcacctatctactcctgagcttccccaacaggagcaggtttgaggggccaggcctcttggaggcccctcctgcttcgttgggttctgcttccttcccttcttagctggctcaggggcttctatgggatcctggaagttccttagggacttgcccagggtcccagggccacccacacttcatctgctccctcataggccccacctccacgtcccggctgggccccagaccccagcttcctgccctccaccgggagtctgcatggttgggagtcctgggtggaggggcctttgtgaggctggacccggctcagggcaggtggaggagctgggcctcccacagggtgcccgggcagtgccatcctggtgggggagggcagccttcaaacgtgtggggtctacagtcctcaggtctaggcagggctgccggttctccacctccccatccgccccaggccccctgcctgtgcctgccttgcaccccctctgcttgggccacggtgtctctgcattgcctgcctttttgccttcacctcttttcttccccgccccctgca

SEQ ID NO: 21265 - DNA, 3922 bp, Homo sapiens
acgtcaatcgcagggcgtgtgtcttgctgggacacagtggaggtctaacctttggtttgcggagcggtcgggtgtattctccgccgcccccacgccctcgaggtccccgccaccgaaccagcggcggagcccgcccgcgcctcccgcggcattcccgcaccggatcgctcctcgctggggcgggacctggcctggcggctctggtcactatgagtgaaacatctttcaacctaatatcagaaaaatgtgacattctatccattcttcgggaccatcctgaaaacaggatttaccggaggaaaatcgaggaactcagcaaaaggttcaccgccatccgcaagaccaaaggggatgggaactgcttctacagggccttgggctattcctacctggagtccctgctggggaagagcagggagatcttcaagttcaaagaacgcgtactgcagaccccaaatgaccttctggctgctggctttgaggagcacaagttcagaaacttcttcaatgctttttacagtgtggtggaactggtagagaaggatggctcagtgtccagcctgctgaaggtgttcaacgaccagagtgcctcggaccacatcgtgcagttcctgcgcctgctcacgtcggccttcatcaggaaccgagcagacttcttccggcacttcattgatgaggagatggacatcaaagacttctgcactcacgaagtagagcccatggccacggagtgtgaccacatccagatcacggcgttgtcgcaggccctgagcattgccctgcaagtggagtacgtggacgagatggataccgccctgaaccaccacgtgttccctgaggccgccaccccttccgtttacctgctctataaaacatcccactacaacatcctttatgcagccgataaacattgattaattttaggccatgcagtggaacctgtcacctaatgggactgcattctgaatggaacattccggctcttcaattttttaagcaatttagactgtagcaagaaaatgtgcagccttttgggcaaagcccctgggaacgaggcctatccactatggactatggtaacttggtaggatttttagtatttattttaatggagggacaaatgctttctaactgggcccccgactccgcaccccagttcgcagtgaggccctgggtgggtcacctgccctctctggacttgtttcttcaactggaggaggtccctgcctatgctgacattccattgtagaaaaatggggcctctggtgtctctttaccaggggcagtgcctctctgcgggggaggaaaagctcaaggttagctgtcttaacccaagtgacttaccaggcctacaaaagagtccagtccagtcacttgttggactgggctctgacagatggcctattgaggtcaacttgaatgtgagggctacggtgtggtttcaaacattcatgatggatgtattttcctacccctaacttaaggagaaaaaaaaaaagacttcctttttttgccaaagtccagaaaggggcctttagcctttagtaggagctcaaattgttggggcccctctacctctctcagggctagaactgcctgactcttggtggacgagcccttcagggttctgctttcagccccacctggacagaggcttacaagactagggtctggaccagaatctgtgtatttctgtctgggaccaggaagccgcagctgtcccatcatccccagcaaatcctagaagtggagtctggatacttcaaggatagaagtgttggcacgcacagccatggacccagctgagcagagcagacgctttgcaggctgcccctggcttcttcctccctttcccgcttctgctctctttatggactggtcagagggtaggtgggaaagaacagacaagccatgggaagttggcagtggggagatttccactgtggaaaccgcctgggaattccggccagcagcttcctccttcagccacctggccataccccttaaataagcccctcaccttgctgcctcaggaccttcaagattccatctgtgggctggccggcaagatggcaccagtggggacccacaccctggctgggcagaggtgctgctagcaacctctcttcctctataagaggaaatggaaaatgcagggtgtggaattgccctttggggtccttccttaattgaaggccaccttctcacaggtttcattctgcagggatttactggaatctattggtgctgctgcatgagtctgctgacaacctgactgcacaaggactgggtagcagactcctcagagtcctcttgacacaaatgtcagatttgtgtcactcttctgccttcgtgaaaagccaatagcactctcagatatcaggggattttagttccaagcagggaccctggtttccatactgccctcagctggagtttggatccaaaggctctggctaagtcattatgtcactttttcacaggaatgtaaatttgactgtcacctctgaatttgttcagtgtcccaccatggtctatgagaagtacactggaagcgtggggggaacacatgacatgatttgtgaatatcatcatctttgccagacaagtctccaggggatccctgtttcccaactgaaaggtgtgaacggacacacacacagcctggatgacgccttggctgttctaaggggctgtaaggtgggctctgggccttccagctaggctctcaagcacagcagaagcctcactgggctgctatgtctctgtatttgtggcttgtgtggtagcctcagaagcagagctgtttggcagactggctggagaaattccctctaggagacttgcctgtgctgtgcttccaggtcacagagccccccggaaactcacaggggccctcttcccagaaaagaatctattctatcacttcagaatcaggacactcaagctctggcagaggaaggccaagttactttcatggtcttaccctctgcttttcccctttttgcaaaaaaccactggccaaatccgaaccattgcccttgtttcccccacgttctctctcagatctttgtctcgaagggaaaacatagtggatgaaaaggtgtggcaggctttggcaccttgttaaaatttctagtcatctgtggatgttaccttgcttgtccacagcagccagtcaccctggccagtcccacttcctggataattctctaccctcaccccacagagccatctctctccagaccaaaagctggaaggagagttgctttgagagcttgtttttacaactgcatgtttattatgatactttctctccaaaggaaacttttaaatcaatgggaacaattagcaacagaaagagcacagtccctgcttttgactgggttcctattttaagcacaaatgagagctctggagccagaatgccagggttctaacttcagcattcacttactagctgtatgatcttggccaagtcacttcacctccctgagccccaattcccaagtttgtgaaatggcaacaatacctatgtgtcactggattattggttaaaacagaatgagattccttgtgtgaaaatagctattatacctgacacactcatcgtatgggctctgcaaagggatattccccaacctgtccttcctgacaggaagcatagggcactgcagatggggaagcatgtcaccttggcagtgactcggtggcttcccaagcaggagtgtcaggggaaccatgagagagagtctaggagcaaacacatcaccaccctgagcagatacaggagtggggagggggctgtaactcagtgagtggcttccaggggccccaggccctgctggatgtgggccaagccctacagcttccctaggcagtaagtaaaaacattctcctagcattaaaatggtttccataa

SEQ ID NO: 21266 - DNA, 708 bp, Homo sapiens
ctttggtttgcggagcggtcgggtgtattctccgccgcccccacgccctcgaggtccccgccaccgaaccagcggcggagcccgcccgcgcctcccgcggcattcccgcaccggatcgctcctcgctggggcgggacctggcctggcggctctggtcactatgagtgaaacatctttcaacctaatatcagaaaaatgtgacattctatccattcttcgggaccatcctgaaaacaggatttaccggaggaaaatcgaggaactcagcaaaaggttcaccgccatccgcaagaccaaaggggatgggaactgcttctacagggccttgggctattcctacctggagtccctgctggggaagagcagggagatcttcaagtgagtgccggggccccttggcctgtcagggctgtgttctctgtgctaggtcagcctcaagtctctcggaggttttcgttacactcaggctggttaacccagagaatgagctgaagagctgcctggcagaggcgtttgatgttgggggtgcccagctgcctgctgtggtgaagttgggggcagccaaggggtggaggatggaatctgtgacctcccagatgctttccagcctctgcttccaccacaggcctgggtcagcccaggtgagtcgcagggagcaggtacttcgtgacccactctgaaaagaaaagaaaagacaaacaaaaagaa

SEQ ID NO: 21267 - DNA, 1013 bp, Homo sapiens
gaaggtggtgaggtcatagaacacaagctttaaagtaagtgaatcatgtgtgcctcatttatttttaaaagcaacttctgagaagggcttagaacaaattttttcccggagtgccatttcccaaaggtactcacagaacaatcaggtgtgaccataatggctgcactgagttgtctcttggacagtgtcagaagggacataaagaaggtggacagagaactaaggcaactgagatgcatcgacgaatttagcacacggtgcctgtgcgacttgtatatgcacccctattgctgctgtgacttgcacccatatccgtactgcttgtgctattccaagcgatcacgctcttgcggcctgtgtgatctctacccatgttgcctgtgtgattataagctttactgtctgcgaccatctctcagaagtttggagaggaaagccatcagagccatagaagatgagaagcgagagcttgccaaactgagaagaacaacaaatagaattctggcttcctcctgctgtagcagtaacattttaggatcggtgaatgtatgcggttttgaacccgatcaagtcaaagttcgagtgaaggatggaaaggtatgtgtgtcggctgagcgggagaacaggtacgactgccttggatcgaaaaagtacagctacatgaacatctgcaaagagttcagcttgccgccctgtgtggatgagaaggatgtaacatactcctatgggctcggcagctgtgtcaagatcgagtctccttgctacccttgcacttctccttgcagcccctgcagcccctgcagcccctgcaacccctgcagcccctgcaacccgtgcagcccatatgatccttgcaacccgtgttatccctgtggaagccgattttcctgtaggaagatgattttgtaaagtgcgcataggaacccattacttaatagaagtcagttactccagccaggcagctctcccaatgtttctcctctccttcccatggcccctgttgttgaagtacg

SEQ ID NO: 21268 - DNA, 3707 bp, Homo sapiens
gagccagactgcatccgccgcggcgtctccatggcacgaccctggcctccgacttcaacgacttcataaggcggcgtttctgggcgcagccgtgtcgctcctggacagttgctgtgcgacttggacagtagaggagcgcctcccaagttttcatccaactgccaaccccaaagcttccacccttctcccctcagagaggacgtttgatgccgggccccttgagaggctcattgacaagcctgcccctctgggtccccctgagcagagcctgctgacccaattgcccacctttgcggctttgatgcctagccatgtctgcctcatcctcaggcggctcccccaggtttccatcgtgtgggaagaacggagtaacgagtctcacgcagaaaaaggtcttgagagcaccttgtggcgcacccagtgtaactgtgacgttgagatcactgtgtagaaggatccgcctgctttccgctgtgcttcactaaatccaaggaggagctgtgcattccagcaggtttagaggagatccagccctaagaaccctggggccggcgtctgggatctgttctggaacggaagccaaccatgaaggaccgctcttcaactccccccttacatgttcacgtggatgagaacacccctgtccacgtccacataaaaaaactcccgaaaccatcagcgaccagcagccagaaatctcacaagcgaggaatgaaaggggacactgtgaatgtgcggcggagtgtccgggtgaaaaccaagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacagagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccggatcgaacaccagggggacaagctggagatggcgagagagaaacatcaggcttcccagaaggaaaataaacagctgagtctgaaggtggatgaactggagaggaaactggaggcgaccagtgcccagaatatcgagttcctacaggtgattgccaagagggaggaggcaatccaccagtcccagctgcggctggaggagaaaacacgggaatgtgggaccctggcaaggcagttggagagtgccattgaagatgcgaggaggcaggtggaacaaaccaaggagcacgcactctccaaggagcgagcagcccagaacaaaatcctggaccttgagacccagctgagcagaaccaaaacggaattgagccagctgcggcggagccgtgatgatgcggaccgccgctaccagagccggctgcaagacctgaaagatcgcctggagcagtccgagagcaccaaccgcagcatgcagaactacgtccagttcctcaaatcatcatacgccaacgtgtttggggatggtccctattccaccttcctgactagctctcccatccgctcccgatctcctcctgcctgaggccacttatcagggcctggagccctgatggaagccataggaactccagagttgccaagccatagctgagaagcctggtggttttcctctcccagtgaaaaaatgggttcagggtcttgtccttagctactagctctagaaaagtcccaaaagcagcagaaggtgaagcaggaagcacttggttttctccttcctgatatagtcacctgttggaagtgttaaaatttcctcgacaggccttaaatttactactacattagggtaccacattttaacttaccatgactttgctccttcctttcctgagaaaatatttccactggattttttccaccagtccccttacagccctcattgttttaggaatctctctcaggttttttctgacctaaaccagcaggaagtcgtcctgggctgtaagcaccatcacttgctttttttttttttctgatttcacaagtgtggtgttttcccaaggctcccttcccaagctcagtgcaaacctctcactcccaagtttctttgaggccacttgcccccaagcacttcacaatagaccctcgagggcttgtgtccatttggccttttacaagtgtaatgccaatttcattgatttttgtttcttttggcctgatttgtatctctggaatgcatttattcttgaaatatttgtgtgattttacaaaaagcttttgtaatcagtt

SEQ ID NO: 21269 - DNA, 3406 bp, Homo sapiens
ggaagcggggaggagccgctgccagagccagactgcatccgccgcggcgtctccatggcacgaccctggcctccgacttcaacgacttcataaggcggcgtttctgggcgcagccgtgtcgctcctggtttccatcgtgtgggaagaacggagtaacgagtctcacgcagaaaaaggtcttgagagcaccttgtggcgcacccagtgtaactgtgacgaagccaaccatgaaggaccgctcttcaactccccccttacatgttcacgtggatgagaacacccctgtccacgtccacataaaaaaactcccgaaaccatcagcgaccagcagccagaaatctcacaagcgaggaatgaaaggggacactgtgaatgtgcggcggagtgtccgggtgaaaaccaaggtaccttggatgccccctggaaaatcatctgcccggcctgtgggatgcaagtgggagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacagagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccggatcgaacaccagggggacaagctggagatggcgagagagaaacatcaggcttcccagaaggaaaataaacagctgagtctgaaggtggatgaactggagaggaaactggaggcgaccagtgcccagaatatcgagttcctacaggtgattgccaagagggaggaggcaatccaccagtcccagctgcggctggaggagaaaacacgggaatgtgggaccctggcaaggcagttggagagtgccattgaagatgcgaggaggcaggtggaacaaaccaaggagcacgcactctccaaggagcgagcagcccagaacaaaatcctggaccttgagacccagctgagcagaaccaaaacggaattgagccagctgcggcggagccgtgatgatgcggaccgccgctaccagagccggctgcaagacctgaaagatcgcctggagcagtccgagagcaccaaccgcagcatgcagaactacgtccagttcctcaaatcatcatacgccaacgtgtttggggatggtccctattccaccttcctgactagctctcccatccgctcccgatctcctcctgcctgaggccacttatcagggcctggagccctgatggaagccataggaactccagagttgccaagccatagctgagaagcctggtggttttcctctcccagtgaaaaaatgggttcagggtcttgtccttagctactagctctagaaaagtcccaaaagcagcagaaggtgaagcaggaagcacttggttttctccttcctgatatagtcacctgttggaagtgttaaaatttcctcgacaggccttaaatttactactacattagggtaccacattttaacttaccatgactttgctccttcctttcctgagaaaatatttccactggattttttccaccagtccccttacagccctcattgttttaggaatctctctcaggttttttctgacctaaaccagcaggaagtcgtcctgggctgtaagcaccatcacttgctttttttttttttctgatttcacaagtgtggtgttttcccaaggctcccttcccaagctcagtgcaaacctctcactcccaagtttctttgaggccacttgcccccaagcacttcacaatagaccctcgagggcttgtgtccatttggccttttacaagtgtaatgccaatttcattgatttttgtttcttttggcctgatttgtatctctggaatgcatttattcttgaaatatttgtgtgattttacaaaaagcttttgtaatcagtt

SEQ ID NO: 21270 - DNA, 2375 bp, Homo sapiens
cccttctcctaggagacagttgtccggccccgccccagcatccccgcggctccctgcgcggttctggccctctggggcccacttggggccgagcggttctcacccgccctctccgcacgtccgccggcgcctcaggtttcccccggacagttgctgtgcgacttggacagtagaggagcgcctcccaagttttcatccaactgccaaccccaaagcttccacccttctcccctcagagaggacgtttgatgccgggccccttgagaggctcattgacaagcctgcccctctgggtccccctgagcagagcctgctgacccaattgcccacctttgcggctttgatgcctagccatgtctgcctcatcctcaggcggctcccccaggtttccatcgtgtgggaagaacggagtaacgagtctcacgcagaaaaaggtcttgagagcaccttgtggcgcacccagtgtaactgtgacgaaatctcacaagcgaggaatgaaaggggacactgtgaatgtgcggcggagtgtccgggtgaaaaccaagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacagagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccgggtaagggactggcagaaagggtcccacgaactgacccgagcaggggcccgcataccaagatgagctgcacgccccccaagggaggactacttcctttttcttggctgctgctttttaaaaggagtgagctatcatcagtgctgtgaaataaaagtctggtgtgccaaa

SEQ ID NO: 21271 - DNA, 3505 bp, Homo sapiens
gagccagactgcatccgccgcggcgtctccatggcacgaccctggcctccgacttcaacgacttcataaggcggcgtttctgggcgcagccgtgtcgctcctggacagttgctgtgcgacttggacagtagaggagcgcctcccaagttttcatccaactgccaaccccaaagcttccacccttctcccctcagagaggacgtttgatgccgggccccttgagaggctcattgacaagcctgcccctctgggtccccctgagcagagcctgctgacccaattgcccacctttgcggctttgatgcctagccatgtctgcctcatcctcaggcggctcccccaggtttccatcgtgtgggaagaacggagtaacgagtctcacgcagaaaaaggtcttgagagcaccttgtggcgcacccagtgtaactgtgacgaaatctcacaagcgaggaatgaaaggggacactgtgaatgtgcggcggagtgtccgggtgaaaaccaaggtaccttggatgccccctggaaaatcatctgcccggcctgtgggatgcaagtgggagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacagagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccggatcgaacaccagggggacaagctggagatggcgagagagaaacatcaggcttcccagaaggaaaataaacagctgagtctgaaggtggatgaactggagaggaaactggaggcgaccagtgcccagaatatcgagttcctacaggtgattgccaagagggaggaggcaatccaccagtcccagctgcggctggaggagaaaacacgggaatgtgggaccctggcaaggcagttggagagtgccattgaagatgcgaggaggcaggtggaacaaaccaaggagcacgcactctccaaggagcgagcagcccagaacaaaatcctggaccttgagacccagctgagcagaaccaaaacggaattgagccagctgcggcggagccgtgatgatgcggaccgccgctaccagagccggctgcaagacctgaaagatcgcctggagcagtccgagagcaccaaccgcagcatgcagaactacgtccagttcctcaaatcatcatacgccaacgtgtttggggatggtccctattccaccttcctgactagctctcccatccgctcccgatctcctcctgcctgaggccacttatcagggcctggagccctgatggaagccataggaactccagagttgccaagccatagctgagaagcctggtggttttcctctcccagtgaaaaaatgggttcagggtcttgtccttagctactagctctagaaaagtcccaaaagcagcagaaggtgaagcaggaagcacttggttttctccttcctgatatagtcacctgttggaagtgttaaaatttcctcgacaggccttaaatttactactacattagggtaccacattttaacttaccatgactttgctccttcctttcctgagaaaatatttccactggattttttccaccagtccccttacagccctcattgttttaggaatctctctcaggttttttctgacctaaaccagcaggaagtcgtcctgggctgtaagcaccatcacttgctttttttttttttctgatttcacaagtgtggtgttttcccaaggctcccttcccaagctcagtgcaaacctctcactcccaagtttctttgaggccacttgcccccaagcacttcacaatagaccctcgagggcttgtgtccatttggccttttacaagtgtaatgccaatttcattgatttttgtttcttttggcctgatttgtatctctggaatgcatttattcttgaaatatttgtgtgattttacaaaaagcttttgtaatcagtt

SEQ ID NO: 21272 - DNA, 2249 bp, Homo sapiens
acccaagcggctcccgggggggtttgaactggccaatgggcgagctgccgaccgggtgtcggaaaaggaggcggaagcggggaggagccgctgccagagccagactgcatccgccgcggcgtctccatggcacgaccctggcctccgacttcaacgacttcataaggcggcgtttctgggcgcagccgtgtcgctcctggtttccatcgtgtgggaagaacggagtaacgagtctcacgcagaaaaaggtcttgagagcaccttgtggcgcacccagtgtaactgtgacgaaatctcacaagcgaggaatgaaaggggacactgtgaatgtgcggcggagtgtccgggtgaaaaccaaggtaccttggatgccccctggaaaatcatctgcccggcctgtgggatgcaagtgggagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacagagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccgggtaagggactggcagaaagggtcccacgaactgacccgagcaggggcccgcataccaagatgagctgcacgccccccaagggaggactacttcctttttcttggctgctgctttttaaaaggagtgagctatcatcagtgctgtgaaataaaagtctggtgtgccaaatgc

SEQ ID NO: 21273 - DNA, 2086 bp, Homo sapiens
aattgagaagatggcggaccagcaaggacctcatcagaataggtttccatcgtgtgggaagaacggagtaacgagtctcacgcagaaaaaggtcttgagagcaccttgtggcgcacccagtgtaactgtgacgaaatctcacaagcgaggaatgaaaggggacactgtgaatgtgcggcggagtgtccgggtgaaaaccaaggtaccttggatgccccctggaaaatcatctgcccggcctgtgggatgcaagtgggagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacagagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccgggtaagggactggcagaaagggtcccacgaactgacccgagcaggggcccgcataccaagatgagctgcacgccccccaagggaggactacttcctttttcttggctgctgctttttaaaaggagtgagctatcatcagtgctgtgaaataaaagtctggtgtgcc

SEQ ID NO: 21274 - DNA, 793 bp, Homo sapiens
ccgccgcggcgtctccatggcacgaccctggcctccgacttcaacgacttcataaggcggcgtttctgggcgcagccgtgtcgctcctggtttccatcgtgtgggaagaacggagtaacgagtctcacgcagaaaaaggtcttgagagcaccttgtggcgcacccagtgtaactgtgacgatcaaccatttttgtgttgtcctcccccacctgccagaagccaaccatgaaggaccgctcttcaactccccccttacatgttcacgtggatgagaacacccctgtccacgtccacataaaaaaactcccgaaaccatcagcgaccagcagccagaaatctcacaagcgaggaatgaaaggggacactgtgaatgtgcggcggagtgtccgggtgaaaaccaaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacagagaaacaaatgacctgcacggacatcaacaccctgacaaggcagaaggaacttctcctgcagaagctgagcacatttgaggagaccaaccgcaccctc

SEQ ID NO: 21275 - DNA, 935 bp, Homo sapiens
ccgcctccttcctctcttggctaccacggggctctgcccctcctctgccgcccgcgggcagggcttcacctttctctctatgggcagaaaccggtaccctcctgcctgctggacagttgctgtgcgacttggacagtagaggagcgcctcccaagttttcatccaactgccaaccccaaagcttccacccttctcccctcagagaggacgtttgatgccgggccccttgagaggctcattgacaagcctgcccctctgggtccccctgagcagagcctgctgacccaattgcccacctttgcggctttgatgcctagccatgtctgcctcatcctcaggcggctcccccaggtttccatcgtgtgggaagaacggagtaacgagtctcacgcagaaaaaggtcttgagagcaccttgtggcgcacccagtgtaactgtgacgaaatctcacaagcgaggaatgaaaggggacactgtgaatgtgcggcggagtgtccgggtgaaaaccaaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacagagaaacaaatgacctgcacggacatcaacaccctgacaaggcagaaggaacttctcctgcagaagctgagcacatttgaggagaccaaccgcaccctccgagacctcctgagggaacagcactgcaaagagg

SEQ ID NO: 21276 - DNA, 905 bp, Homo sapiens
ccaccggcgcggggcctctcctcctcccgctaacgggcggtcggccgcctccttcctctcttggctaccacggggctctgcccctcctctgccgcccgcgggcagggcttcacctttctctctatgggcagaaaccggtaccctcctgcctgctggacagttgctgtgcgacttggacagtagaggagcgcctcccaagttttcatccaactgccaaccccaaagcttccacccttctcccctcagagaggacgtttgatgccgggccccttgagaggctcattgacaagcctgcccctctgggtccccctgagcagagcctgctgacccaattgcccacctttgcggctttgatgcctagccatgtctgcctcatcctcaggcggctcccccaggtttccatcgtgtgggaagaacggagtaacgagtctcacgcagaaaaaggtcttgagagcaccttgtggcgcacccagtgtaactgtgacgaaatctcacaagcgaggaatgaaaggggacactgtgaatgtgcggcggagtgtccgggtgaaaaccaaggtaccttggatgccccctggaaaatcatctgcccggcctgtgggatgcaagtgggagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggca

SEQ ID NO: 21277 - DNA, 828 bp, Homo sapiens
aacgacttcataaggcggcgtttctgggcgcagccgtgtcgctcctggtttccatcgtgtgggaagaacggagtaacgagtctcacgcagaaaaaggtcttgagagcaccttgtggcgcacccagtgtaactgtgacgatcaaccatttttgtgttgtcctcccccacctgccagaagccaaccatgaaggaccgctcttcaactccccccttacatgttcacgtggatgagaacacccctgtccacgtccacataaaaaaactcccgaaaccatcagcgaccagcagccagaaatctcacaagcgaggaatgaaaggggacactgtgaatgtgcggcggagtgtccgggtgaaaaccaagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacagtagg

SEQ ID NO: 21278 - DNA, 822 bp, Homo sapiens
gggcctctcctcctcccgctaacgggcggtcggccgcctccttcctctcttggctaccacggggctctgcccctcctctgccgcccgcgggcagggcttcacctttctctctatgggcagaaaccggtaccctcctgcctgctggacagttgctgtgcgacttggacagtagaggagcgcctcccaagttttcatccaactgccaaccccaaagcttccacccttctcccctcagagaggacgtttgatgccgggccccttgagaggctcattgacaagcctgcccctctgggtccccctgagcagagcctgctgacccaattgcccacctttgcggctttgatgcctagccatgtctgcctcatcctcaggcggctcccccaggtttccatcgtgtgggaagaacggagtaacgagtctcacgcagaaaaaggtcttgagagcaccttgtggcgcacccagtgtaactgtgacgaaatctcacaagcgaggaatgaaaggggacactgtgaatgtgcggcggagtgtccgggtgaaaaccaagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaa

SEQ ID NO: 21279 - DNA, 2069 bp, Homo sapiens
cagactgcatccgccgcggcgtctccatggcacgaccctggcctccgacttcaacgacttcataaggcggcgtttctgggcgcagccgtgtcgctcctggtttccatcgtgtgggaagaacggagtaacgagtctcacgcagaaaaaggtcttgagagcaccttgtggcgcacccagtgtaactgtgacgatcaaccatttttgtgttgtcctcccccacctgccagaagccaaccatgaaggaccgctcttcaactccccccttacatgttcacgtggatgagaacacccctgtccacgtccacataaaaaaactcccgaaaccatcagcgaccagcagccagaaatctcacaagcgaggaatgaaaggggacactgtgaatgtgcggcggagtgtccgggtgaaaaccaaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacagagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccgggtaagggactggcagaaagggtcccacgaactgacccgagcaggggcccgcataccaagatgagctgcacgccccccaagggaggactacttcctttttcttggctgctgctttttaaaaggagtgagctatcatcagtgctgtgaaataaaagtctggtgtgcc

SEQ ID NO: 21280 - DNA, 937 bp, Homo sapiens
agactgcatccgccgcggcgtctccatggcacgaccctggcctccgacttcaacgacttcataaggcggcgtttctgggcgcagccgtgtcgctcctggtttccatcgtgtgggaagaacggagtaacgagtctcacgcagaaaaaggtcttgagagcaccttgtggcgcacccagtgtaactgtgacgatcaaccatttttgtgttgtcctcccccacctgccagaagccaaccatgaaggaccgctcttcaactccccccttacatgttcacgtggatgagaacacccctgtccacgtccacataaaaaaactcccgaaaccatcagcgaccagcagccagaaatctcacaagcgaggaatgaaaggggacactgtgaatgtgcggcggagtgtccgggtgaaaaccaaggtaccttggatgccccctggaaaatcatctgcccggcctgtgggatgcaagtgggagacttcagaagaaacacctacaacaggagaaggagtgcctcatgtccaagctggtggaggcggaaatggatggggctgcggctgccaagcaggtcatggccttgaaggataccatcgggaagctgaaaacagagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgca

SEQ ID NO: 21281 - DNA, 2140 bp, Homo sapiens
accggcgcggggcctctcctcctcccgctaacgggcggtcggccgcctccttcctctcttggctaccacggggctctgcccctcctctgccgcccgcgggcagggcttcacctttctctctatgggcagaaaccggtaccctcctgcctgctggtttccatcgtgtgggaagaacggagtaacgagtctcacgcagaaaaaggtcttgagagcaccttgtggcgcacccagtgtaactgtgacgaaatctcacaagcgaggaatgaaaggggacactgtgaatgtgcggcggagtgtccgggtgaaaaccaagaatccacctcattgcctggagatcacgccaccatcttcagaaaagctggtctcagtgatgcggttaagtgacctctctacagaagatgatgactcaggtcactgtaaaatgaaccgttatgataagaagattgatagtctaatgaatgcggttggttgtctgaagtctgaggtcaagatgcaaaaaggtgagcgccagatggccaaaaggttcctggaggaacggaaggaagagctggaggaggtggcccacgaactggctgagactgagcacgagaacacggtgttgaggcacaacatcgagcgcatgaaggaggagaaggacttcaccatacttcagaagaaacacctacaacaggagaaggagtgcctcatgtccaagctggtggaggcggaaatggatggggctgcggctgccaagcaggtcatggccttgaaggataccatcgggaagctgaaaacagagaaacaaatgacctgcacggacatcaacaccctgacaaggcagaaggaacttctcctgcagaagctgagcacatttgaggagaccaaccgcaccctccgagacctcctgagggaacagcactgcaaagaggattctgaaagactaatggagcaacaaggagcactgctgaaacggctggcggaggccgactcagagaaagcgcgcctgctgttactgctgcaagacaaggacaaggaggtggaagagctccttcaggaaatacaatgtgagaaggctcaagcaaagacagcctctgagctttctaaatccatggagtccatgcgtgggcatttgcaggcacagcttcggtccaaagaggctgagaacagtcgcctgtgcatgcagattaagaatctggagcgcagcgggaatcagcataaggcagaagtggaggccatcatggagcagctgaaggagttgaagcagaagggagaccgagacaaagagagcttgaagaaggccatccgagcccagaaggagcgagccgagaagagcgaggagtatgctgagcagctacacgtgcaactcgctgacaaggatctttatgtcgctgaagctttatccactctggaatcctggaggagccgctacaaccaagttgtaaaagaaaagggagaccttgagctggaaattattgtcctgaatgaccgggtaacagatcttgtaaaccaacaacaaaccctggaggagaagatgcgggaagaccgggatagcctggtggagagactacaccgtcagactgctgagtattccgcattcaagctggagaatgagaggctgaaggccagctttgctccaatggaggacaaactcaaccaggcacacctcgaggtccagcagctgaaggcctcagtgaagaactatgaggggatgattgacaactataagagtcaggtgatgaagaccagattggaggctgatgaagtagctgcccagctagaacgctgtgacaaagagaacaagatccttaaagatgagatgaacaaagagattgaggcggcacgaaggcagttccagtctcagctggctgacctgcagcagctccctgacatcctgaagatcacggaggcgaagctggctgagtgccaagaccaactgcagggctatgagcggaagaacatcgacctcacagccatcatatcagacctgcgcagccgggtaagggactggcagaaagggtcccacgaactgacccgagcaggggcccgcataccaagatgagctgcacgccccccaagggaggactacttcctttttcttggctgctgctttttaaaaggagtgagctatcatcagtgctgtgaaataaaagtctggtgtgcc

SEQ ID NO: 21282 - DNA, 1307 bp, Homo sapiens
attctagagtttagagtgggggacctctccccaattctgtaagcccatgaggagagaggaaggcctttctctccatgctccttttgcgggaactccctggcaccaaggccaggggggaaaggacagtctctgatgaggatgggtctctaggctgctctgagtgctgtccctgcactgaagaagttatagttccctcccaggcggccccctccctgcccctcagctcagcctcaatcaagaagttccccatctttgaccactccaagtaggagaaaccggcccagggctcccttagagccgagaacagtgagctggccatgacggaggaggtatggatgggtacctggaggccccatcgcccccggggacccatcatggccctctacagcagccctggacccaagtacctgattccaccaacaacaggcttcatgaagcacacgcccaccaagctgcgtgcaccggcctacagcttccgtggggcccccatgctcctggcagagaactgctccccagggccccgttacaatgtaaaccccaagatactgaggactggcaaggaccttggccctgcctactccatcctggggcgctaccaaaccaagaccatgctgactcctggtccaggtgactactttccagagaaatccaccaagtacgtgttcgactcagcacccagccactccatctctgcccggacaaaggcattccgagtggacagcaccccaggccccgctgcgtacatgctgcccatggtaatggggcccaataccgtcggcaaggcctcccagccctccttttccatcaagggccgcagcaagctgggcggcttcagcgacgacctacacaagaccccaggtcccgcagcctaccgccaaactgatgtgcgggtgaccaagttcaaggctccgcagtacaccatggctgcccgtgtggagcccccaggggacaagaccctcaagccaggaccaggcgcccacagccctgagaaggtgaccctgaccaagccctgcgccccagttgtcaccttcggcatcaaacactctgattacatgactcccctgctggttgatgtggaataacgccagccctgctgtgccccatcacacccggcatctacacaagatccgccgggccacagagctcgaggctgtcttcaccagctgggctgggccagcctggccctgcagggcagagcacgcttgtttgggcaattgtaatcagttactttttttctatgctattttaccattttttaatcttgttttctgctgtgcccaaattattaataaatcagattgcattaa

SEQ ID NO: 21283 - DNA, 711 bp, Homo sapiens
cctctccccaattctgtaagcccatgaggagagaggaaggcctttctctccatgctccttttgcgggaactccctggcaccaaggccaggggggaaaggacagtctctgatgaggatgggtctctaggctgctctgagtgctgtccctgcactgaagaagttatagttccctcccaggcggccccctccctgcccctcagctcagcctcaatcaagaagttccccatctttgaccactccaagtaggagaaaccggcccagggctcccttagagccgagaacagtgagctggccatgacggaggaggtatggatgggtacctggaggccccatcgcccccggggacccatcatggccctctacagcagccctggacccaagtacctgattccaccaacaacaggcttcatgaagcacacgcccaccaagctgcgtgcaccggcctacagcttccgtggggcccccatgctcctggcagagaactgctccccagggccccgttacaatgtaaaccccaagatactgaggactggcaaggaccttggccctgcctactccatcctggggcgctaccaaaccaagaccatgctgactcctggtccagccctgaagtcagcatttccatcctggacaccccctgacccgacttggtcaccacctgtgttggagcccagaggccccacgcctagaatgttggggagtcctccttga

SEQ ID NO: 21284 - DNA, 892 bp, Homo sapiens
cctctccccaattctgtaagcccatgaggagagaggaaggcctttctctccatgctccttttgcgggaactccctggcaccaaggccaggggggaaaggacagtctctgatgaggatgggtctctaggctgctctgagtgctgtccctgcactgaagaagttatagttccctcccaggcggccccctccctgcccctcagctcagcctcaatcaagaagttccccatctttgaccactccaagtaggagaaaccggcccagggctcccttagagccgagaacagtgagctggccatgacggaggaggtatggatgggtacctggaggccccatcgcccccggggacccatcatggccctctacagcagccctggacccaagtacctgattccaccaacaacaggcttcatgaagcacacgcccaccaagctgcgtgcaccggcctacagcttccgtggggcccccatgctcctggcagagaactgctccccacccaataccgtcggcaaggcctcccagccctccttttccatcaagggccgcagcaagctgggcggcttcagcgacgacctacacaaggtgaccctgaccaagccctgcgccccagttgtcaccttcggcatcaaacactctgattacatgactcccctgctggttgatgtggaataacgccagccctgctgtgccccatcacacccggcatctacacaagatccgccgggccacagagctcgaggctgtcttcaccagctgggctgggccagcctggccctgcagggcagagcacgcttgtttgggcaattgtaatcagttactttttttctatgctattttaccattttttaatcttgttttctgctgtgcccaaattattaataaatcagattgcatt

SEQ ID NO: 21285 - DNA, 1156 bp, Homo sapiens
ctgaatgggttggggccttctcttggatcaagagtctcttatttgatcgaggtctgttattagacttcctcattctttctcagacctcaggctgcatggtggcagctgatgaaaatatccaaaagatgagaagagacaattgagtctggtgagggaaaggggagacagagggtgaagtggtgctcaagatggatgcagagtactctgggaatgagttccccaggtcagaaggagaaagagaccaacatcagagacctggaaaggaaaggaagagtggggaggcaggatggggcacaggtgagctgggacaagatgggagactgctgtcctccaccctctccctcagtagtaacaggtccttgggccagcgccagaactctccgctgccctttcaatggagaatcacacacagcttccgctggatggcccaggtgttggcctctgagctcagcctggttgcctttatcctactattggtcgtggccttctccaagaaatggctggacctctctaggagcctcttctaccagcgctggcccgtggatgtcagcaacagaatccacacatcagcccacgttatgtccatggggctcctgcacttttacaaatccaggagctgttctgacttagagaatgggaaagtcaccttcatcttctccaccctcatgctattccccattaacatctggatcttcgagttggaaaggaatgtatccatccccataggctggagctatttcattggttggctggtgcttatcctatacttcacctgcgcgatcctttgctacttcaaccataaaagtttctggagtctgattctgagccaccccagtggtgccgtgtcctgcagcagcagtttcggctcagtagaagaatctccaagggcacagacgatcacagacacccccatcacccaggagggagtcctggatcctgagcagaaggatacacatgtgtaatcttttctgaactcctggcaccaagttctgtccattcatctgaccccatctcctcatcctcccccagcccttgaataggttggtcctcatcattgcaaggaatgagaaagggaggattttgcactcctctgctttctccctgccttgattgagcttgagtgatgtggaataaattgtccgtctcttctttctca

SEQ ID NO: 21286 - DNA, 1728 bp, Homo sapiens
atggtaacgtggctttacagatttttacccacttcaaatatggccgccaagctccgttctcttttaccgcctgatctgcggctacaattctggcttcatgcccgcctccaaaagtgcttcctctcgaggggttgtggttcttactgcgcaggcgcaaaagcaagtcctcttccgggcaaaatggcgatgggactaatgtgcggacgccgggagcttctgcgcttgctacagtccgggcgtcgggtccacagcgtcgcagggccctcgcaatggcttgggaaaccgctgaccacacggctcctattcccagcagccccgtgctgctgtcgcccacactacctcttccttgcggcttccggcccccgcagcctcagtacctctgctatctcttttgcagaagtccaggttcaggcccctcctgttgttgctgcaactccctcacccacagcagtacctgaggtggcttctggagagactgcagatgtagtccaaactgctgcagagcagagcttcgctgaactggggctggggtcatacaccccagtgggactgatccagaatttactggaatttatgcatgttgatctgggcctaccttggtggggggccattgctgcatgtacagtctttgcccgctgcctgatttttcctctcatcgtgacgggccagcgagaggcagccaggatccacaatcacttgccagagatccagaagttttccagtcgaatcagagaggccaagttagcaggagaccatattgagtattacaaggcttcctcggagatggcactttaccagaaaaaacatggtattaaactctataaacctctcattctccctgtgactcaggccccaatcttcatctccttcttcattgctttgagagagatggccaaccttcctgtgcccagcctgcagacaggtggcctctggtggttccaggatctcacggtatccgatcccatctacatattaccactggcagtcactgctacaatgtgggctgttcttgagctaggtgctgagacaggtgtgcaaagttctgaccttcagtggatgagaaatgtcatcagaatgatgcccctgataaccttgcccataaccatgcatttccccacggcagtgtttatgtactggctctcctccaatttgttttccctggtccaagtatcctgtctccggattccagcagtacgcactgtacttaaaatcccccagcgtgttgtacatgacctggacaaattacctccacgggaaggcttcctagagagcttcaaaaaaggctggaaaaatgctgaaatgacgcgtcagctgcgagagcgtgaacaacgcatgcggaatcagttggagctagcagccaggggtcctttacgacagacctttacccacaaccctctcctacaacctggaaaggataaccctcccaatatccctagcagcagcagcaaaccaaagtcaaagtatccctggcacgacacacttggctgacttatgttctgtgcgcattctggcaggaattctgtctcttcagagactcatcctcaaaacaagacttgacactgtgtccttgccccagtcctaggaactgtggcacacagagatgttcattttaaaaacggatttcatgaaacactcttgtacttatgtttataagagagcactgggtagccaagtgatcttcccattcacagagttagtaaacctctgtactacatgctgcttcctgat

SEQ ID NO: 21287 - DNA, 1750 bp, Homo sapiens
gtgcggacgccgggagcttctgcgcttgctacagtccgggcgtcgggtaaggatgccccggggcagagcaccgggatgctgccctgacccagtgaaccaggccccaggacagctcgtgctaggggtatcagcagacgctgacctgctcaccgggacctgaatgtcatgacctcgggtcatgtgaggacgcgctagggttagtccccgacactatgggcccagcagcccggtgtcagcttctggaattggcttggctcctggcgagagcacctcggcctcgttctcagggccctccgatgtgggtctgcgataactgagatgcggggaacccaggtccacagcgtcgcagggccctcgcaatggcttgggaaaccgctgaccacacggctcctattcccagcagccccgtgctgctgtcgcccacactacctcttccttgcggcttccggcccccgcagcctcagtacctctgctatctcttttgcagaagtccaggttcaggcccctcctgttgttgctgcaactccctcacccacagcagtacctgaggtggcttctggagagactgcagatgtagtccaaactgctgcagagcagagcttcgctgaactggggctggggtcatacaccccagtgggactgatccagaatttactggaatttatgcatgttgatctgggcctaccttggtggggggccattgctgcatgtacagtctttgcccgctgcctgatttttcctctcatcgtgacgggccagcgagaggcagccaggatccacaatcacttgccagagatccagaagttttccagtcgaatcagagaggccaagttagcaggagaccatattgagtattacaaggcttcctcggagatggcactttaccagaaaaaacatggtattaaactctataaacctctcattctccctgtgactcaggccccaatcttcatctccttcttcattgctttgagagagatggccaaccttcctgtgcccagcctgcagacaggtggcctctggtggttccaggatctcacggtatccgatcccatctacatattaccactggcagtcactgctacaatgtgggctgttcttgagctaggtgctgagacaggtgtgcaaagttctgaccttcagtggatgagaaatgtcatcagaatgatgcccctgataaccttgcccataaccatgcatttccccacggcagtgtttatgtactggctctcctccaatttgttttccctggtccaagtatcctgtctccggattccagcagtacgcactgtacttaaaatcccccagcgtgttgtacatgacctggacaaattacctccacgggaaggcttcctagagagcttcaaaaaaggctggaaaaatgctgaaatgacgcgtcagctgcgagagcgtgaacaacgcatgcggaatcagttggagctagcagccaggggtcctttacgacagacctttacccacaaccctctcctacaacctggaaaggataaccctcccaatatccctagcagcagcagcaaaccaaagtcaaagtatccctggcacgacacacttggctgacttatgttctgtgcgcattctggcaggaattctgtctcttcagagactcatcctcaaaacaagacttgacactgtgtccttgccccagtcctaggaactgtggcacacagagatgttcattttaaaaacggatttcatgaaacactcttgtacttatgtttataagagagca

SEQ ID NO: 21288 - DNA, 1944 bp, Homo sapiens
aaatctttgtctctagcaaactgttttgtcactgtagtaaggctctagtgctggaaatttatctttgacagaggaagaatgcttttgaaaacagttcttacgtgattttatgtaacttaatttgccctggaaaggaaatgtctcgtctctggtatgggaaaaaagggagaagacatcaaccaattaatcataaatacactctggtagtgtcagtggctgagtatcaccgcaggatcgatgctctaaatactgaagaactgcgcacactctgcagacgcctccagattactacaagggaagacataaattcaaagcaggttgctacagtgaaagcagacctggagtctgaatcttttcgaccaaacctaagtgatcccagtgaacttttactgccagatcaaattgaaaagcttaccaagcatcttccaccaagaacaattggctatccatggactcttgtttatggtactggaaaacatggcacaagcttgaaaactctttatcgaacaatgacaggtttagacaccccagtgctgatggtgattaaagacagtgatggacaggtttttggtgcgttagcatctgagccactgaaagtgagtgatggcttttatggtactggagagacctttgtttttacattctgtccggagtttgaggtctttaagtggacaggagataatatgttttttatcaaaggagacatggattcactagctttcggtggtggaggaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacatatgatctgcaggtttgggcatatgctttcatcattaaattatctgataaagttacaagtcacaaaggagaatgagaacttaatgattctattggatttaatatattagcaagaaaacatactatttacatatgtgtagcttagtaaggcattaacataagtacaaaaactatgaaacagatgcatatttcctcaacatactgtgtcaggtatactgttttataatttggttgttttagccttattgcacaccaactcccaaaatataggttactcttgttcaaaaggaaaaaaaaaattgtgattttctttgagtggtatatgttattaattaccattagcatttgctcttataaagggcaatgattatagtagacaatattgtaactcagtagacttgttgaatatgcaaacttactgtcaagtgacctcaaaaa

SEQ ID NO: 21289 - DNA, 4406 bp, Homo sapiens
gcctcttgtgaggcgcgcggagccgcctcccctgggtcaggtctgatgggccggtgggcgcgctagtggtggccgccaccgccgaaaccgtcgacctcctgggccccagttccgcgtccagccccgcggcagcatggactacctgacgacgttcaccgagaagagtgggcgccttctgcggggcacggccaaccgcctgttggggttcgggggcggcggcgaagcccggcaggtgcgcttcgaagattacctgagggagccagcccagggggacctcgggtgcgggtccccgccccaccggcccccggcgccgtccagcccggagggacctgacactggccaaaagaagaccctagacaagaaagatggaagacgaatgtcttttcagaaacctaaagggactattgagtatactgttgaatcaagggattctttgaatagcatagccctgaagtttgatacaacacctaacgaacttgttcaattaaataagttattctcccgagcagttgttactggacaggttctgtatgttcctgatcctgaatatgtctccagtgttgagagctctccatctctaagccccgtaagtcctctgtcaccaacatcatctgaggctgaatttgataagaccactaatcctgatgtccatccaacagaagcaactccctcatctactttcactggtattcgacctgcacgagttgtatcttcaacttctgaggaggaggaagcatttactgagaaatttcttaaaattaattgcaaatatattaccagtggcaagggcacagtcagtggtgtgctgctagttacaccaaataatataatgtttgatccacataaaaatgaccctttggttcaagagaatggctgtgaggaatatggcatcatgtgtccaatggaagaggtgatgtcagctgcaatgtacaaagaaattttggatagcaaaataaaggaatctttacccatagatatagatcagctatcaggaagggacttctgccattcaaagaaaatgacaggaagtaacactgaggaaatagactcaagaatccgagatgcaggtaatgatagtgccagcactgctcctaggagcactgaggagtctctttctgaagatgtgttcacagaatcagaactttcccctatacgagaggagcttgtatcttcagatgaactgcgacaagataaatcttctggtgcgtcatcagaatctgtgcaaactgtcaatcaggctgaagtagaaagtctgacagtcaaatcagaatctactggtactcctggtcacttaagatctgatactgaacattctacaaatgaagttgggactttatgtcataaaactgatttaaataatcttgaaatggccattaaggaagatcagattgcagataactttcaaggaatatcaggtcctaaagaagacagcacaagtataaaaggtaattcagaccaggattcttttcttcatgagaattcgttacaccaagaagagagtcaaaaagaaaatatgccttgtggggaaacagcagaatttaaacaaaagcaaagtgttaacaaaggaaaacaaggaaaggagcaaaatcaggactcacagacagaggcagaagagctacgcaaactttggaaaacccatactatgcaacaaactaaacagcaaagggaaaatattcaacaagtgtcacaaaaagaagctaagcataaaattacatctgctgatggacacatagaaagttctgcacttttaaaagaaaagcaaaggcatcgattacataagttcttgtgtctcagagttggaaaaccaatgaggaaaacgtttgtatctcaagcaagtgctacaatgcaacagtatgcacagagagataagaaacatgaatattggtttgctgtgccacaagaaaggacagatcacttgtatgccttcttcattcagtggagtccagaaatatatgcagaagatactggcgaatataccagagaacctggatttatagtagtaaaaaagattgaggagtctgaaacaattgaggattctagtaatcaagcagcagccagagaatgggagattactacaagggaagacataaattcaaagcaggttgctacagtgaaagcagacctggagtctgaatcttttcgaccaaacctaagtgatcccagtgaacttttactgccagatcaaattgaaaagcttaccaagcatcttccaccaagaacaattggctatccatggactcttgtttatggtactggaaaacatggcacaagcttgaaaactctttatcgaacaatgacaggtttagacaccccagtgctgatggtgattaaagacagtgatggacaggtttttggtgcgttagcatctgagccactgaaagtgagtgatggcttttatggtactggagagacctttgtttttacattctgtccggagtttgaggtctttaagtggacaggagataatatgttttttatcaaaggagacatggattcactagctttcggtggtggaggaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacatatgatctgcaggtttgggcatatgctttcatcattaaattatctgataaagttacaagtcacaaaggagaatgagaacttaatgattctattggatttaatatattagcaagaaaacatactatttacatatgtgtagcttagtaaggcattaacataagtacaaaaactatgaaacagatgcatatttcctcaacatactgtgtcaggtatactgttttataatttggttgttttagccttattgcacaccaactcccaaaatataggttactcttgttcaaaaggaaaaaaaaaattgtgattttctttgagtggtatatgttattaattaccattagcatttgctcttataaagggcaatgattatagtagacaatattgtaactcagtagacttgttgaatatgcaaacttactgtcaagtgacctcaaaaaaaaaatgaaaagatagaatacactagtagttcttatcctcttttgtaggaaaccaataatagccattgtggcaataattcatcagttgattttaaagcttcatgttatgcaaaaaagaatcctgctgttatacatgtgacagtgactttgtgctgaaatttcagctattccagataaacattgtatatcttgtaaattaatgtttaaaggtgtagttttgttcttacagaaagtgttgattgccaggttgcttatagcactttaagttattctaaaaatgaaattataagccaaatatttggcttaagtagatttagttgtatagcacttacatatttagttcttttgaaagtttagataattatttaaagaaagcataatgctaatggaaaagaaaatctgatgttctattataatatgctattgctgaatatgaatagaaatacagggcatcatttccttgtctcattataagttagtaacaatatatagattaaatgtttacaatatagggaattgtaaataaatatatcagtttttttccccttcggtcttccacagcagtattattgtctttgtggagttgactaatgataatttaaaaatcctgtaatggatttctactaaaataaggtcatagtggcatataccaaataaaatcaaatacagaaatacaaa

SEQ ID NO: 21290 - DNA, 2956 bp, Homo sapiens
aacgagacatctagtacggggctcacaggtaacagaactctgatcagatccgccccggctcccacacagctataaggttgcctgcctgcctgcacagaaatgacgaaggacaaaaacagcccagggctgaagaaaaagtcccagtcggtggatattaatgctccagggttcaaccctttggctggtgcaggaaagcaaacaccacaagccagtaagcccccggcacccaagacccccatcattgaagaagagcagaacaatgcagcaaatactcagaaacatccttccagaaggagcgaactgaagaggttctacacaattgacactggccaaaagaagaccctagacaagaaagatggaagacgaatgtcttttcagaaacctaaagggactattgagtatactgttgaatcaagggattctttgaatagcatagccctgaagtttgatacaacacctaacgaacttgttcaattaaataagttattctcccgagcagttgttactggacaggttctgtatgttcctgatcctgaatatgtctccagtgttgagagctctccatctctaagccccgtaagtcctctgtcaccaacatcatctgaggctgaatttgataagaccactaatcctgatgtccatccaacagaagcaactccctcatctactttcactggtattcgacctgcacgagttgtatcttcaacttctgaggaggaggaagcatttactgagaaatttcttaaaattaattgcaaatatattaccagtggcaagggcacagtcagtggtgtgctgctagttacaccaaataatataatgtttgatccacataaaaatgaccctttggttcaagagaatggctgtgaggaatatggcatcatgtgtccaatggaagaggtgatgtcagctgcaatgtacaaagaaattttggatagcaaaataaaggaatctttacccatagatatagatcagctatcaggaagggacttctgccattcaaagaaaatgacaggaagtaacactgaggaaatagactcaagaatccgagatgcaggtaatgatagtgccagcactgctcctaggagcactgaggagtctctttctgaagatgtgttcacagaatcagaactttcccctatacgagaggagcttgtatcttcagatgaactgcgacaagataaatcttctggtgcgtcatcagaatctgtgcaaactgtcaatcaggctgaagtagaaagtctgacagtcaaatcagaatctactggtactcctggtcacttaagatctgatactgaacattctacaaatgaagttgggactttatgtcataaaactgatttaaataatcttgaaatggccattaaggaagatcagattgcagataactttcaaggaatatcaggtcctaaagaagacagcacaagtataaaaggtaattcagaccaggattcttttcttcatgagaattcgttacaccaagaagagagtcaaaaagaaaatatgccttgtggggaaacagcagaatttaaacaaaagcaaagtgttaacaaaggaaaacaaggaaaggagcaaaatcaggactcacagacagaggcagaagagctacgcaaactttggaaaacccatactatgcaacaaactaaacagcaaagggaaaatattcaacaagtgtcacaaaaagaagctaagcataaaattacatctgctgatggacacatagaaagttctgcacttttaaaagaaaagcaaaggcatcgattacataagttcttgtgtctcagagttggaaaaccaatgaggaaaacgtttgtatctcaagcaagtgctacaatgcaacagtatgcacagagagataagaaacatgaatattggtttgctgtgccacaagaaaggacagatcacttgtatgccttcttcattcagtggagtccagaaatatatgcagaagatactggcgaatataccagagaacctggatttatagtagtaaaaaagattgaggagtctgaaacaattgaggattctagtaatcaagcagcagccagagaatgggaggtagtgtcagtggctgagtatcaccgcaggatcgatgctctaaatactgaagaactgcgcacactctgcagacgcctccagattactacaagggaagacataaattcaaagcaggttgctacagtgaaagcagacctggagtctgaatcttttcgaccaaacctaagtgatcccagtgaacttttactgccagatcaaattgaaaagcttaccaagcatcttccaccaagaacaattggctatccatggactcttgtttatggtactggaaaacatggcacaagcttgaaaactctttatcgaacaatgacaggtttagacaccccagtgctgatggtgattaaagacagtgatggacaggtttttggtgcgttagcatctgagccactgaaagtgagtgatggcttttatggtactggagagacctttgtttttacattctgtccggagtttgaggtctttaagtggacaggagataatatgttttttatcaaaggagacatggattcactagctttcggtggtggaggaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagctt

SEQ ID NO: 21291 - DNA, 4550 bp, Homo sapiens
attcacctcgcggccacaggagctcagcgccggcgccgcgccgcccagccccgccgagaggggcgcactcgccgccgcggggcccgccgccgctcaccgcagccccctcctggcgacccgcaagtcctctcaaactgtgagtaactaagtggtttgtgcatcattccagaagcaaagctaaaatttttagcggtgttgtcgacttgacctgctaatttcctgttctggaatcgagagaagactcctcaacaagttgctgcaatgtctgtgtctaatctatcatggctgaagaaaaagtcccagtcggtggatattaatgctccagggttcaaccctttggctggtgcaggaaagcaaacaccacaagccagtaagcccccggcacccaagacccccatcattgaagaagagcagaacaatgcagcaaatactcagaaacatccttccagaaggagcgaactgaagaggttctacacaattgacactggccaaaagaagaccctagacaagaaagatggaagacgaatgtcttttcagaaacctaaagggactattgagtatactgttgaatcaagggattctttgaatagcatagccctgaagtttgatacaacacctaacgaacttgttcaattaaataagttattctcccgagcagttgttactggacaggttctgtatgttcctgatcctgaatatgtctccagtgttgagagctctccatctctaagccccgtaagtcctctgtcaccaacatcatctgaggctgaatttgataagaccactaatcctgatgtccatccaacagaagcaactccctcatctactttcactggtattcgacctgcacgagttgtatcttcaacttctgaggaggaggaagcatttactgagaaatttcttaaaattaattgcaaatatattaccagtggcaagggcacagtcagtggtgtgctgctagttacaccaaataatataatgtttgatccacataaaaatgaccctttggttcaagagaatggctgtgaggaatatggcatcatgtgtccaatggaagaggtgatgtcagctgcaatgtacaaagaaattttggatagcaaaataaaggaatctttacccatagatatagatcagctatcaggaagggacttctgccattcaaagaaaatgacaggaagtaacactgaggaaatagactcaagaatccgagatgcaggtaatgatagtgccagcactgctcctaggagcactgaggagtctctttctgaagatgtgttcacagaatcagaactttcccctatacgagaggagcttgtatcttcagatgaactgcgacaagataaatcttctggtgcgtcatcagaatctgtgcaaactgtcaatcaggctgaagtagaaagtctgacagtcaaatcagaatctactggtactcctggtcacttaagatctgatactgaacattctacaaatgaagttgggactttatgtcataaaactgatttaaataatcttgaaatggccattaaggaagatcagattgcagataactttcaaggaatatcaggtcctaaagaagacagcacaagtataaaaggtaattcagaccaggattcttttcttcatgagaattcgttacaccaagaagagagtcaaaaagaaaatatgccttgtggggaaacagcagaatttaaacaaaagcaaagtgttaacaaaggaaaacaaggaaaggagcaaaatcaggactcacagacagaggcagaagagctacgcaaactttggaaaacccatactatgcaacaaactaaacagcaaagggaaaatattcaacaagtgtcacaaaaagaagctaagcataaaattacatctgctgatggacacatagaaagttctgcacttttaaaagaaaagcaaaggcatcgattacataagttcttgtgtctcagagttggaaaaccaatgaggaaaacgtttgtatctcaagcaagtgctacaatgcaacagtatgcacagagagataagaaacatgaatattggtttgctgtgccacaagaaaggacagatcacttgtatgccttcttcattcagtggagtccagaaatatatgcagaagatactggcgaatataccagagaacctggatttatagtagtaaaaaagattgaggagtctgaaacaattgaggattctagtaatcaagcagcagccagagaatgggagattactacaagggaagacataaattcaaagcaggttgctacagtgaaagcagacctggagtctgaatcttttcgaccaaacctaagtgatcccagtgaacttttactgccagatcaaattgaaaagcttaccaagcatcttccaccaagaacaattggctatccatggactcttgtttatggtactggaaaacatggcacaagcttgaaaactctttatcgaacaatgacaggtttagacaccccagtgctgatggtgattaaagacagtgatggacaggtttttggtgcgttagcatctgagccactgaaagtgagtgatggcttttatggtactggagagacctttgtttttacattctgtccggagtttgaggtctttaagtggacaggagataatatgttttttatcaaaggagacatggattcactagctttcggtggtggaggaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacatatgatctgcaggtttgggcatatgctttcatcattaaattatctgataaagttacaagtcacaaaggagaatgagaacttaatgattctattggatttaatatattagcaagaaaacatactatttacatatgtgtagcttagtaaggcattaacataagtacaaaaactatgaaacagatgcatatttcctcaacatactgtgtcaggtatactgttttataatttggttgttttagccttattgcacaccaactcccaaaatataggttactcttgttcaaaaggaaaaaaaaaattgtgattttctttgagtggtatatgttattaattaccattagcatttgctcttataaagggcaatgattatagtagacaatattgtaactcagtagacttgttgaatatgcaaacttactgtcaagtgacctcaaaaaaaaaatgaaaagatagaatacactagtagttcttatcctcttttgtaggaaaccaataatagccattgtggcaataattcatcagttgattttaaagcttcatgttatgcaaaaaagaatcctgctgttatacatgtgacagtgactttgtgctgaaatttcagctattccagataaacattgtatatcttgtaaattaatgtttaaaggtgtagttttgttcttacagaaagtgttgattgccaggttgcttatagcactttaagttattctaaaaatgaaattataagccaaatatttggcttaagtagatttagttgtatagcacttacatatttagttcttttgaaagtttagataattatttaaagaaagcataatgctaatggaaaagaaaatctgatgttctattataatatgctattgctgaatatgaatagaaatacagggcatcatttccttgtctcattataagttagtaacaatatatagattaaatgtttacaatatagggaattgtaaataaatatatcagtttttttccccttcggtcttccacagcagtattattgtctttgtggagttgactaatgataatttaaaaatcctgtaatggatttctactaaaataaggtcatagtggcatataccaaataaaatcaaatacagaaat

SEQ ID NO: 21292 - DNA, 2621 bp, Homo sapiens
gaaattctctcttccctccccagctttacagcctccactcaggactatcattgctatggatactacttagtgattagctctctctcttgtcaatcaaatctttgtctctagcaaactgttttgtcactgtagtaaggctctagtgctggaaatttatctttgacagaggaagaatgcttttgaaaacagttcttacgtgattttatgtaacttaatttgccctggaaaggaaatgtctcgtctctggtatgggaaaaaagggagaagacatcaaccaattaatcataaatacactctgattactacaagggaagacataaattcaaagcaggttgctacagtgaaagcagacctggagtctgaatcttttcgaccaaacctaagtgatcccagtgaacttttactgccagatcaaattgaaaagcttaccaagcatcttccaccaagaacaattggctatccatggactcttgtttatggtactggaaaacatggcacaagcttgaaaactctttatcgaacaatgacaggtttagacaccccagtgctgatggtgattaaagacagtgatggacaggtttttggtgcgttagcatctgagccactgaaagtgagtgatggcttttatggtactggagagacctttgtttttacattctgtccggagtttgaggtctttaagtggacaggagataatatgttttttatcaaaggagacatggattcactagctttcggtggtggaggaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacatatgatctgcaggtttgggcatatgctttcatcattaaattatctgataaagttacaagtcacaaaggagaatgagaacttaatgattctattggatttaatatattagcaagaaaacatactatttacatatgtgtagcttagtaaggcattaacataagtacaaaaactatgaaacagatgcatatttcctcaacatactgtgtcaggtatactgttttataatttggttgttttagccttattgcacaccaactcccaaaatataggttactcttgttcaaaaggaaaaaaaaaattgtgattttctttgagtggtatatgttattaattaccattagcatttgctcttataaagggcaatgattatagtagacaatattgtaactcagtagacttgttgaatatgcaaacttactgtcaagtgacctcaaaaaaaaaatgaaaagatagaatacactagtagttcttatcctcttttgtaggaaaccaataatagccattgtggcaataattcatcagttgattttaaagcttcatgttatgcaaaaaagaatcctgctgttatacatgtgacagtgactttgtgctgaaatttcagctattccagataaacattgtatatcttgtaaattaatgtttaaaggtgtagttttgttcttacagaaagtgttgattgccaggttgcttatagcactttaagttattctaaaaatgaaattataagccaaatatttggcttaagtagatttagttgtatagcacttacatatttagttcttttgaaagtttagataattatttaaagaaagcataatgctaatggaaaagaaaatctgatgttctattataatatgctattgctgaatatgaatagaaatacagggcatcatttccttgtctcattataagttagtaacaatatatagattaaatgtttacaatatagggaattgtaaataaatatatcagtttttttccccttcggtcttccacagcagtattattgtctttgtggagttgactaatgataatttaaaaatcctgtaatggatttctactaaaataaggtcatagtggcatataccaaataaaatcaa

SEQ ID NO: 21293 - DNA, 4294 bp, Homo sapiens
gtcctctcaaactgtgagtaactaagtggtttgtgcatcattccagaagcaaagctaaaatttttagcggtgttgtcgacttgacctgctaatttcctgttctggaatcgagagaagactcctcaacaagttgctgcaatgtctgtgtctaatctatcatggctgaagaaaaagtcccagtcggtggatattaatgctccagggttcaaccctttggctggtgcaggaaagcaaacaccacaagccagtaagcccccggcacccaagacccccatcattgaagaagagcagaacaatgcagcaaatactcagaaacatccttccagaaggagcgaactgaagaggttctacacaattgacactggccaaaagaagaccctagacaagaaagatggaagacgaatgtcttttcagaaacctaaagggactattgagtatactgttgaatcaagggattctttgaatagcatagccctgaagtttgatacaacacctaacgaacttgttcaattaaataagttattctcccgagcagttgttactggacaggttctgtatgttcctgatcctgaatatgtctccagtgttgagagctctccatctctaagccccgtaagtcctctgtcaccaacatcatctgaggctgaatttgataagaccactaatcctgatgtccatccaacagaagcaactccctcatctactttcactggtattcgacctgcacgagttgtatcttcaacttctgaggaggaggaagcatttactgagaaatttcttaaaattaattgcaaatatattaccagtggcaagggcacagtcagtggtgtgctgctagttacaccaaataatataatgtttgatccacataaaaatgaccctttggttcaagagaatggctgtgaggaatatggcatcatgtgtccaatggaagaggtgatgtcagctgcaatgtacaaagaaattttggatagcaaaataaaggaatctttacccatagatatagatcagctatcaggaagggacttctgccattcaaagaaaatgacaggaagtaacactgaggaaatagactcaagaatccgagatgcaggtaatgatagtgccagcactgctcctaggagcactgaggagtctctttctgaagatgtgttcacagaatcagaactttcccctatacgagaggagcttgtatcttcagatgaactgcgacaagataaatcttctggtgcgtcatcagaatctgtgcaaactgtcaatcaggctgaagtagaaagtctgacagtcaaatcagaatctactggtactcctggtcacttaagatctgatactgaacattctacaaatgaagttgggactttatgtcataaaactgatttaaataatcttgaaatggccattaaggaagatcagattgcagataactttcaaggaatatcaggtcctaaagaagacagcacaagtataaaaggtaattcagaccaggattcttttcttcatgagaattcgttacaccaagaagagagtcaaaaagaaaatatgccttgtggggaaacagcagaatttaaacaaaagcaaagtgttaacaaaggaaaacaaggaaaggagcaaaatcaggactcacagacagaggcagaagagctacgcaaactttggaaaacccatactatgcaacaaactaaacagcaaagggaaaatattcaacaagtgtcacaaaaagaagctaagcataaaattacatctgctgatggacacatagaaagttctgcacttttaaaagaaaagcaaaggcatcgattacataagttcttgtgtctcagagttggaaaaccaatgaggaaaacgtttgtatctcaagcaagtgctacaatgcaacagtatgcacagagagataagaaacatgaatattggtttgctgtgccacaagaaaggacagatcacttgtatgccttcttcattcagtggagtccagaaatatatgcagaagatactggcgaatataccagagaacctggatttatagtagtaaaaaagattgaggagtctgaaacaattgaggattctagtaatcaagcagcagccagagaatgggagcttaccaagcatcttccaccaagaacaattggctatccatggactcttgtttatggtactggaaaacatggcacaagcttgaaaactctttatcgaacaatgacaggtttagacaccccagtgctgatggtgattaaagacagtgatggacaggtttttggtgcgttagcatctgagccactgaaagtgagtgatggcttttatggtactggagagacctttgtttttacattctgtccggagtttgaggtctttaagtggacaggagataatatgttttttatcaaaggagacatggattcactagctttcggtggtggaggaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacatatgatctgcaggtttgggcatatgctttcatcattaaattatctgataaagttacaagtcacaaaggagaatgagaacttaatgattctattggatttaatatattagcaagaaaacatactatttacatatgtgtagcttagtaaggcattaacataagtacaaaaactatgaaacagatgcatatttcctcaacatactgtgtcaggtatactgttttataatttggttgttttagccttattgcacaccaactcccaaaatataggttactcttgttcaaaaggaaaaaaaaaattgtgattttctttgagtggtatatgttattaattaccattagcatttgctcttataaagggcaatgattatagtagacaatattgtaactcagtagacttgttgaatatgcaaacttactgtcaagtgacctcaaaaaaaaaatgaaaagatagaatacactagtagttcttatcctcttttgtaggaaaccaataatagccattgtggcaataattcatcagttgattttaaagcttcatgttatgcaaaaaagaatcctgctgttatacatgtgacagtgactttgtgctgaaatttcagctattccagataaacattgtatatcttgtaaattaatgtttaaaggtgtagttttgttcttacagaaagtgttgattgccaggttgcttatagcactttaagttattctaaaaatgaaattataagccaaatatttggcttaagtagatttagttgtatagcacttacatatttagttcttttgaaagtttagataattatttaaagaaagcataatgctaatggaaaagaaaatctgatgttctattataatatgctattgctgaatatgaatagaaatacagggcatcatttccttgtctcattataagttagtaacaatatatagattaaatgtttacaatatagggaattgtaaataaatatatcagtttttttccccttcggtcttccacagcagtattattgtctttgtggagttgactaatgataatttaaaaatcctgtaatggatttctactaaaataaggtcatagtggcatataccaaataaaatcaaata

SEQ ID NO: 21294 - DNA, 2007 bp, Homo sapiens
actgctagctgagcaaggttcgaaggaaggacctcagaaatgttctgccagcgcaaagacactggccaaaagaagaccctagacaagaaagatggaagacgaatgtcttttcagaaacctaaagggactattgagtatactgttgaatcaagggattctttgaatagcatagccctgaagtttgatacaacacctaacgaacttgttcaattaaataagttattctcccgagcagttgttactggacaggttctgtatgttcctgatcctgaatatgtctccagtgttgagagctctccatctctaagccccgtaagtcctctgtcaccaacatcatctgaggctgaatttgataagaccactaatcctgatgtccatccaacagaagcaactccctcatctactttcactggtattcgacctgcacgagttgtatcttcaacttctgaggaggaggaagcatttactgagaaatttcttaaaattaattgcaaatatattaccagtggcaagggcacagtcagtggtgtgctgctagttacaccaaataatataatgtttgatccacataaaaatgaccctttggttcaagagaatggctgtgaggaatatggcatcatgtgtccaatggaagaggtgatgtcagctgcaatgtacaaagaaattttggatagcaaaataaaggaatctttacccatagatatagatcagctatcaggaagggacttctgccattcaaagaaaatgacaggaagtaacactgaggaaatagactcaagaatccgagatgcaggtaatgatagtgccagcactgctcctaggagcactgaggagtctctttctgaagatgtgttcacagaatcagaactttcccctatacgagaggagcttgtatcttcagatgaactgcgacaagataaatcttctggtgcgtcatcagaatctgtgcaaactgtcaatcaggctgaagtagaaagtctgacagtcaaatcagaatctactggtactcctggtcacttaagatctgatactgaacattctacaaatgaagttgggactttatgtcataaaactgatttaaataatcttgaaatggccattaaggaagatcagattgcagataactttcaaggaatatcaggtcctaaagaagacagcacaagtataaaaggtaattcagaccaggattcttttcttcatgagaattcgttacaccaagaagagagtcaaaaagaaaatatgccttgtggggaaacagcagaatttaaacaaaagcaaagtgttaacaaaggaaaacaaggaaaggagcaaaatcaggactcacagacagaggcagaagagctacgcaaactttggaaaacccatactatgcaacaaactaaacagcaaagggaaaatattcaacaagtgtcacaaaaagaagctaagcataaaattacatctgctgatggacacatagaaagtaagtgttatagagtaaatgaagttagttcatccaattgtatggtgtctccgtctttcctcactgactcaaaagccgctgtaccttagggcaacctgaaggataagtgagtgacccttgaccggtgattctctggggacaagtatatacagtctccagtgtctactgtcttttcttatcccacaggtggattgtacacataatgagcatcattgctacccaccatgtttaaacattcttggctcactacatcgtatcattaaacaatttatttcttgagaaattgcacaaaagctgtataatacctttgatcactccattttctcttaaaaagtttttggtgtgttaccattaaaaatgtcttttttcatatataacattttaattgccaaagttgtaatcccatcttttataaaatgtacagttaaacctaaaagtgtacttacagaattcttccacgtatcgagaagtttcatcatcatcatctaattattttcttttaaaaacctgccctcaggacaaataaaaacactattttatctgtc

SEQ ID NO: 21295 - DNA, 4501 bp, Homo sapiens
gtcctctcaaactgtgagtaactaagtggtttgtgcatcattccagaagcaaagctaaaatttttagcggtgttgtcgacttgacctgctaatttcctgttctggaatcgagagaagactcctcaacaagttgctgcaatgtctgtgtctaatctatcatggctgaagaaaaagtcccagtcggtggatattaatgctccagggttcaaccctttggctggtgcaggaaagcaaacaccacaagccagtaagcccccggcacccaagacccccatcattgaagaagagcagaacaatgcagcaaatactcagaaacatccttccagaaggagcgaactgaagaggttctacacaattgacactggccaaaagaagaccctagacaagaaagatggaagacgaatgtcttttcagaaacctaaagggactattgagtatactgttgaatcaagggattctttgaatagcatagccctgaagtttgatacaacacctaacgaacttgttcaattaaataagttattctcccgagcagttgttactggacaggttctgtatgttcctgatcctgaatatgtctccagtgttgagagctctccatctctaagccccgtaagtcctctgtcaccaacatcatctgaggctgaatttgataagaccactaatcctgatgtccatccaacagaagcaactccctcatctactttcactggtattcgacctgcacgagttgtatcttcaacttctgaggaggaggaagcatttactgagaaatttcttaaaattaattgcaaatatattaccagtggcaagggcacagtcagtggtgtgctgctagttacaccaaataatataatgtttgatccacataaaaatgaccctttggttcaagagaatggctgtgaggaatatggcatcatgtgtccaatggaagaggtgatgtcagctgcaatgtacaaagaaattttggatagcaaaataaaggaatctttacccatagatatagatcagctatcaggaagggacttctgccattcaaagaaaatgacaggaagtaacactgaggaaatagactcaagaatccgagatgcaggtaatgatagtgccagcactgctcctaggagcactgaggagtctctttctgaagatgtgttcacagaatcagaactttcccctatacgagaggagcttgtatcttcagatgaactgcgacaagataaatcttctggtgcgtcatcagaatctgtgcaaactgtcaatcaggctgaagtagaaagtctgacagtcaaatcagaatctactggtactcctggtcacttaagatctgatactgaacattctacaaatgaagttgggactttatgtcataaaactgatttaaataatcttgaaatggccattaaggaagatcagattgcagataactttcaaggaatatcaggtcctaaagaagacagcacaagtataaaaggtaattcagaccaggattcttttcttcatgagaattcgttacaccaagaagagagtcaaaaagaaaatatgccttgtggggaaacagcagaatttaaacaaaagcaaagtgttaacaaaggaaaacaaggaaaggagcaaaatcaggactcacagacagaggcagaagagctacgcaaactttggaaaacccatactatgcaacaaactaaacagcaaagggaaaatattcaacaagtgtcacaaaaagaagctaagcataaaattacatctgctgatggacacatagaaagttctgcacttttaaaagaaaagcaaaggcatcgattacataagttcttgtgtctcagagttggaaaaccaatgaggaaaacgtttgtatctcaagcaagtgctacaatgcaacagtatgcacagagagataagaaacatgaatattggtttgctgtgccacaagaaaggacagatcacttgtatgccttcttcattcagtggagtccagaaatatatgcagaagatactggcgaatataccagagaacctggatttatagtagtaaaaaagattgaggagtctgaaacaattgaggattctagtaatcaagcagcagccagagaatgggaggtagtgtcagtggctgagtatcaccgcaggatcgatgctctaaatactgaagaactgcgcacactctgcagacgcctccagattactacaagggaagacataaattcaaagcaggttgctacagtgaaagcagacctggagtctgaatcttttcgaccaaacctaagtgatcccagtgaacttttactgccagatcaaattgaaaagcttaccaagcatcttccaccaagaacaattggctatccatggactcttgtttatggtactggaaaacatggcacaagcttgaaaactctttatcgaacaatgacaggtttagacaccccagtgctgatggtgattaaagacagtgatggacaggtttttggtgcgttagcatctgagccactgaaagtgagtgatggcttttatggtactggagagacctttgtttttacattctgtccggagtttgaggtctttaagtggacaggagataatatgttttttatcaaaggagacatggattcactagctttcggtggtggaggaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacatatgatctgcaggtttgggcatatgctttcatcattaaattatctgataaagttacaagtcacaaaggagaatgagaacttaatgattctattggatttaatatattagcaagaaaacatactatttacatatgtgtagcttagtaaggcattaacataagtacaaaaactatgaaacagatgcatatttcctcaacatactgtgtcaggtatactgttttataatttggttgttttagccttattgcacaccaactcccaaaatataggttactcttgttcaaaaggaaaaaaaaaattgtgattttctttgagtggtatatgttattaattaccattagcatttgctcttataaagggcaatgattatagtagacaatattgtaactcagtagacttgttgaatatgcaaacttactgtcaagtgacctcaaaaaaaaaatgaaaagatagaatacactagtagttcttatcctcttttgtaggaaaccaataatagccattgtggcaataattcatcagttgattttaaagcttcatgttatgcaaaaaagaatcctgctgttatacatgtgacagtgactttgtgctgaaatttcagctattccagataaacattgtatatcttgtaaattaatgtttaaaggtgtagttttgttcttacagaaagtgttgattgccaggttgcttatagcactttaagttattctaaaaatgaaattataagccaaatatttggcttaagtagatttagttgtatagcacttacatatttagttcttttgaaagtttagataattatttaaagaaagcataatgctaatggaaaagaaaatctgatgttctattataatatgctattgctgaatatgaatagaaatacagggcatcatttccttgtctcattataagttagtaacaatatatagattaaatgtttacaatatagggaattgtaaataaatatatcagtttttttccccttcggtcttccacagcagtattattgtctttgtggagttgactaatgataatttaaaaatcctgtaatggatttctactaaaataaggtcatagtggcatataccaaataaaatcaaata

SEQ ID NO: 21296 - DNA, 3599 bp, Homo sapiens
gtcctctcaaactgtgagtaactaagtggtttgtgcatcattccagaagcaaagctaaaatttttagcggtgttgtcgacttgacctgctaatttcctgttctggaatcgagagaagactcctcaacaagttgctgcaatgtctgtgtctaatctatcatggctgaagaaaaagtcccagtcggtggatattaatgctccagggttcaaccctttggctggtgcaggaaagcaaacaccacaagccagtaagcccccggcacccaagacccccatcattgaagaagagcagaacaatgcagcaaatactcagaaacatccttccagaaggagcgaactgaagaggttctacacaattgacactggccaaaagaagaccctagacaagaaagatggaagacgaatgtcttttcagaaacctaaagggactattgagtatactgttgaatcaagggattctttgaatagcatagccctgaagtttgatacaacacctaacgaacttgttcaattaaataagttattctcccgagcagttgttactggacaggttctgtatgttcctgatcctgaatatgtctccagtgttgagagctctccatctctaagccccgtaagtcctctgtcaccaacatcatctgaggctgaatttgataagaccactaatcctgatgtccatccaacagaagcaactccctcatctactttcactggtattcgacctgcacgagttgtatcttcaacttctgaggaggaggaagcatttactgagaaatttcttaaaattaattgcaaatatattaccagtggcaagggcacagtcagtggtgtgctgctagttacaccaaataatataatgtttgatccacataaaaatgaccctttggttcaagagaatggctgtgaggaatatggcatcatgtgtccaatggaagaggtgatgtcagctgcaatgtacaaagaaattttggatagcaaaataaaggaatctttacccatagatatagatcagctatcaggaagggacttctgccattcaaagaaaatgacaggaagtaacactgaggaaatagactcaagaatccgagatgcaggtaatgatagtgccagcactgctcctaggagcactgaggagtctctttctgaagatgtgttcacagaatcagaactttcccctatacgagaggagcttgtatcttcagatgaactgcgacaagataaatcttctggtgcgtcatcagaatctgtgcaaactgtcaatcaggctgaagtagaaagtctgacagtcaaatcagaatctactggtactcctggtcacttaagatctgatactgaacattctacaaatgaagttgggactttatgtcataaaactgatttaaataatcttgaaatggccattaaggaagatcagattgcagataactttcaaggaatatcaggtcctaaagaagacagcacaagtataaaaggtaattcagaccaggattcttttcttcatgagaattcgttacaccaagaagagagtcaaaaagaaaatatgccttgtggggaaacagcagaatttaaacaaaagcaaagtgttaacaaaggaaaacaaggaaaggagcaaaatcaggactcacagacagaggcagaagagctacgcaaactttggaaaacccatactatgcaacaaactaaacagcaaagggaaaatattcaacaagtgtcacaaaaagaagctaagcataaaattacatctgctgatggacacatagaaagttctgcacttttaaaagaaaagcaaaggcatcgattacataagttcttgtgtctcagagttggaaaaccaatgaggaaaacgtttgtatctcaagcaagtgctacaatgcaacagtatgcacagagagataagaaacatgaatattggtttgctgtgccacaagaaaggacagatcacttgtatgccttcttcattcagtggagtccagaaatatatgcagaagatactggcgaatataccagagaacctggatttatagtagtaaaaaagattgaggagtctgaaacaattgaggattctagtaatcaagcagcagccagagaatgggagattactacaagggaagacataaattcaaagcaggttgctacagtgaaagcagacctggagtctgaatcttttcgaccaaacctaagtgatcccagtgaacttttactgccagatcaaattgaaaagcttaccaagcatcttccaccaagaacaattggctatccatggactcttgtttatggtactggaaaacatggcacaagcttgaaaactctttatcgaacaatgacaggtttagacaccccagtgctgatggtgattaaagacagtgatggacaggtttttggtgcgttagcatctgagccactgaaagtgagtgatggcttttatggtactggagagacctttgtttttacattctgtccggagtttgaggtctttaagtggacaggagataatatgttttttatcaaaggagacatggattcactagctttcggtggtggaggaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacatatgatctgcaggtttgggcatatgctttcatcattaaattatctgataaagttacaagtcacaaaggagaatgagaacttaatgattctattggatttaatatattagcaagaaaacatactatttacatatgtgtagcttagtaaggcattaacataagtacaaaaactatgaaacagatgcatatttcctcaacatactgtgtcaggtatactgttttataatttggttgttttagccttattgcacaccaactcccaaaatataggttactcttgttc

SEQ ID NO: 21297 - DNA, 2460 bp, Homo sapiens
atttttagtttgttgaagttcgtgactgcttcactctctcattcttagcttgaatttggaaatgacttttgatgacctaaagatccagactgtgaaggaccagcctgatgagaagtcaaatggaaaaaaagctaaaggtcttcagtttctttactctccatggtggtgcctggctgctgcgactctaggggtcctttgcctgggattagtagtgaccattatggtgctgggcatgcaattatcccaggtgtctgacctcctaacacaagagcaagcaaacctaactcaccagaaaaagaaactggagggacagatctcagcccggcaacaagcagaagaagcttcacaggagtcagaaaacgaactcaaggaaatgatagaaacccttgctcggaagctgaatgagaaatccaaagagcaaatggaacttcaccaccagaatctgaatctccaagaaacactgaagagagtagcaaattgttcagctccttgtccgcaagactggatctggcatggagaaaactgttacctattttcctcgggctcatttaactgggaaaagagccaagagaagtgcttgtctttggatgccaagttgctgaaaattaatagcacagctgatctggacttcatccagcaagcaatttcctattccagttttccattctggatggggctgtctcggaggaaccccagctacccatggctctgggaggacggttctcctttgatgccccacttatttagagtccgaggcgctgtctcccagacatacccttcaggtacctgtgcatatatacaacgaggagctgtttatgcggaaaactgcattttagctgccttcagtatatgtcagaagaaggcaaacctaagagcacagtgaatttgaaggctctggaagaaaagaaaaaagtctttgagttttattctggaatttaagctattctttgtcacttgggtgccaaacatgagagcccagaaaactgtcatttagctggctgcagaactcctttgcagaaactggggttccaggagcctggcacctttatgtcaacatttttgattctagctacctgtattatttcacctagcttgtcccaagcttccctgccagcctgaagtccattttcccctttttattttaaaatttgactcctcttcaagcttgaaaaccctctgaactcagtcttctttacctcattatcaccttcccctcacactcctaaaattgcatgaaagacagaacatggagaacttgctcaagtgcaggcagagagcaaaaaggggaaatatgtctgggaaaaagtgcacgtgaagaaacaaagaaggacagaggccattccgaaatcaagaaactcatgttcttaactttaaaaaaggtatcaatccttggtttttaaactgtggtccatctccagactctaccacttacggacagacagacagacagacacacacacacacacacacacacattttgggacaagtggggagcccaagaaagtaattagtaagtgagtggtcttttctgtaagctaatccacaacctgttaccacttcctgaatcagttattatttcttcatttttttttctaccagaggacagattaatagatttaacccttcacaacagttcttgttagaatcatgggatgtgtggcccagaggtaagaatagaatttctttccctaaagaacataccttttgtagatgaactcttctcaactctgttttgctatgctataattccgaaacatacaagacaaaaaaaatgaagacactcaatctagaacaaactaagccaggtatgcaaatatcgctgaatagaaacagatggaattagaaatatatcttctatttttaggcttctatttcctttccacccactcttcacaggctattctactttaaaggaagcctttttattttgctgcacacaatctagcaggaatctttttttttttttaagagctgtgtcatccttatgtaggcaagagatgtttgcttttgttaaaagctttattgagatataattaacataaaataaactgaacatatttaaagtgtactatttgataagttttcacaccttgtggagaacatgcatactacaattaagagagtgaacatatccatcatccctcaaagtgtcacaatgctcctcctgatgactcctccccagaaaaccaccaatcggctttcattttgcattttgtagttttatgtgaatggaatcatatagtatgtcttttttttttgtctggcttctttcactttgcataattattttgagattcatatgtctccatcttgatgctcgtatgaattcattcttttaaatgttgaatattcccttgtatggatataccacaattcatttacccatttacttgttgatgacatttgggttgttttagttttgggatattacaaataaagctgctgtgaacatttgtgtac

SEQ ID NO: 21298 - DNA, 950 bp, Homo sapiens
agtttgttgaagttcgtgactgcttcactctctcattcttagcttgaatttggaaatgacttttgatgacctaaagatccagactgtgaaggaccagcctgatgagaagtcaaatggaaaaaaagctaaaggtcttcagtttctttactctccatggtggtgcctggctgctgcgactctaggggtcctttgcctgggattagtagtgaccattatggtgctgggcatgcaattatcccaggtgtctgacctcctaacacaagagcaagcaaacctaactcaccagaaaaagaaactggagggacagatctcagcccggcaacaagcagaagaagcttcacaggagtcagaaaacgaactcaaggaaatgatagaaacccttgctcggaagctgaatgagaaatccaaagagcaaatggaacttcaccaccagaatctgaatctccaagaaacactgaagagagtagcaaattgttcaggacttcatccagcaagcaatttcctattccagttttccattctggatggggctgtctcggaggaaccccagctacccatggctctgggaggacggttctcctttgatgccccacttatttagagtccgaggcgctgtctcccagacatacccttcaggtacctgtgcatatatacaacgaggagctgtttatgcggaaaactgcattttagctgccttcagtatatgtcagaagaaggcaaacctaagagcacagtgaatttgaaggctctggaagaaaagaaaaaagtctttgagttttattctggaatttaagctattctttgtcacttgggtgccaaacatgagagcccagaaaactgtcatttagctggctgcagaactcctttgcagaaactggggttccaggagcctggcacctttatgtcaacatttttgattctagctacctgtattatttcacctagcttgt

SEQ ID NO: 21299 - DNA, 1008 bp, Homo sapiens
gtgactgcttcactctctcattcttagcttgaatttggaaatgacttttgatgacctaaagatccagactgtgaaggaccagcctgatgagaagtcaaatggaaaaaaagctaaaggtcttcagtttctttactctccatggtggtgcctggctgctgcgactctaggggtcctttgcctgggattagtagtgaccattatggtgctgggcatgcaattatcccaggtgtctgacctcctaacacaagagcaagcaaacctaactcaccagaaaaagaaactggagggacagatctcagcccggcaacaagcagaagaagcttcacaggagtcagaaaacgaactcaaggaaatgatagaaacccttgctcggaagctgaatgagaaatccaaagagcaaatggaacttcaccaccagaatctgaatctccaagaaacactgaagagagtagcaaattgttcagctccttgtccgcaagactggatctggcatggagaaaactgttacctattttcctcgggctcatttaactgggaaaagagccaagagaagtgcttgtctttggatgccaagttgctgaaaattaatagcacagctgatctgatttagagtccgaggcgctgtctcccagacatacccttcaggtacctgtgcatatatacaacgaggagctgtttatgcggaaaactgcattttagctgccttcagtatatgtcagaagaaggcaaacctaagagcacagtgaatttgaaggctctggaagaaaagaaaaaagtctttgagttttattctggaatttaagctattctttgtcacttgggtgccaaacatgagagcccagaaaactgtcatttagctggctgcagaactcctttgcagaaactggggttccaggagcctggcacctttatgtcaacatttttgattctagctacctgtattatttcacctagcttgtcccaagcttccctgccagcctgaagtccattttcccctttttattttaa

SEQ ID NO: 21300 - DNA, 4181 bp, Homo sapiens
ctgagccggagacaggcagttgtgaaaaacttcaggacaaaaatgtttcatttaaggacttgtgctgctaagttgaggccattgacggcttcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcgctcatcagggcatatcagatacgagggcaccatgtagcacagctggaccccctggggattttggatgctgatctggactcctccgtgcccgctgacattatctcatccacagacaaacttgggttctatggcctggatgagtctgacctcgacaaggtcttccacttgcccaccaccactttcatcgggggacaggaatcagcacttcctctgcgggagatcatccgtcggctggagatggcctactgccagcatattggggtggagttcatgttcatcaatgacctggagcagtgccagtggatccggcagaagtttgagacccctgggatcatgcagttcacaaatgaggagaaacggaccctgctggccaggcttgtgcggtccaccaggtttgaggagttcctacagcggaagtggtcctctgagaagcgctttggtctagaaggctgcgaggtactgatccctgccctcaagaccatcattgacaagtctagtgagaatggcgtggactacgtgatcatgggcatgccacacagagggcggctgaacgtgcttgcaaatgtcatcaggaaggagctggaacagatcttctgtcaattcgattcaaagctggaggcagctgatgagggctccggagatgtgaagtaccacctgggcatgtatcaccgcaggatcaatcgtgtcaccgacaggaacattaccttgtccttggtggccaacccttcccaccttgaggccgctgaccccgtggtgatgggcaagaccaaagccgaacagttttactgtggcgacactgaagggaaaaaggtcatgtccatcctgttgcatggggatgctgcatttgctggccagggcattgtgtacgagaccttccacctcagcgacctgccatcctacacaactcatggcaccgtgcacgtggtcgtcaacaaccagatcggcttcaccaccgaccctcggatggcccgctcctccccctaccccactgacgtggcccgagtggtgaatgcccccattttccacgtgaactcagatgaccccgaggctgtcatgtacgtgtgcaaagtggcggccgagtggaggagcaccttccacaaggacgtggttgtcgatttggtgtgttaccggcgcaacggccacaacgagatggatgagcccatgttcacgcagccgctcatgtacaagcagatccgcaagcagaagcctgtgttacagaagtacgctgagctgctggtgtcgcagggtgtggtcaaccagcctgagtatgaggaggaaatttccaagtatgataagatctgtgaggaagcttttgccagatctaaagatgagaagatcttgcacattaagcactggctggactctccctggcctggcttcttcaccctggacgggcagcccaggagcatgtcctgcccctccacgggtctgacggaggatattctgacacacatcgggaatgtggctagttctgtgcctgtggaaaactttactattcatggagggctgagccggatcttgaagactcgtggggaaatggtgaagaaccggactgtggactgggctctagcggagtacatggcgtttggctcgctcctgaaggagggcatccacattcggctgagcggccaggacgtggagcggggcacattcagccaccgccaccatgtgctccatgaccagaatgtggacaagagaacctgcatccccatgaaccatctctggcccaatcaggccccctatactgtgtgcaacagctcactgtctgagtacggcgtgctgggctttgagctgggcttcgccatggccagtcctaatgccctggtcctctgggaagcccaatttggtgacttccacaacacggcccagtgtatcatcgaccagttcatctgcccgggacaagccaagtgggtgcggcagaatggcatcgtgttgctgctgccccatggcatggagggcatgggtccagaacattcctccgcccgcccagagcggttcttgcagatgtgcaacgatgacccagatgtcctgccagaccttaaagaagccaacttcgacatcaatcagctatatgactgcaattgggttgttgtcaactgctccactcctggcaacttcttccacgtgctacgacgccagatcctgctgccattccggaagccgttaattatcttcacccccaaatccctgttgcgccaccccgaggccagatccagctttgatgagatgcttccaggaacccacttccagcgggtgatcccagaagatggccctgcagctcagaacccagaaaatgtcaaaaggcttctcttctgcaccggcaaagtgtattatgacctcacccgggagcgcaaagcacgcgacatggtggggcaggtggccatcacaaggattgagcagctgtcgccattcccctttgacctcctgctgaaggaggtgcagaagtaccccaatgctgagctggcctggtgccaggaggagcacaagaaccaaggctactatgactacgtgaagccaagacttcggaccaccatcagccgcgccaagcccgtctggtatgccggccgggacccagcggctgctccagccaccggcaacaagaagacccacctgacggagctgcagcgcctcctggacacggccttcgacctggacgtcttcaagaacttctcgtagatgctgcctagggttgcttgggccactgccctctccacacccatgactgccccttgcttctcaactaaagaatagtgcctcagcgctgcccacaccaccgccctcctcgctgtgccaccacccctccctctgctctcataggagttaggctgtcgtccccctccagtgcttggctgccccacaggccacacgctgcccaggctctgctgacttctgagcagttttccaggaggccggggggagcaggaggaggaaaggtagcccccgagggatgtccttggggaggggtcagctctggccacaatcctccccaccagtctcacccactaggataggaactgggccttgtgtgctggcttccgctgtcacccagcaaggcacaggctcctgtatttgagactaggatagcttcatcttgagcctgagccttagaatctgtagaggagcctggagtcggatctagccatggctggcagaggtttctagggtgggccccagccgtggcgtgaactgaggatgacccggggcagctggcaggagagagccttggcctgacctggcacagaaagggcagcttcagtctctgcagtgtccattatctgctgttccttcgagggttccaggctgtgtgtggggcccaagcatgccccacccacccctcctgggcccaggcagcacctggagcccacagagtctgtgtgtagccaggaagccccgctcaggtagccaccaccggggcactggctgctctgtcttggtcctgttaaccctccacctcctctcttggactccctccccaccccaaccactctttctttctcctttaacccaatggagactttctgatgcatcgttttctttgctgtgccaaagcaggtcagaagagggagaggaggggctgggggtgaggggccaggccatggccaaggggccagctgcccctcatttatcactctgaccttcacagggacagatctgatttatttattttggttaaaaaaaaaaaaaaggaacagaaacaactttgcattgcattggcttgacccataaactaagttatatccgtg

SEQ ID NO: 21301 - DNA, 789 bp, Homo sapiens
tttggagccccggagtggggtgtcggcgcctcattcgggtggagctgagccggagacaggcagcgtccttgtgaactttccgcttggatcctgactctgctgttagtagcctatgaccttggatgaaatgcagttgtgaaaaacttcaggacaaaaatgtttcatttaaggacttgtgctgctaagttgaggccattgacggcttcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcgctcatcagggcatatcagatacgagggcaccatgtagcacagctggaccccctggggattttggatgctgatctggactcctccgtgcccgctgacattatctcatccacagacaaacttgggttctatggcctggatgagtctgacctcgacaaggtcttccacttgcccaccaccactttcatcgggggacaggaatcagcacttcctctgcgggagatcatccgtcggctggag

SEQ ID NO: 21302 - DNA, 1744 bp, Homo sapiens
ccgagagtttggagccccggagtggggtgtcggcgcctcattcgggtggagctgagccggagacaggcagttgtgaaaaacttcaggacaaaaatgtttcatttaaggacttgtgctgctaagttgaggccattgacggcttcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcgctcatcagggcatatcagatacgagggcaccatgtagcacagctggaccccctggggattttggatgctgatctggactcctccgtgcccgctgacattatctcatccacagacaaacttgggttctatggcctggatgagtctgacctcgacaaggtcttccacttgcccaccaccactttcatcgggggacaggaatcagcacttcctctgcgggagatcatccgtcggctggagatggcctactgccagcatattggggtggagttcatgttcatcaatgacctggagcagtgccagtggatccggcagaagtttgagacccctgggatcatgcagttcacaaatgaggagaaacggaccctgctggccaggcttgtgcggtccaccaggtttgaggagttcctacagcggaagtggtcctctgagaagcgctttggtctagaaggctgcgaggtactgatccctgccctcaagaccatcattgacaagtctagtgagaatggcgtggactacgtgatcatgggcatgccacacagagggcggctgaacgtgcttgcaaatgtcatcaggaaggagctggaacagatcttctgtcaattcgattcaaagctggaggcagctgatgagggctccggagatgtgaagtaccacctgggcatgtatcaccgcaggatcaatcgtgtcaccgacaggaacattaccttgtccttggtggccaacccttcccaccttgaggccgctgaccccgtggtgatgggcaagaccaaagccgaacagttttactgtggcgacactgaagggaaaaaggtaaggcccagagagaggcgtgcaaggcagatcgtcaaggccccatgttccagcatggagttccgctcaccaacataacccagagccctgggtgcatctagactttaaaaaaatatttaaagtcggccgggcgcagtgtctcacgcctgtaatcccagcactttgggaggccgaggtgggcagatcacctgagttcgggagttggagaccagcctgaccaacatggagaaactccatctctactaaaaatacaaaattagctgggcgtggtggcgcgcgcctgtaatcccagctactcaggaggctgaggcaggagaatcgcttgaacccgggaggtggaggttgcagtgagccgagattacgccattgcactccagcctgggccaacaagagcgaaactctgtctcaaagaaaaaaataaataaataaaaaatatatgtatatg

SEQ ID NO: 21303 - DNA, 3266 bp, Homo sapiens
attctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcgctcatcagggcatatcaggtcaggggtcaccacattgcaaaacttgatcctctcggaattagttgtgtaaattttgatgatgctccagtaactgtttcttcaaacgtggatcttgcagttttcaaggaacgacttcgaatgctaacagtaggagggttctatggcctggatgagtctgacctcgacaaggtcttccacttgcccaccaccactttcatcgggggacaggaatcagcacttcctctgcgggagatcatccgtcggctggagatggcctactgccagcatattggggtggagttcatgttcatcaatgacctggagcagtgccagtggatccggcagaagtttgagacccctgggatcatgcagttcacaaatgaggagaaacggaccctgctggccaggcttgtgcggtccaccaggtttgaggagttcctacagcggaagtggtcctctgagaagcgctttggtctagaaggctgcgaggtactgatccctgccctcaagaccatcattgacaagtctagtgagaatggcgtggactacgtgatcatgggcatgccacacagagggcggctgaacgtgcttgcaaatgtcatcaggaaggagctggaacagatcttctgtcaattcgattcaaagctggaggcagctgatgagggctccggagatgtgaagtaccacctgggcatgtatcaccgcaggatcaatcgtgtcaccgacaggaacattaccttgtccttggtggccaacccttcccaccttgaggccgctgaccccgtggtgatgggcaagaccaaagccgaacagttttactgtggcgacactgaagggaaaaaggtcatgtccatcctgttgcatggggatgctgcatttgctggccagggcattgtgtacgagaccttccacctcagcgacctgccatcctacacaactcatggcaccgtgcacgtggtcgtcaacaaccagatcggcttcaccaccgaccctcggatggcccgctcctccccctaccccactgacgtggcccgagtggtgaatgcccccattttccacgtgaactcagatgaccccgaggctgtcatgtacgtgtgcaaagtggcggccgagtggaggagcaccttccacaaggacgtggttgtcgatttggtgtgttaccggcgcaacggccacaacgagatggatgagcccatgttcacgcagccgctcatgtacaagcagatccgcaagcagaagcctgtgttacagaagtacgctgagctgctggtgtcgcagggtgtggtcaaccagcctgagtatgaggaggaaatttccaagtatgataagatctgtgaggaagcttttgccagatctaaagatgagaagatcttgcacattaagcactggctggactctccctggcctggcttcttcaccctggacgggcagcccaggagcatgtcctgcccctccacgggtctgacggaggatattctgacacacatcgggaatgtggctagttctgtgcctgtggaaaactttactattcatggagggctgagccggatcttgaagactcgtggggaaatggtgaagaaccggactgtggactgggctctagcggagtacatggcgtttggctcgctcctgaaggagggcatccacattcggctgagcggccaggacgtggagcggggcacattcagccaccgccaccatgtgctccatgaccagaatgtggacaagagaacctgcatccccatgaaccatctctggcccaatcaggccccctatactgtgtgcaacagctcactgtctgagtacggcgtgctgggctttgagctgggcttcgccatggccagtcctaatgccctggtcctctgggaagcccaatttggtgacttccacaacacggcccagtgtatcatcgaccagttcatctgcccgggacaagccaagtgggtgcggcagaatggcatcgtgttgctgctgccccatggcatggagggcatgggtccagaacattcctccgcccgcccagagcggttcttgcagatgtgcaacgatgacccagatgtcctgccagaccttaaagaagccaacttcgacatcaatcagctatatgactgcaattgggttgttgtcaactgctccactcctggcaacttcttccacgtgctacgacgccagatcctgctgccattccggaagccgttaattatcttcacccccaaatccctgttgcgccaccccgaggccagatccagctttgatgagatgcttccaggaacccacttccagcgggtgatcccagaagatggccctgcagctcagaacccagaaaatgtcaaaaggcttctcttctgcaccggcaaagtgtattatgacctcacccgggagcgcaaagcacgcgacatggtggggcaggtggccatcacaaggattgagcagctgtcgccattcccctttgacctcctgctgaaggaggtgcagaagtaccccaatgctgagctggcctggtgccaggaggagcacaagaaccaaggctactatgactacgtgaagccaagacttcggaccaccatcagccgcgccaagcccgtctggtatgccggccgggacccagcggctgctccagccaccggcaacaagaagacccacctgacggagctgcagcgcctcctggacacggccttcgacctggacgtcttcaagaacttctcgtagatgctgcctagggttgcttgggccactgccctctccacacccatgactgccccttgcttctcaactaaagaatagtgcctcagcgctgcccacaccaccgccctcctcgctgtgccaccacccctccctctgctctcataggagttaggctgtcgtccccctccagtgcttggctgccccacaggccacacgctgcccaggctctgctgacttctgagcagttttccaggaggccggggggagcaggaggaggaaaggtagcccccgagggatgtcctt

SEQ ID NO: 21304 - DNA, 3479 bp, Homo sapiens
agagtttggagccccggagtggggtgtcggcgcctcattcgggtggagctgagccggagacaggcagttgtgaaaaacttcaggacaaaaatgtttcatttaaggacttgtgctgctaagttgaggccattgacggcttcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcgctcatcagggcatatcaggtcaggggtcaccacattgcaaaacttgatcctctcggaattagttgtgtaaattttgatgatgctccagtaactgtttcttcaaacgtggggttctatggcctggatgagtctgacctcgacaaggtcttccacttgcccaccaccactttcatcgggggacaggaatcagcacttcctctgcgggagatcatccgtcggctggagatggcctactgccagcatattggggtggagttcatgttcatcaatgacctggagcagtgccagtggatccggcagaagtttgagacccctgggatcatgcagttcacaaatgaggagaaacggaccctgctggccaggcttgtgcggtccaccaggtttgaggagttcctacagcggaagtggtcctctgagaagcgctttggtctagaaggctgcgaggtactgatccctgccctcaagaccatcattgacaagtctagtgagaatggcgtggactacgtgatcatgggcatgccacacagagggcggctgaacgtgcttgcaaatgtcatcaggaaggagctggaacagatcttctgtcaattcgattcaaagctggaggcagctgatgagggctccggagatgtgaagtaccacctgggcatgtatcaccgcaggatcaatcgtgtcaccgacaggaacattaccttgtccttggtggccaacccttcccaccttgaggccgctgaccccgtggtgatgggcaagaccaaagccgaacagttttactgtggcgacactgaagggaaaaaggtcatgtccatcctgttgcatggggatgctgcatttgctggccagggcattgtgtacgagaccttccacctcagcgacctgccatcctacacaactcatggcaccgtgcacgtggtcgtcaacaaccagatcggcttcaccaccgaccctcggatggcccgctcctccccctaccccactgacgtggcccgagtggtgaatgcccccattttccacgtgaactcagatgaccccgaggctgtcatgtacgtgtgcaaagtggcggccgagtggaggagcaccttccacaaggacgtggttgtcgatttggtgtgttaccggcgcaacggccacaacgagatggatgagcccatgttcacgcagccgctcatgtacaagcagatccgcaagcagaagcctgtgttacagaagtacgctgagctgctggtgtcgcagggtgtggtcaaccagcctgagtatgaggaggaaatttccaagtatgataagatctgtgaggaagcttttgccagatctaaagatgagaagatcttgcacattaagcactggctggactctccctggcctggcttcttcaccctggacgggcagcccaggagcatgtcctgcccctccacgggtctgacggaggatattctgacacacatcgggaatgtggctagttctgtgcctgtggaaaactttactattcatggagggctgagccggatcttgaagactcgtggggaaatggtgaagaaccggactgtggactgggctctagcggagtacatggcgtttggctcgctcctgaaggagggcatccacattcggctgagcggccaggacgtggagcggggcacattcagccaccgccaccatgtgctccatgaccagaatgtggacaagagaacctgcatccccatgaaccatctctggcccaatcaggccccctatactgtgtgcaacagctcactgtctgagtacggcgtgctgggctttgagctgggcttcgccatggccagtcctaatgccctggtcctctgggaagcccaatttggtgacttccacaacacggcccagtgtatcatcgaccagttcatctgcccgggacaagccaagtgggtgcggcagaatggcatcgtgttgctgctgccccatggcatggagggcatgggtccagaacattcctccgcccgcccagagcggttcttgcagatgtgcaacgatgacccagatgtcctgccagaccttaaagaagccaacttcgacatcaatcagctatatgactgcaattgggttgttgtcaactgctccactcctggcaacttcttccacgtgctacgacgccagatcctgctgccattccggaagccgttaattatcttcacccccaaatccctgttgcgccaccccgaggccagatccagctttgatgagatgcttccaggaacccacttccagcgggtgatcccagaagatggccctgcagctcagaacccagaaaatgtcaaaaggcttctcttctgcaccggcaaagtgtattatgacctcacccgggagcgcaaagcacgcgacatggtggggcaggtggccatcacaaggattgagcagctgtcgccattcccctttgacctcctgctgaaggaggtgcagaagtaccccaatgctgagctggcctggtgccaggaggagcacaagaaccaaggctactatgactacgtgaagccaagacttcggaccaccatcagccgcgccaagcccgtctggtatgccggccgggacccagcggctgctccagccaccggcaacaagaagacccacctgacggagctgcagcgcctcctggacacggccttcgacctggacgtcttcaagaacttctcgtagatgctgcctagggttgcttgggccactgccctctccacacccatgactgccccttgcttctcaactaaagaatagtgcctcagcgctgcccacaccaccgccctcctcgctgtgccaccacccctccctctgctctcataggagttaggctgtcgtccccctccagtgcttggctgccccacaggccacacgctgcccaggctctgctgacttctgagcagttttccaggaggccggggggagcaggaggaggaaaggtagcccccgagggatgtccttggggaggggtcagctctggccacaatcctccccaccagtctcacccacta

SEQ ID NO: 21305 - DNA, 5083 bp, Homo sapiens
agaagagcgatgggagggggtgacgtggcagtgacaggcgcataaactgaaatgaatggcggaaacagcagccaatcggcgatcagattggccgggcattccgcattctcccgtcctccctgagcgctggaaacttcaggaaagcaccaatgagcttccccaaaagtctgattggcctttatctgaaccaatcaaaggtgggtctggcggacgcgtcccaccccaggctctcactgggcgctgtagaatgacaggcccgagagaaatgccaatatccgcggggtcttcctcaagtgacactcagcggcaccaatcgacgtccttcttcccggcggccgagccctcctccccgcggctggccgggcggggcggggacgctgcgcggcggtggctgatgcggtagccgtgtggggcgctccgggcggcgacggcggctctcgtaggcggttccggtcttgtatctccaggcggcggcggctcatggcggcgacggagctgagaggagtggtggggccaggcccggcagccattgcagcacttggcggcggcggcgccggtcccccagtggtgggaggaggcggcggccgcggagatgcggggccaggctccggggccgcgtcagggacggtggtcgcggcggcggcgggaggcccgggcccgggggccgggggagtggcggcggctggcccggcccctgcgccgccgactgggggctcgggcggctcgggcgctgggggttcgggctcggctcgagagggctggctcttcaaatggaccaattatatcaaaggctaccagcggcgatggttcgtgctgagcaacgggctcctgagctactacagatcaaaggcagaaatgagacatacctgccgtggtaccatcaacctcgccacagccaacatcaccgtggaggactcctgcaacttcatcatttccaatgggggtgctcagacctaccatctgaaagctagttcagaagttgagcggcagcgctgggtgacggccctggaactggccaaggccaaagctgtgaagatgctggcagagtcagatgaatcaggagatgaagagtctgtctcacaaactgacaagactgagctgcagaatacccttcggaccctctctagcaaagtagaggacttgagcacgtgcaatgacttgatagctaagcatggcacagctctgcagcgttctctcagtgagctggagtccctgaagttgcctgctgagagcaatgaaaagatcaaacaggtcaacgaacgagccacactctttaggataacatccaatgccatgatcaacgcctgcagagatttcctcatgttagcccagacccatagtaaaaaatggcaaaagtcactacagtatgaaagagaccagcgtatccgactggaagaaaccctcgagcagctggcgaagcagcataatcacctggagagggccttccgaggagccacggtgctgccggcaaacactcctggcaatgtgggttctggtaaagatcagtgctgctctggcaaaggggacatgagcgatgaagatgatgagaatgaattttttgatgcacctgagatcatcaccatgcctgaaaatttgggccacaaacgtactggcagcaatatcagtggagccagcagtgacatcagccttgatgaacagtacaagcatcagctggaggagaccaaaaaggaaaagagaaccagaataccatacaagccaaactatagcctcaatttatggagcatcatgaagaactgcattggaaaagaactctctaagatccccatgccggtaaactttaatgagcccttgtccatgcttcagcgccttactgaagatctggaataccatgagctgttagaccgagctgcaaaatgtgagaattctctagaacagctctgttatgttgcagctttcaccgtgtcctcctactccactactgtcttccgcaccagtaagccattcaacccactgcttggggagacctttgagctggaccgattagaggagaatgggtaccgatccctctgtgaacaggtgagtcatcatccccctgctgctgcgcaccatgctgagtccaaaaatggctggacattgcgtcaggaaatcaaaatcaccagcaagtttcgaggcaaatacctctccattatgcccctcggtaccattcattgtattttccatgcaactgggcaccactacacttggaagaaagttaccacaactgtacacaacattattgtgggcaagttgtggatagatcagtctggcgaaattgatattgtgaatcacaagacaggagacaagtgtaatcttaaatttgttccttatagctacttctctcgggatgtagcaagaaaggtgacgggggaagtgacagatccatcaggaaaagtccactttgctcttctggggacgtgggatgagaaaatggaatgtttcaaagtacagccagtcattggggaaaatgggggtgatgctcgacagagaggccatgaagcagaggaaagcagggtcatgctgtggaaaaggaatcctttaccgaagaatgcagaaaacatgtactacttctcagagcttgctctgactctcaatgcttgggaaagtggcactgcccccacagacagccggttacgacctgaccagagactgatggaaaatggacgctgggatgaagcaaatgcggagaagcagcgcctggaggaaaaacaaagactttccagaaagaagagagaagcggaagctatgaaagccacagaggatggcacaccatatgatccctataaggcactgtggtttgagcggaagaaggaccctgttaccaaggagttaacccatatttataggggagaatactgggagtgtaaagaaaaacaggactggagctcatgcccggacattttctgaaacggcagtaacaaaaaagaggagcatataatggagaagaggacagaggatgtgtgggaaagctggaagttgtgactctcttaccaagtgctttcctcaagtttgtctctcttgaccaatcattttttccaaatcaatcaccagaaggagacaccagtggtggtgattggctggttgccttagctgattgaaactgaaatcgacataggagatactatgtctgtaagggagaggtttagtggccgaaggttagtgttattccacatccacgaagtcaagtattcttggctcttctttctccctctgcccccatttaagacaatgtcactcaccctccccttgtagtatcctgctcagccaagatctgcctaagattatgattcaggggcattttggtgctgttaaaagcaagagccgaatttagaagttcccttaaaaagaaacacataagacttaccaatggaggcattgtgaatggttgcagtggagcttaggtataacatcatcaagtgtgttcacacgcggggtcggtttaatggagtgtccacgcggagataactgcgatattggaacacctgtgagagagattgttctatagggctggaatattcagagttacattcttggaagtttctgtttttacttgcatcaaacacccctctgttgttctccatcatctttaatagcaactggagaccactttggtcattggtaagggggtgcattctcctcacaaaggggttttatggacttcctcaggcggagagcttctgagaacacaggcaggatggaaaaagactactagccacttttgctttcccaaccccccttaatgccatccttcattgtctttctggcttctcttcttctggcacagtaccattttgggtctgtgccccagtgtggagcaaaacattgcctgtcccattctgatatacttcagaatttgagagcagaagttaatgtggaacaaaagttttcaccatctctcaagccccaaggactggagccacctctggaataatgtgttaaatatctgtatattatatatatgtagagaaaaatctaattttttggtttgatttccttcccattaagaatcttgttttttgatacccttgtctccctgagactctttcttggacacgtgttgatgtggatggcactcctgctctccatcttttatgggcagagagatttcaaaacctgagcaggatcatgtctggcagttactaaacagggactttgtccatggtttgtatcatggggtgcctactgctgtctaaactctgctctcctaattagctgactcttgaaaatgaaatcctaacctctttcctgcctcttttctttctcttttcaggaagagtgtgggtagaaagtccggagggcaacttccaatttaattctgctctgtccggcgcataggctgaattccaaaagaactttcttcctaggatgtggggcttaaagcaccgtcatgtggggtggatcagataattgctcctgtggggccctggcttccttctctgtttgtgcagtatttgtttttgttgtcttgttgagaaatatcccctgtgcaacccacccttggttgaggatcacaaattgaggtgccttccttgtatgctttttgttagtattttttgtttttgttccttaactgctgagcctcagccagcgtgggtcctgggggaaataccattccaaaggaagccatccctatggggaaattggttttactgggtaaattaatacttttatttcttcccctatcccttccttcctagttgtgataaacatgggagaggagtgactttgactgctggggaatttcctcctaagaaccttattcccaaaataagccagggattatgtcaaggcttctttcaaggaggctcataaaagcagtgacctcatccggggctttggatagagtgagaattccccaactaaattggacttctctgctttatccccttctcttccttcaccatctgcactacatttctggctgatcccaatcagattcccgctaatggaagaagtttagaatctttcaggtggaataaagtcacatgaaaacaaaacacaactatatatattttcagtttttttgccttattgatttttttccaaaaaaaaaaaactactaaattaaataattttttaaaagtca

SEQ ID NO: 21306 - DNA, 3403 bp, Homo sapiens
atggcggcgacggagctgagaggagtggtggggccaggcccggcagccattgcagcacttggcggcggcggcgccggtcccccagtggtgggaggaggcggcggccgcggagatgcggggccaggctccggggccgcgcttcagcgccttactgaagatctggaataccatgagctgttagaccgagctgcaaaatgtgagaattctctagaacagctctgttatgttgcagctttcaccgtgtcctcctactccactactgtcttccgcaccagtaagccattcaacccactgcttggggagacctttgagctggaccgattagaggagaatgggtaccgatccctctgtgaacaggtgagtcatcatccccctgctgctgcgcaccatgctgagtccaaaaatggctggacattgcgtcaggaaatcaaaatcaccagcaagtttcgaggcaaatacctctccattatgcccctcggtaccattcattgtattttccatgcaactgggcaccactacacttggaagaaagttaccacaactgtacacaacattattgtgggcaagttgtggatagatcagtctggcgaaattgatattgtgaatcacaagacaggagacaagtgtaatcttaaatttgttccttatagctacttctctcgggatgtagcaagaaaggtgacgggggaagtgacagatccatcaggaaaagtccactttgctcttctggggacgtgggatgagaaaatggaatgtttcaaagtacagccagtcattggggaaaatgggggtgatgctcgacagagaggccatgaagcagaggaaagcagggtcatgctgtggaaaaggaatcctttaccgaagaatgcagaaaacatgtactacttctcagagcttgctctgactctcaatgcttgggaaagtggcactgcccccacagacagccggttacgacctgaccagagactgatggaaaatggacgctgggatgaagcaaatgcggagaagcagcgcctggaggaaaaacaaagactttccagaaagaagagagaagcggaagctatgaaagccacagaggatggcacaccatatgatccctataaggcactgtggtttgagcggaagaaggaccctgttaccaaggagttaacccatatttataggggagaatactgggagtgtaaagaaaaacaggactggagctcatgcccggacattttctgaaacggcagtaacaaaaaagaggagcatataatggagaagaggacagaggatgtgtgggaaagctggaagttgtgactctcttaccaagtgctttcctcaagtttgtctctcttgaccaatcattttttccaaatcaatcaccagaaggagacaccagtggtggtgattggctggttgccttagctgattgaaactgaaatcgacataggagatactatgtctgtaagggagaggtttagtggccgaaggttagtgttattccacatccacgaagtcaagtattcttggctcttctttctccctctgcccccatttaagacaatgtcactcaccctccccttgtagtatcctgctcagccaagatctgcctaagattatgattcaggggcattttggtgctgttaaaagcaagagccgaatttagaagttcccttaaaaagaaacacataagacttaccaatggaggcattgtgaatggttgcagtggagcttaggtataacatcatcaagtgtgttcacacgcggggtcggtttaatggagtgtccacgcggagataactgcgatattggaacacctgtgagagagattgttctatagggctggaatattcagagttacattcttggaagtttctgtttttacttgcatcaaacacccctctgttgttctccatcatctttaatagcaactggagaccactttggtcattggtaagggggtgcattctcctcacaaaggggttttatggacttcctcaggcggagagcttctgagaacacaggcaggatggaaaaagactactagccacttttgctttcccaaccccccttaatgccatccttcattgtctttctggcttctcttcttctggcacagtaccattttgggtctgtgccccagtgtggagcaaaacattgcctgtcccattctgatatacttcagaatttgagagcagaagttaatgtggaacaaaagttttcaccatctctcaagccccaaggactggagccacctctggaataatgtgttaaatatctgtatattatatatatgtagagaaaaatctaattttttggtttgatttccttcccattaagaatcttgttttttgatacccttgtctccctgagactctttcttggacacgtgttgatgtggatggcactcctgctctccatcttttatgggcagagagatttcaaaacctgagcaggatcatgtctggcagttactaaacagggactttgtccatggtttgtatcatggggtgcctactgctgtctaaactctgctctcctaattagctgactcttgaaaatgaaatcctaacctctttcctgcctcttttctttctcttttcaggaagagtgtgggtagaaagtccggagggcaacttccaatttaattctgctctgtccggcgcataggctgaattccaaaagaactttcttcctaggatgtggggcttaaagcaccgtcatgtggggtggatcagataattgctcctgtggggccctggcttccttctctgtttgtgcagtatttgtttttgttgtcttgttgagaaatatcccctgtgcaacccacccttggttgaggatcacaaattgaggtgccttccttgtatgctttttgttagtattttttgtttttgttccttaactgctgagcctcagccagcgtgggtcctgggggaaataccattccaaaggaagccatccctatggggaaattggttttactgggtaaattaatacttttatttcttcccctatcccttccttcctagttgtgataaacatgggagaggagtgactttgactgctggggaatttcctcctaagaaccttattcccaaaataagccagggattatgtcaaggcttctttcaaggaggctcataaaagcagtgacctcatccggggctttggatagagtgagaattccccaactaaattggacttctctgctttatccccttctcttccttcaccatctgcactacatttctggctgatcccaatcagattcccgctaatggaagaagtttagaatctttcaggtggaataaagtcacatgaaaacaaaacacaactatatatattttcagtttttttgccttattgatttttttccaaaaaaaaaaaactactaaattaaataattttttaaaagtca

SEQ ID NO: 21307 - DNA, 4340 bp, Homo sapiens
gcccccgcctcgcgccgcgcgcacgtgactgcgcccccggccccgcccccggcctgccccccgcccccactggccgctcggccgcgcgcgggtcggccggctctatggggaaagcggcggctccgagccgaggcggcggctgtggcggccgctcccgcgggctctcgtcgctgttcacggttgtcccctgcctgtcgtgccacacggcggcgccgggcatgagcgcttccacgtccggctccgggccggagcccaagccccagccccagcccgtgcccgaaccggagcggggaccgctgtcagaacaggtgtcggaggcagtttcggaggcagtgccaagatcggaacctgtgtccgagacgacgtctgagccggagccaggggctgggcagccatcggaactgctgcaggggtcgcggccggggtcagagtcaagctcaggtgtaggggctgggcccttcactaaggccgcatcggagccgctctcccgggcggtggggagcgcgacctttctcagacccgagtcaggatcgctgccagcgttaaagcccctgcctcttctgcgaccaggacaggcgaagactcctcttggggttccaatgtcggggactggcacgacctccagtgccccactggccttactgcctctggacagcttcgagggctggcttctcaagtggaccaactatctgaagggctaccagcgccgctggttcgtgctgggcaatggtttgctctcttactacagaaatcagggtgaaatggcccacacgtgccgtggaaccatcaacctgtccaccgcgcacattgacacggaggactcttgtggtatcttgctgaccagtggggccaggagctaccacctcaaggccagctcagaggtggaccggcagcagtggatcaccgccctggagctggccaaggccaaggctgtccgcgtgatgaacactcattcagatgactctggggacgacgacgaggctaccaccccagccgacaagagcgagctgcaccacaccctgaagaatctttccctgaagttagatgacctcagcacgtgcaatgacctcatcgccaagcacggcgctgcactccagcgctccctgacagagctggacggcctcaagatcccatctgagagtggggagaagctgaaggtggtgaatgagcgggccaccctcttccgcatcacatccaatgctatgatcaacgcctgcagggacttcttggaactagcagagatacacagtcggaaatggcagcgggcactgcagtatgagcaggagcagcgcgtgcacttggaggaaaccattgagcagctggcgaagcagcacaacagcctcgagcgggccttccacagtgcccctggccggccggccaacccctccaagagcttcattgagggaagcctcttgactcccaaaggagaggacagtgaggaagatgaagataccgagtactttgatgccatggaagactccacatccttcatcaccgtgatcaccgaggccaaggaagacagcagaaaagctgaaggtagcaccgggacaagttccgtggactggagctcagcagacaatgtactagatggtgcctcgctcgtgcccaagggttcatccaaagtcaagaggcgagtccgcattcccaacaagcccaactacagccttaacctctggagcatcatgaagaactgcatcggccgggagctctccaggatccccatgccggtgaacttcaatgagcccctgtccatgctccagcggctgacagaggacctggagtaccaccacctgctggacaaggcagtgcactgcaccagctcagtggagcagatgtgcctggtggccgccttctctgtgtcctcctactccaccacagtgcaccgcatcgccaagcccttcaaccccatgctgggggagaccttcgagctggaccgcctcgacgacatgggcctgcgctccctctgtgagcaggtgagccaccaccccccctcagctgcgcactacgtgttctccaagcatggctggagcctctggcaggagatcaccatctccagcaagttccggggaaaatacatctccatcatgccgctaggtgccatccacttagaattccaggccagtgggaatcactacgtgtggaggaagagcacctcaactgttcacaacatcatcgtgggcaagctctggatcgaccagtcaggggacatcgagattgtgaaccataagaccaatgaccggtgccagctgaagttcctgccctacagctacttctccaaagaggcagcccggaaggtgacaggagtggtgagtgacagccagggcaaggcccattacgtgctgtccggctcgtgggatgaacaaatggagtgctccaaggtcatgcatagcagtcccagcagccccagctctgacgggaagcagaagacagtgtaccagaccctgtcagccaagctgctgtggaagaagtacccgctgccggagaacgcggagaacatgtactacttctcagagctggccctgaccctcaacgagcacgaggagggcgtagcgccaaccgacagccgcctgcggcccgaccagcggctgatggagaagggccgttgggacgaggccaataccgagaagcagcggctggaggagaagcagcgcctgtcgcggcgccggcggctggaggcctgcgggccgggcagcagctgcagctcggaggaagagaaggaggcggatgcctacacgccactgtggtttgagaagaggctggatccgctgaccggggagatggcctgtgtgtacaagggcggctactgggaggccaaggagaagcaagactggcatatgtgccccaacatcttctgagcgccacccttgcaacaaatacaggcgcctgcacagcctggcccacctgttcattaatgcactcaatttagtactgaatggtctttctcccagcccattcccagcccttcctatttcctttcctattttttttttctccccacactttcttgggactcccaccttggaaggaggaagggctgacctgggttctctccagcccccaggtgcgccgggtcacccgtgccccttcattatggacctgggccctaccggaacccctgccccagttaccacaactcaggccggctggcccgggccatgggctgcgcaaatcaccagcccccaacccagggaggaactggcccctcctagggagcctcttcgacttttttagaaaaatgatctccatttctttccagccatgatgtttagtaaatatttttagtaccgcacttagcagacagctttccaagtgtgctttcttgccacaaaagtgtcctggcaagagccccttatttttaagacatcaggaagccagaccgctttgagttgggagaattttgtagctcaacatatcaagtcctcgatggtatctgagctgcccacacccccacctgccaaggccccacagagcccaaaacagaagggggctgccccagcccagcagagcacagagtttctggagctcccatccacagatgcaggagggggtactgatggtaacccccatgtggatttgagggcagcagtccctggcctcaccctagccagcctgggtggctccctagccccaagaggccaggaagggctggaaggcagggcctgcaggtgctccccgccctgagacccaggccccaaatcagcaataatgaacaaacccttggcccagcctgggctggtgacctgggcaccagagaccttgcatccctcctcatcctaggaggcccctaggggtgccccatctcagtgtcccctgaactctttatttgcctaatttatatatatatatatgagatatataaatatatataaaatagctattttgcttaaatttctacagtatgtaaaagtgaaaaaatgatgaagacgggtgcacctgtctgagtttggccctcatgtgagctgtgcccttccctctcctcatgcccccttccagcggcttctgccaaccatggggggctggaccaccatggccactgacccagcccctcagaatcccacactccaatcctttccatttcagtttagtcctaaaagttcatcacagggtctttctttctactccaggactggttttgtttttatatatataaaaaaaaaaagtgaaaacaccaatgtgtgaaatgccttacaatgcccactggagaggcggggcggggtggggcaggatggccccactggggctcctacagagctgtggaatgtacctctccccaacactgttttgttagcgagcaccttttgaccagtaataaaaaaccttggctttggagttttccactg

SEQ ID NO: 21308 - DNA, 2992 bp, Homo sapiens
actggccgctcggccgcgcgcgggtcggccggctctatggggaaagcggcggctccgagccgaggcggcggctgtggcggccgctcccgcgggctctcgtcgctgttcacggttgtcccctgcctgtcgtgccacacggcggcgccgggcatgagcgcttccacgtccggctccgggccggagcccaagccccagccccagcccgtgcccgaaccggagcggggaccgctgtcagaacaggtgtcggaggcagtttcggaggcagtgccaagatcggaacctgtgtccgagacgacgtctgagccggagccaggggctgggcagccatcggaactgctgcaggggtcgcggccggggtcagagtcaagctcaggtgtaggggctgggcccttcactaaggccgcatcggagccgctctcccgggcggtggggagcgcgacctttctcagacccgagtcaggatcgctgccagcgttaaagcccctgcctcttctgcgaccaggacaggcgaagactcctcttggggttccaatgtcggggactggcacgacctccagtgccccactggccttactgcctctggacagcttcgagggctggcttctcaagtggaccaactatctgaagggctaccagcgccgctggttcgtgctgggcaatggtttgctctcttactacagaaatcagggtgaaatggcccacacgtgccgtggaaccatcaacctgtccaccgcgcacattgacacggaggactcttgtggtatcttgctgaccagtggggccaggagctaccacctcaaggccagctcagaggtggaccggcagcagtggatcaccgccctggagctggccaaggccaaggctgtccgcgtgatgaacactcattcagatgactctggggacgacgacgaggctaccaccccagccgacaagagcgagctgcaccacaccctgaagaatctttccctgaagttagatgacctcagcacgtgcaatgacctcatcgccaagcacggcgctgcactccagcgctccctgacagagctggacggcctcaagatcccatctgagagtggggagaagctgaaggtggtgaatgagcgggccaccctcttccgcatcacatccaatgctatgatcaacgcctgcagggacttcttggaactagcagagatacacagtcggaaatggcagcgggcactgcagtatgagcaggagcagcgcgtgcacttggaggaaaccattgagcagctggcgaagcagcacaacagcctcgagcgggccttccacagtgcccctggccggccggccaacccctccaagagcttcattgagggaagcctcttgactcccaaaggagaggacagtgaggaagatgaagataccgagtactttgatgccatggaagactccacatccttcatcaccgtgatcaccgaggccaaggaagacagcagaaaagctgaaggtagcaccgggacaagttccgtggactggagctcagcagacaatgtgaacttcaatgagcccctgtccatgctccagcggctgacagaggacctggagtaccaccacctgctggacaaggcagtgcactgcaccagctcagtggagcagatgtgcctggtggccgccttctctgtgtcctcctactccaccacagtgcaccgcatcgccaagcccttcaaccccatgctgggggagaccttcgagctggaccgcctcgacgacatgggcctgcgctccctctgtgagcaggtgagccaccaccccccctcagctgcgcactacgtgttctccaagcatggctggagcctctggcaggagatcaccatctccagcaagttccggggaaaatacatctccatcatgccgctaggtgccatccacttagaattccaggccagtgggaatcactacgtgtggaggaagagcacctcaactgttcacaacatcatcgtgggcaagctctggatcgaccagtcaggggacatcgagattgtgaaccataagaccaatgaccggtgccagctgaagttcctgccctacagctacttctccaaagaggcagcccggaaggtgacaggagtggtgagtgacagccagggcaaggcccattacgtgctgtccggctcgtgggatgaacaaatggagtgctccaaggtcatgcatagcagtcccagcagccccagctctgacgggaagcagaagacagtgtaccagaccctgtcagccaagctgctgtggaagaagtacccgctgccggagaacgcggagaacatgtactacttctcagagctggccctgaccctcaacgagcacgaggagggcgtagcgccaaccgacagccgcctgcggcccgaccagcggctgatggagaagggccgttgggacgaggccaataccgagaagcagcggctggaggagaagcagcgcctgtcgcggcgccggcggctggaggcctgcgggccgggcagcagctgcagctcggaggaaggtgaggccgggcgggaagggcgccccggaggggaggaaaggggtgcccgggtgggggtgccgcagggacggattccgggggagcaggccacaagcccacccaccagcccactgtgcctgcccagcagagaaggaggcggatgcctacacgccactgtggtttgagaagaggctggatccgctgaccggggagatggcctgtgtgtacaagggcggctactgggaggccaaggagaagcaagactggcatatgtgccccaacatcttctgagcgccacccttgcaacaaatacaggcgcctgcacagcctggcccacctgttcattaatgcactcaatttagtactgaatggtctttctcccagcccattcccagcccttcctatttcctttcctattttttttttctccccacactttcttgggactcccaccttggaaggaggaagggctgacctgggttctctccagcccccaggtgcgccgggtcacccgtg

SEQ ID NO: 21309 - DNA, 2747 bp, Homo sapiens
catggtgaaaccccgtttctactaaaaatacaaaatttagctgggcatggtgcgggccgtggaattccagctactagggaggccaaggcaggagaatcgcttgaacctgggaagcggaggctgcagtgaaccaagatcacgccactgcattccagcctgggctaccgagtgagactcagtctcaaaaaggaaaaaaaaaaaaagcggaaaaaaaaattcgctgatgttttaaccattctggggtcacagcctcctttgttatggacctactctggaaaaatgcacagacagagaacccgaacgatgtcgtcactggcagcgaagcgccttggcatgaaccgtaggccagctggctcaggaggtggaggcggtgaggcggccacttggggccaccgcttctggcggccgcaggagcgacccacagacagaaatcagggtgaaatggcccacacgtgccgtggaaccatcaacctgtccaccgcgcacattgacacggaggactcttgtggtatcttgctgaccagtggggccaggagctaccacctcaaggccagctcagaggtggaccggcagcagtggatcaccgccctggagctggccaaggccaaggctgtccgcgtgatgaacactcattcagatgactctggggacgacgacgaggctaccaccccagccgacaagagcgagctgcaccacaccctgaagaatctttccctgaagttagatgacctcagcacgtgcaatgacctcatcgccaagcacggcgctgcactccagcgctccctgacagagctggacggcctcaagatcccatctgagagtggggagaagctgaaggtggtgaatgagcgggccaccctcttccgcatcacatccaatgctatgatcaacgcctgcagggacttcttggaactagcagagatacacagtcggaaatggcagcgggcactgcagtatgagcaggagcagcgcgtgcacttggaggaaaccattgagcagctggcgaagcagcacaacagcctcgagcgggccttccacagtgcccctggccggccggccaacccctccaagagcttcattgagggaagcctcttgactcccaaaggagaggacagtgaggaagatgaagataccgagtactttgatgccatggaagactccacatccttcatcaccgtgatcaccgaggccaaggaagacagaaaagctgaaggtagcaccgggacaagttccgtggactggagctcagcagacaatgtactagatggtgcctcgctcgtgcccaagggttcatccaaagtcaagaggcgagtccgcattcccaacaagcccaactacagccttaacctctggagcatcatgaagaactgcatcggccgggagctctccaggatccccatgccggtgaacttcaatgagcccctgtccatgctccagcggctgacagaggacctggagtaccaccacctgctggacaaggcagtgcactgcaccagctcagtggagcagatgtgcctggtggccgccttctctgtgtcctcctactccaccacagtgcaccgcatcgccaagcccttcaaccccatgctgggggagaccttcgagctggaccgcctcgacgacatgggcctgcgctccctctgtgagcaggtgagccaccaccccccctcagctgcgcactacgtgttctccaagcatggctggagcctctggcaggagatcaccatctccagcaagttccggggaaaatacatctccatcatgccgctaggtgccatccacttagaattccaggccagtgggaatcactacgtgtggaggaagagcacctcaactgttcacaacatcatcgtgggcaagctctggatcgaccagtcaggggacatcgagattgtgaaccataagaccaatgaccggtgccagctgaagttcctgccctacagctacttctccaaagaggcagcccggaaggtgacaggagtggtgagtgacagccagggcaaggcccattacgtgctgtccggctcgtgggatgaacaaatggagtgctccaaggtcatgcatagcagtcccagcagccccagctctgacgggaagcagaagacagtgtaccagaccctgtcagccaagctgctgtggaagaagtacccgctgccggagaacgcggagaacatgtactacttctcagagctggccctgaccctcaacgagcacgaggagggcgtagcgccaaccgacagccgcctgcggcccgaccagcggctgatggagaagggccgttgggacgaggccaataccgagaagcagcggctggaggagaagcagcgcctgtcgcggcgccggcggctggaggcctgcgggccgggcagcagctgcagctcggaggaagagaaggaggcggatgcctacacgccactgtggtttgagaagaggctggatccgctgaccggggagatggcctgtgtgtacaagggcggctactgggaggccaaggagaagcaagactggcatatgtgccccaacatcttctgagcgccacccttgcaacaaatacaggcgcctgcacagcctggcccacctgttcattaatgcactcaatttagtactgaatggtctttctcccagcccattcccagcccttcctatttcctttcctattttttttttctccccacactttcttgggactcccaccttggaaggaggaagggctgacctgggttctctccagcccccaggtgcgccgg

SEQ ID NO: 21310 - DNA, 2470 bp, Homo sapiens
gagtgtccgccgcctccgccgggcggcccaccgagctgtgcacgcgtccgtgcaagcccccgggacccggcgccatgtagcgccccgccgattggaggctgccccgccgcgggaaatgaagggacgcggctgctgggacacggcctccgtgcgctccttctgcagctccggctgcctgaataaatttaagaaggatgactctggggacgacgacgaggctaccaccccagccgacaagagcgagctgcaccacaccctgaagaatctttccctgaagttagatgacctcagcacgtgcaatgacctcatcgccaagcacggcgctgcactccagcgctccctgacagagctggacggcctcaagatcccatctgagagtggggagaagctgaaggtggtgaatgagcgggccaccctcttccgcatcacatccaatgctatgatcaacgcctgcagggacttcttggaactagcagagatacacagtcggaaatggcagcgggcactgcagtatgagcaggagcagcgcgtgcacttggaggaaaccattgagcagctggcgaagcagcacaacagcctcgagcgggccttccacagtgcccctggccggccggccaacccctccaagagcttcattgagggaagcctcttgactcccaaaggagaggacagtgaggaagatgaagataccgagtactttgatgccatggaagactccacatccttcatcaccgtgatcaccgaggccaaggaagacagcagaaaagctgaaggtagcaccgggacaagttccgtggactggagctcagcagacaatgtactagatggtgcctcgctcgtgcccaagggttcatccaaagtcaagaggcgagtccgcattcccaacaagcccaactacagccttaacctctggagcatcatgaagaactgcatcggccgggagctctccaggatccccatgccggtgaacttcaatgagcccctgtccatgctccagcggctgacagaggacctggagtaccaccacctgctggacaaggcagtgcactgcaccagctcagtggagcagatgtgcctggtggccgccttctctgtgtcctcctactccaccacagtgcaccgcatcgccaagcccttcaaccccatgctgggggagaccttcgagctggaccgcctcgacgacatgggcctgcgctccctctgtgagcaggtgagccaccaccccccctcagctgcgcactacgtgttctccaagcatggctggagcctctggcaggagatcaccatctccagcaagttccggggaaaatacatctccatcatgccgctaggtgccatccacttagaattccaggccagtgggaatcactacgtgtggaggaagagcacctcaactgttcacaacatcatcgtgggcaagctctggatcgaccagtcaggggacatcgagattgtgaaccataagaccaatgaccggtgccagctgaagttcctgccctacagctacttctccaaagaggcagcccggaaggtgacaggagtggtgagtgacagccagggcaaggcccattacgtgctgtccggctcgtgggatgaacaaatggagtgctccaaggtcatgcatagcagtcccagcagccccagctctgacgggaagcagaagacagtgtaccagaccctgtcagccaagctgctgtggaagaagtacccgctgccggagaacgcggagaacatgtactacttctcagagctggccctgaccctcaacgagcacgaggagggcgtagcgccaaccgacagccgcctgcggcccgaccagcggctgatggagaagggccgttgggacgaggccaataccgagaagcagcggctggaggagaagcagcgcctgtcgcggcgccggcggctggaggcctgcgggccgggcagcagctgcagctcggaggaagcagagaaggaggcggatgcctacacgccactgtggtttgagaagaggctggatccgctgaccggggagatggcctgtgtgtacaagggcggctactgggaggccaaggagaagcaagactggcatatgtgccccaacatcttctgagcgccacccttgcaacaaatacaggcgcctgcacagcctggcccacctgttcattaatgcactcaatttagtactgaatggtctttctcccagcccattcccagcccttcctatttcctttcctattttttttttctccccacactttcttgggactcccaccttggaaggaggaagggctgacctgggttctctccagcccccaggtgcgccgggtcacccgtgccccttcattatggacctgggccctaccggaacccctgccccagttaccacaactcaggccggctggcccgggccatgggctgcgcaaatcaccagcccccaacccagggaggaactggcccctcctagggagcctcttcgactttttta

SEQ ID NO: 21311 - DNA, 2045 bp, Homo sapiens
agcattctgagaacagcagggccacgccaggcgcctgcctctccccacagcacagccaggatggggcctggagaaggccggcagcagcagaggagaccctgggagtcagggatggacaccaggcctgcagggacttcttggaactagcagagatacacagtcggaaatggcagcgggcactgcagtatgagcaggagcagcgcgtgcacttggaggaaaccattgagcagctggcgaagcagcacaacagcctcgagcgggccttccacagtgcccctggccggccggccaacccctccaagagcttcattgagggaagcctcttgactcccaaaggagaggacagtgaggaagatgaagataccgagtactttgatgccatggaagactccacatccttcatcaccgtgatcaccgaggccaaggaagacagaaaagctgaaggtagcaccgggacaagttccgtggactggagctcagcagacaatgtactagatggtgcctcgctcgtgcccaagggttcatccaaagtcaagaggcgagtccgcattcccaacaagcccaactacagccttaacctctggagcatcatgaagaactgcatcggccgggagctctccaggatccccatgccggtgaacttcaatgagcccctgtccatgctccagcggctgacagaggacctggagtaccaccacctgctggacaaggcagtgcactgcaccagctcagtggagcagatgtgcctggtggccgccttctctgtgtcctcctactccaccacagtgcaccgcatcgccaagcccttcaaccccatgctgggggagaccttcgagctggaccgcctcgacgacatgggcctgcgctccctctgtgagcaggtgagccaccaccccccctcagctgcgcactacgtgttctccaagcatggctggagcctctggcaggagatcaccatctccagcaagttccggggaaaatacatctccatcatgccgctaggtgccatccacttagaattccaggccagtgggaatcactacgtgtggaggaagagcacctcaactgttcacaacatcatcgtgggcaagctctggatcgaccagtcaggggacatcgagattgtgaaccataagaccaatgaccggtgccagctgaagttcctgccctacagctacttctccaaagaggcagcccggaaggtgacaggagtggtgagtgacagccagggcaaggcccattacgtgctgtccggctcgtgggatgaacaaatggagtgctccaaggtcatgcatagcagtcccagcagccccagctctgacgggaagcagaagacagtgtaccagaccctgtcagccaagctgctgtggaagaagtacccgctgccggagaacgcggagaacatgtactacttctcagagctggccctgaccctcaacgagcacgaggagggcgtagcgccaaccgacagccgcctgcggcccgaccagcggctgatggagaagggccgttgggacgaggccaataccgagaagcagcggctggaggagaagcagcgcctgtcgcggcgccggcggctggaggcctgcgggccgggcagcagctgcagctcggaggaagagaaggaggcggatgcctacacgccactgtggtttgagaagaggctggatccgctgaccggggagatggcctgtgtgtacaagggcggctactgggaggccaaggagaagcaagactggcatatgtgccccaacatcttctgagcgccacccttgcaacaaatacaggcgcctgcacagcctggcccacctgttcattaatgcactcaatttagtactgaatggtctttctcccagcccattcccagcccttcctatttcctttcctattttttttttctccccacactttcttgggactcccaccttggaaggaggaagggctgacctgggttctctccagcccccaggtgcgccgggtcacccgtgccccttcattatggacctgggccctaccggaacccctgccccagttaccacaactca

SEQ ID NO: 21312 - DNA, 6600 bp, Homo sapiens
catttcccggggatttggagcaggcacgcgcggcccgggcgtccggagctgtagcagcagcagcagccgccgtgccggggccgccaccgcggcgggcacccgcgtcccgggcgcccacggaccatggagagggcagtccagggcacagacggcggcgggggtagcaacagcagcagccgcagcagcagccgtgctacctcggcgggctcctcgccctcctgctctctggcgggccggggggtctccagccggtcggcggcggccgggctcggcggcgggggaagccgcagcagcccgggctctgtggccgctagcccgtccgggggaggcggccgcaggagggagccggcgctcgagggcgtgctcagcaaatacaccaacctcctccagggctggcagaacaggtacttcgtactggatttcgaggctggcatcctgcagtattttgtgaatgagcaaagcaaacaccagaagcctcgaggagtcctgtctttatctggagccatagtgtccctgagcgatgaagctccccacatgctggtggtgtactctgctaatggagagatgtttaaactgagagctgctgatgcaaaagagaaacaattctgggtgactcagcttcgagcttgtgccaaataccacatggaaatgaattctaagagtgctccaagctcccgaagccgaagtctcactttgctcccacatggaacacccaattctgcgtctccctgtagccagagacacctcagtgtgggggcccccggtgttgtcacaatcacgcatcacaagtcgcctgcagccgcccgaagagccaagagtcagtattccggccagcttcacgaagtcagagagatgatgaaccaggtggaagggcagcagaagaaccttgtgcacgccattgagtccctgccagggtccggccccctcactgccttggaccaggacctgctgctcctgaaagctacctctgctgccaccctcagctgccttggggagtgcctcaacttgttacagcagagtgtgcaccaggcgggccagcccagccagaagccaggagcctcggaaaacatcctgggatggcacgggtccaagtcacattccacagagcagctgaaaaatgggacacttggctctttgccatcagccagtgccaacataacctgggcaattttaccaaactctgctgaagacgaacaaacctcacagccagagccagagccaaactcaggctctgaattggttttgtctgaagatgaaaaaagtgacaatgaagataaggaagagacggaattgggcgtcatggaggatcagcgtagtataattcttcatctcatttcacaactcaaacttggaatggatttgaccaaggtggtgcttcccacctttatcctggagaagcgatctttgctggagatgtatgcagatttcatggcgcacccagacctactgctggccatcaccgctggggccacaccagaggagagagtcatttgcttcgttgagtattatctcacagcctttcacgagggccgcaagggcgctttagccaagaagccctacaaccccatcataggcgagacatttcactgctcctgggaagttcccaaggacagggtcaagcctaagaggactgcttcccgctctcctgccagctgtcacgaacacccaatggccgatgacccttccaaaagctacaaactaaggtttgtggctgagcaagtgtcccatcacccacccatctcctgcttctactgtgagtgcgaggagaagagactgtgcgtcaacactcatgtatggaccaaaagcaagttcatgggcatgtccgtgggggtctctatgataggggaaggtgtgttgaggctcctggaacacggggaggagtacgtattcaccctgcctagtgcctacgcccggtccattctcaccatcccgtgggtggagctcggaggaaaagtcagcatcaactgtgccaagactgggtactcagcgacagtgatattccacacgaagcctttctatggagggaaagtccacagggttaccgcagaagtgaagcacaacccaaccaacaccattgtttgtaaagcccatggggaatggaatggtactttagagttcacctacaacaatggagaaaccaaagtcatcgacacaaccacactgccagtgtatcccaagaagatcagacctcttgagaagcagggacccatggagtccaggaacctctggcgggaggtgacccgatacctgcggctgggggacattgacgcagccaccgagcagaagcggcacctggaggagaagcaacgggtggaggaacggaagcgcgagaacctccgcacaccatggaagcccaaatattttatccaggagggcgatggctgggtatacttcaatcccctctggaaagcacactgatggggtggaggtgcagagctttccagtatagccctgtttttgtaggaatattaaagtagtagagtatcagggttttgttggcattcactgagaccttgtattagcatccaagaaatgatgagagagagagaaattatatactatgaaaagtgcacccccacactctgctagaggaatgaatttattcaagagccattcggggcacgtgtgtgtacacaccgtatacgttcacacacatgcactatgtaaacatctgagtatgattacacatttaaatactgcactcaccaaggttaaagtgggtaatcataagctcctttttatcaatgaagtttgaagtttttctatttttcactttgccaaaaatgttttacactcacaaagatattctcacttagtcaactcctgtcaaaatgaaggtgaactggcatggcccgatcactgtccataagggagaaagtggctcattcctggtagaagtatgggtggttatcatttcaaaattattgtgattctcacctccctccccacctcagtgttttgtctgtccgcgcccaagaaagataagcaagtatttcctgctggatgggggttggcaggaagctgttaaagatttatgccagagccttgcaggatggagcacctctgggacaactaagagccaaggcccaccaaggagttttccacccgtctctcatggtcacagcgctagtcattcatttttgagaagttgcttcttttacatcagaaaaccagtcaatcatatggagacttcttttgtgatgaaaaagggctttagaagttaaatacatgcatgcacatgaaaacatgcacaaccacagcctcaatcttgtatttagtttggggaaagagaagagaatttcctgtggattattttttcctcaagtgcacctctctggttaacccaaactctgcaagaaagcactgtgactaaaacatacataacgcctgcataaatattccatggtttcagttaaatttcagtttttagcctttacacatgaggtcaaaggagtgacgaaaatacaaagcaaggaaaaaatgaaatatctggtttttgctgaatgcttaatttattttttactgtgccactccaatatttatcaaatccaaatagcatgaatgcttctctgtagtaatactaattttgtgccttttgtctgctttcttaagaccagttgttcacactttgtagatattagacaaatatatttcgattgaatacatatctgtgtctgtgttttattttcagggattcaacagttctattaaattggtggctctaagtgagctcaacttttcctggttaaatatttctagttattgatatgaagagcaatcatatctatatggaaaaagtatttaacacatttaaaaatgtaccagataaacatttatgaatattttctggtaagtccataagaacatttaactcctacccagtgagtgttgtttcacgagaagagtcactgccagaagtcacaatagaagcctacttaggtccacagtctttaaagcatctgggtgaatcaagtatctggaaccatcttatttctgacagagaaagtggaacaaatgctattttgagaaaaagaagaaaactcaactcaatgagactgaaaagtaatcactgtgttgttggattttccagtctgactacaaagcataaaccatctgggaagtaaaacatggagagggctcacttttcttttgaggccaggggtacatttaaaattgtgaaatgttatgtgtcaggagatttacataaaacatatgtactccaggaataattataaatacccttgtagccactgcttaagcaaagaaacctgtttaccagtaccttaaaagccactattgtgcccctatacaattgtatccctctccatgccttcctggaataaccatccccttatgggttttttgttgttcttttagactatacacactatgtgtgtatttctaaacagtgtgattggttttacccatttttgtaaaaattgaatcataccctagtttgcctatttgagccaatattttctttctagttcaatccttgttgctctatttgttcattttcttgctgagttcatattatgttttattgtggtaaaatatatgtaacaaaatctaccattttaactattttttttttcccagatggagtctcactctgtcacccaggctggagtgcaatggcgcgcaatctctgctcactgcaacctctgccttccgggttcaagcgattctcctgcttcagcctcccgagtagctgggattacaggcgtgtgccaccatgcccagctaatttttgtatttttagtagagatggggtttcaccatgttggccaggctggtctcaaactcctgacctcaggtgattcacccacctgagcctcccaaagtgctgggattacaggtgtgagccactgtgcccagcctggcattttaaaaatatactgagaagtggaattgctatatcatatgaaaattctggtttaagttttaaggaattgccacacagtttctcacaagagctggctgccacattttgcaatgccactagcaatgcacaagggatccaatttctccacatcctcaccaatacctattattttgtttttacttttgttgtttctttaaccccatcctaatggctatgaagtgccatctcaatgtggttttgatttatatttccctaatgattagtgatgttgagcatgtgtttttgtggttttggccatttgtaaatctttggagaaatgtttattcaaatccttttgcccattttaaaattaggttctttttgttgagttttaggagtcctttatgggtattaatcctttctggatattaatcctttatcagatatgatgtgcaaatattttcttctgactctttggttgcctcttcactgttaatggtgtcctctgatgtacaaaagtatttaattttgataatgtctaatttatttttctttgtacttgtgcttttgatgtcatatccaagaaatcattgacaaatacaatgctgtgaagtttttgtcctatgatttcttctaagagttttatagttttaggtcttactggggggtagggggtactttgatccattttgagttggtttttatatatggtgttagataagggtccaacttcattcttttgcatgtggatatccagtttccccaacaccatttgttgaaaagactctgcattccccattgagtgatcttggtaccttgttgaaaatcactggctatatacacgaatgtttatttatggcctattcttttccaatggtcgatgtcagtctttatgccagtaccacactcttttagttactgtagctttgtagcaagttacaagattaggaagtatgagacctccaacttttttattcttttttcaatattgtttcgtctgtacagggtcatttaagattccatgtgaattttaggatgaaattttctatttttgcaaaaaactctgggattttgatagggattgcattgaatctgtagatccctttgagtagcattgtcttaacagtaagtcttccaatctgttaaccagaatatctttccatttatttatctgtcttaatttctttcagcatgttttgtagttttcactgggcaagtcttcctcagttaagtttaattcttaagtattttactctttttggtactactgtaagtagatctttctcagtttcctttttggattgttcaatgttggcatataaaagtgtaagtgccaggcacagtgtcacatgcctatagttccagctactcaggaggctgagacaggaggattgcttgggcccaggagtttgagatttcagcatgctatgattgctcctgtgaatagccactgcactccagcctgggcaacataacaagacctcatttcgtaaaaaacacataatactgatttttgtgcattggttttgtatcctttgctgaatttgtttattctaacagttttttggggggtgtgtgggatctaggattttctagatacaatcatgtcatttgctaacagattttacttcttccaaatttggatgtcttttatttcttgttcttgcctaattgctgtacctagaacttcaaatactgtgttgaaggaaggaggcaaaaaaaaaaaaaaaaaaaaa

SEQ ID NO: 21313 - DNA, 2624 bp, Homo sapiens
tttcccggggatttggagcaggcacgcgcggcccgggcgtccggagctgtagcagcagcagcagccgccgtgccggggccgccaccgcggcgggcacccgcgtcccgggcgcccacggaccatggagagggcagtccagggcacagacggcggcgggggtagcaacagcagcagccgcagcagcagccgtgctacctcggcgggctcctcgccctcctgctctctggcgggccggggggtctccagccggtcggcggcggccgggctcggcggcgggggaagccgcagcagcccgggctctgtggccgctagcccgtccgggggaggcggccgcaggagggagccggcgctcgagggcgtgctcagcaaatacaccaacctcctccagggctggcagaacaggtacttcgtactggatttcgaggctggcatcctgcagtattttgtgaatgagcaaagcaaacaccagaagcctcgaggagtcctgtctttatctggagccatagtgtccctgagcgatgaagctccccacatgctggtggtgtactctgctaatggagagatgtttaaactgagagctgctgatgcaaaagagaaacaattctgggtgactcagcttcgagcttgtgccaaataccacatggaaatgaattctaagatgatgaaccaggtggaagggcagcagaagaaccttgtgcacgccattgagtccctgccagggtccggccccctcactgccttggaccaggacctgctgctcctgaaagctacctctgctgccaccctcagctgccttggggagtgcctcaacttgttacagcagagtgtgcaccaggcgggccagcccagccagaagccaggagcctcggaaaacatcctgggatggcacgggtccaagtcacattccacagagcagctgaaaaatgggacacttggctctttgccatcagccagtgccaacataacctgggcaattttaccaaactctgctgaagacgaacaaacctcacagccagagccagagccaaactcaggctctgaattggttttgtctgaagatgaaaaaagtgacaatgaagataaggaagagacggaattgggcgtcatggaggatcagcgtagtataattcttcatctcatttcacaactcaaacttggaatggatttgaccaaggtggtgcttcccacctttatcctggagaagcgatctttgctggagatgtatgcagatttcatggcgcacccagacctactgctggccatcaccgctggggccacaccagaggagagagtcatttgcttcgttgagtattatctcacagcctttcacgagggccgcaagggcgctttagccaagaagccctacaaccccatcataggcgagacatttcactgctcctgggaagttcccaaggacagggtcaagcctaagaggactgcttcccgctctcctgccagctgtcacgaacacccaatggccgatgacccttccaaaagctacaaactaaggtttgtggctgagcaagtgtcccatcacccacccatctcctgcttctactgtgagtgcgaggagaagagactgtgcgtcaacactcatgtatggaccaaaagcaagttcatgggcatgtccgtgggggtctctatgataggggaaggtgtgttgaggctcctggaacacggggaggagtacgtattcaccctgcctagtgcctacgcccggtccattctcaccatcccgtgggtggagctcggaggaaaagtcagcatcaactgtgccaagactgggtactcagcgacagtgatattccacacgaagcctttctatggagggaaagtccacagggttaccgcagaagtgaagcacaacccaaccaacaccattgtttgtaaagcccatggggaatggaatggtactttagagttcacctacaacaatggagaaaccaaagtcatcgacacaaccacactgccagtgtatcccaagaagatcagacctcttgagaagcagggacccatggagtccaggaacctctggcgggaggtgacccgatacctgcggctgggggacattgacgcagccaccgagcagaagcggcacctggaggagaagcaacgggtggaggaacggaagcgcgagaacctccgcacaccatggaagcccaaatattttatccaggagggcgatggctgggtatacttcaatcccctctggaaagcacactgatggggtggaggtgcagagctttccagtatagccctgtttttgtaggaatattaaagtagtagagtatcagggttttgttggcattcactgagaccttgtattagcatccaagaaatgatgagagagagagaaattatatactatgaaaagtgcacccccacactctgctagaggaatgaatttattcaagagccattcggggcacgtgtgtgtacacaccgtatacgttcacacacatgcactatgtaaacatctgagtatgattacacatttaaatactgcactcaccaaggttaaagtgggtaatcataagctcctttttatcaatgaagtttgaagtttttctatttttcactttgccaaaaatgttttacactcacaaagatattctcacttagtc

SEQ ID NO: 21314 - DNA, 4191 bp, Homo sapiens
cacttaagtcttctcgccggatgctttttcctccttgcttttgccggaaaggagagagatacatgtgaaggatatctgtcctcgttgcttcccctgccctctcaaaagtttaacttctgtgggaatgtgtatcttccttttctggaccatttgacagtcccgccccagccgccgtgtgatttagcaaccggtatcatattcagatcaaatcttaaaaaaaaaaagtcacctacagaactacagaattgttctctcccgctcaagaagggcaagtggactttggcgttaagatgcaggggggtgaaccagtgtccacaatgaaagtctcggagagcgaaggaaagctggagggccaggccacagcggtgaccccgaacaagaacagcagctgtggaggtggaatcagtagcagcagcagcagccgcggtggcagtgcaaaaggctggcagtacagtgatcacatggaaaatgtgtatggctatttaatgaagtataccaaccttgtcactgggtggcagtacaggttttttgttttaaacaatgaagctgggctgttggagtactttgtgaatgaacagtctagaaatcagaaacctagaggaactttgcagcttgcaggagctgtaatatcacccagtgatgaggattctcacaccttcactgtaaacgctgccagtggggaacaatataaactcagagctacagatgcaaaagagcgacagcactgggttagcagacttcagatatgtacacagcatcatactgaagctattggaaagaataatcctcctctgaagtcacggagcttctcacttgcatctagtagtaattctcctatatcgcagaggagaccaagtcaaaatgccatttctttttttaatgttggacattccaaactgcaatcactgagcaaaagaactaatttacctccagaccatcttgtggaagtcagagaaatgatgtctcatgctgaaggacaacaaagagacttaattagacgaattgaatgccttcctacttctggccatcttagttccttggaccaggatctcttaatgctcaaagctacttccatggcaactatgaactgcttaaatgactgctttcatattctccagttacagcatgcatcacatcagaagggctcattgccttcaggaacgacaatcgagtggttagaaccaaagatatctttatcaaaccactataaaaatggagctgaccagccctttgcaactgatcagagtaagccggtggcagtcccagaagagcagcctgttgcagaatctggactattagcgagggagcctgaagaaataaatgcagatgatgagatagaggatacatgtgaccacaaagaggatgacctgggagctgtagaagaacaacgtagtgtcatcctacatctcttgtcacagcttaagctgggcatggatttaacaagagtggtgcttcctacatttatcctagagaagcgttccttgctggaaatgtatgcagactttatgtctcatccagacctatttatagccatcactaatggagccacagctgaggacagaatgattcgctttgttgagtactaccttacctcatttcatgaaggccgtaagggagccattgctaaaaaaccatacaatcctatcattggagaaacatttcactgttcctggaagatgccaaaaagcgaggtagcatccagtgtttttagcagttcttccacccagggagtcacaaatcatgctcctttatcgggggagtctttgacccaggtgggatcagactgttacacagtcagatttgttgctgagcaggtttctcatcatcctccagtctcaggattttatgcagaatgtacagagaggaagatgtgtgtaaatgcgcatgtctggactaagagcaagttcttaggcatgtcaataggcgtgacaatggttggagaaggtatccttagtctgttggagcatggagaagagtacacattttctctaccctgtgcatatgctcggtcaattttgactgttccttgggtagaactgggtggcaaagtcagtgtcaactgtgcaaaaactggatattcagccagcatcacttttcataccaagccattttatggtggcaaactgcatcgggttacagctgaagtaaagcacaacatcaccaacactgtggtatgcagagtgcaaggggaatggaatagtgttcttgagttcacatatagcaatggagagacaaagtatgtggacttgactaaattggcagtgacgaagaaaagagtgagacctctggagaagcaggatccatttgaatccaggcgattgtggaaaaatgtgacagactcgctgagagaatctgaaattgataaggccacagagcataagcataccctggaagaacgtcagaggactgaagaaaggcatcgtactgaaacaggcacaccttggaaaaccaaatattttattaaagagggagatggctgggtttatcataaaccactttggaaaataattccaacaacacaaccagcagagtgacacatactatctaaaactcgaccaaatgaggttcttctctgtttaccctaaatcctcccagaatggagtcattgcactgagtgacctgcttcctgattgcgcagactgaaactagctaaacctgaatgtacctactagggcaccataatactgcagcaagaccaaagtggtaaagaaacacagtggaccttttaccaacctgttcatgtgatgtgagcaataccatcttaaaacttgttacctgaatcagtagatgaatcttttatccagttcttgctcctaaagttaagtttgaatcccctatttttgcacaggggcagcagatacacacaacaatgagaactcagtgactttgatttctttgtagtgaaaagtgaagtctccgtttcagagtttgtgtctttctttctgtccataactgaagtattcactactcttgtaaaccaaccaagaggaggagaaagatgacccagaagtggattcagccattgtgcctgaaatcagtgtttaaaaaaaaaaatcaaccaggttgtggtaacaaggcattctatttcttcaaaaagactgtatgcctgtgtctgaggaacttacctattatccacctctgttggaactctcttttaaaaagtacatttatagattgatcagaattataaccatggagaattttttcttctgagcattttaatatacttgaaaacaacattgacttgaaaaatttcagaacatttttcagtacctagttttattaaatattacacttgagagacactttttaaaaatgtgttaatgtcaatatgatgagattttagcctttctccagaactaaggcattaaagaaaatagcaaatattaaaaaataaaactgttacttttttccttctttcttttcacctttaggttaatatccagtattatgtgttatccctttggataagtatgctttattttacctctgttaaaaattaaaataaatgattctattcatatttgtcagtaattcaaaacttatatgtgtaactgaacgcgcatgtaaggtatggttttatttattttttttttttttgaggaaatttaaatgctaaagaaacaacgaaatgaaaaggtatcaggaaaaaaagatcaggaagttgtattcaggtacaaatctttttttaaataagtattttgttgaggttgaagaattgctggcaattaaaagaatagagctaattatggctttcatcattcattcatgtatttattgagcacctacttattatggtgctcaacacttgttactgcaagctaccttaatttcccaagagtggtgccttactctgttttttctgatatggtcttccaatcagtgtgtgtaacatacctgttgtttatcagccattgtaggtggctgtgtctgttgcatcatcataagaagtttaagctttgtgctctgataaattgtgttctgttaaagaggttagtaggatgaaaacagcaaaacaataattttttcaacaaattgtaaattataagaaaaagagttggtttgtgtacaacaattttaatgattcccttgttcatttttgctgtgaaatgcactgaaaaaaatcctcaaaatgagttatagttcctgtgttgggaaaattgacaaataataaaactagagaacaaacaa

SEQ ID NO: 21315 - DNA, 4195 bp, Homo sapiens
ctgcggggaggggcggcgccacctcgcgctccgccgtggtcccggcgccgggtcccggagacagacgttacgcgggctcgagcgtcctcggggagtgccagccagagttggtgacgaccacttcctcgacgtggggcgggcggacgggaagcctggggtcgtggccaccgcctcgggagctctgggagcccgggtgaccgcgtagaaatgaacacagaagcggagcaacagcttctccatcacgccagaaatggcaatgctgaagaagtaagacaactattagagaccatggcgaggaatgaagtgattgctgacattaattgcaaaggaagaagtaagtctaacttgggctggacacctctacatctggcatgctattttggacacagacaagtggtccaggatctgttgaaggctggtgcagaagtgaatgtgttgaatgacatgggagacacgccgcttcatcgagctgcctttacaggacgaaaggagttggtaatgcttctcttagaatataatgctgatactactattgttaatgggagtggacagacagcaaaagaagttactcatgctgaagaaatcagaagcatgcttgaagctgtagaaaggactcaacaaagaaagcttgaagaattacttttagcagcagcaagagaaggcaaaacaacagaactcacagctctgctcaacaggcccaatcctcctgatgttaactgttcggatcagttaggaaatacacccttgcattgtgcagcttaccgggcccataaacaatgtgccttaaagcttctaagaagtggagcagaccctaatctgaagaacaaaaatgatcagaaacctcttgaccttgcccagggtgctgaaatgaaacacattcttgttggtaataaggtcatctacaaagcattgaaacgatatgagggccctctctggaagagttcaagattttttggctggagattattctgggtagtgttagagcatggagtcctttcatggtataggaaacagcctgatgcagttcataatatttatcgccagggatgcaaacacctgactcaagcagtatgcacggtaaaatccactgatagctgcctcttctttattaaatgctttgatgacaccattcatggcttccgggttcctaagaatagccttcagcagtcaagagaggactggctggaagcaatagaagaacattctgcttacagcactcactactgttcccaggaccagctgactgatgaggaggaggaagatacggtttctgctgcagacctgaagaaatcattagagaaagcacagtcatgccaacagcgactagatagggaaatttccaactttctcaaaatgattaaggagtgtgacatggctaaagaaatgcttccatcatttcttcagaaagttgaagttgtctcagaagcttctagagaaacttgtgtagctttgactgattgccttaatctcttcaccaaacaagaaggggtgaggaattttaaattggaacaagagcaagaaaaaaacaaaatcttgtcagaagcactggagacgctggccactgaacatcatgaattagagcagtctctggtgaaaggctctccacccgccagcatccttagcgaggacgagttctatgatgcgctgtcagattccgagtccgaaaggtccctgagtagattggaagcagtgacagcacgctcctttgaagaggaaggagagcatttgggcagtagaaaacacagaatgtccgaagaaaaagactgtggtggcggagatgctctctccaatggcatcaagaaacacagaacaagtttgccttctcctatgttttccagaaatgacttcagtatctggagcatcctcagaaaatgtattggaatggaactatccaagatcacgatgccagttatatttaatgagcctctgagcttcctacagcgcctaactgaatacatggagcatacttacctcatccacaaggccagttcactctctgatcctgtggaaaggatgcagtgtgtagctgcgtttgctgtatctgctgttgcttctcagtgggaacggactggaaaacctttcaacccactgctgggagagacttatgaattagtgcgagatgaccttggatttagactcatctccgaacaggtcagccatcacccaccaatcagtgcatttcatgctgaaggattaaacaatgacttcatctttcatggctctatctatcccaaactgaaattctgggggaagagtgtagaagcagaacccaaaggaaccatcaccttggagctccttgaacacaatgaggcatatacatggacaaatcccacctgctgtgtgcataatatcattgtgggtaaactgtggatcgaacagtatggcaatgtggaaattataaaccacaagactggggacaaatgtgtgttgaattttaagccatgtggcctttttggtaaggaattacacaaagttgaaggctacattcaagataaaagcaaaaagaagctctgtgccctctatgggaagtggactgaatgtttatacagtgttgaccctgccacgtttgacgcttacaaaaaaaatgataagaaaaatacagaagagaagaagaacagcaaacagatgagcacctctgaggagttggatgaaatgccagtgccggattctgaaagtgtattcattatccctggaagcgttcttctatggcgaatagccccacggcctccaaattctgcccagatgtataattttactagttttgcaatggttttgaatgaagtagacaaagacatggagagtgtgattcccaagacagactgcaggttacggcctgacatcagagccatggaaaatggagagatagatcaagctagtgaagaaaaaaaacgacttgaggaaaaacaaagagcagcccgcaaaaacaggtccaagtcagaagaggactggaagacgaggtggttccatcaaggtcctaatccctacaatggagcacaggactggatttactctggcagctactgggacagaaattacttcaatttgcctgacatttattaaaatgcatacaagtcagggtgtttggctaatctacaaataagtcttaaacctatgtttttaaatttttttcccttggtttctacttatcttttaaaaaaaaaaatgaaaaaacactcatgagataactgcatttcacccaacaaaagcagggtataaggcgatattggtgatgaaagtcttaggaaaaatgcataattttgctataaaatgtacttatttggaatactattttatatagaggtaagagaacactgctggggaatatgctttttatggttgctgttgccatatttactgaaggtttatacctaaatgtaactttagctttatggaactatatagtaatcccaaatcaagttattttgaatatttttatgctgtcatgcttgaatgttttagatgtaacctttgacatatttagaactctcctcctatacaatgtttattctcagatatagaggttatgtcattttataaagacttcattgataagatggcttttattcatactaatcctcccaatgttaccccttccatcttccaagaagaaaaaaaatgcctgaatattcagaatagatatttctgatttgaaaattctaaagaattaaactggaaaagtatttcatttacttagtgctctgaatttacttttacagttttctgcagtcagtatcattaaaatggttaagtttacatttgaactgaaaatatgtataaaatctagcaattcacaaaaatgccctagaaatatagattttaatcaccattacataatgacaaaccttgttaaatgcttccacttccagtggcaaatgccactagggaaagtaagttgcactcatgtaagtatcaaactatataaaaggaggccttgtgcatttcaagtttgcaaagtacctgtgtacttaaaatatgtgtggagacctactgtacagtagttttgcccctttaattggggcacattcatcttaaatcttatagtatttatccacccaaaccccagactgagatactgctcccaggggcctaggtagctgccagtccgtgattttaattgctgtcttgaagttaacaagtgttataatgaaataatctacctgatgctaaataaaggctttagaatgttccccaaaag

SEQ ID NO: 21316 - DNA, 1859 bp, Homo sapiens
gaagtcttctgaagtgacaccagtgccttatccctagaggaatatcagcatagaaagcacagtcatgccaacagcgactagatagggaaatttccaactttctcaaaatgattaaggagtgtgacatggctaaagaaatgcttccatcatttcttcagaaagttgaagttgtctcagaagcttctagagaaacttgtgtagctttgactgattgccttaatctcttcaccaaacaagaaggggtgaggaattttaaattggaacaagagcaagaaaaaaacaaaatcttgtcagaagcactggagacgctggccactgaacatcatgaattagagcagtctctggtgaaaggctctccacccgccagcatccttagcgaggacgagttctatgatgcgctgtcagattccgagtccgaaaggtccctgagtagattggaagcagtgacagcacgctcctttgaagaggaaggagagcatttgggcagtagaaaacacagaatgtccgaagaaaaagactgtggtggcggagatgctctctccaatggcatcaagaaacacagaacaagtttgccttctcctatgttttccagaaatgacttcagtatctggagcatcctcagaaaatgtattggaatggaactatccaagatcacgatgccagttatatttaatgagcctctgagcttcctacagcgcctaactgaatacatggagcatacttacctcatccacaaggccagttcactctctgatcctgtggaaaggatgcagtgtgtagctgcgtttgctgtatctgctgttgcttctcagtgggaacggactggaaaacctttcaacccactgctgggagagacttatgaattagtgcgagatgaccttggatttagactcatctccgaacaggtcagccatcacccaccaatcagtgcatttcatgctgaaggattaaacaatgacttcatctttcatggctctatctatcccaaactgaaattctgggggaagagtgtagaagcagaacccaaaggaaccatcaccttggagctccttgaacacaatgaggcatatacatggacaaatcccacctgctgtgtgcataatatcattgtgggtaaactgtggatcgaacagtatggcaatgtggaaattataaaccacaagactggggacaaatgtgtgttgaattttaagccatgtggcctttttggtaaggaattacacaaagttgaaggctacattcaagataaaagcaaaaagaagctctgtgccctctatgggaagtggactgaatgtttatacagtgttgaccctgccacgtttgacgcttacaaaaaaaatgataagaaaaatacagaagagaagaagaacagcaaacagatgagcacctctgaggagttggatgaaatgccagtgccggattctgaaagtgtattcattatccctggaagcgttcttctatggcgaatagccccacggcctccaaattctgcccagatgtataattttactagttttgcaatggttttgaatgaagtagacaaagacatggagagtgtgattcccaagacagactgcaggttacggcctgacatcagagccatggaaaatggagagatagatcaagctagtgaagaaaaaaaacgacttgaggaaaaacaaagagcagcccgcaaaaacaggtccaagtcagaagaggactggaagacgaggtggttccatcaaggtcctaatccctacaatggagcacaggactggatttactctggcagctactgggacagaaattacttcaatttgcctgacatttattaaaatgcatacaagtcagggtgtttggctaatctacaaataagtctt

SEQ ID NO: 21317 - DNA, 1886 bp, Homo sapiens
gcgggctcgagcgtcctcggggagtgccagccagagttggtgacgaccacttcctcgacgtggggcgggcggacgggaagcctggggtcgtggccaccgcctcgggagctctgggagcccgggtgaccgcgtaggtcagtttctcgcggctgtccacgcctggagttcgaggccggttcccgcgctgacgggttcccgccgggctgcgctcgggagaaatgaacacagaagcggagcaacagcttctccatcacgccagaaatggcaatgctgaagaagtaagacaactattagagaccatggcgaggaatgaagtgattgctgacattaattgcaaaggaagaagtaagtctaacttgggctggacacctctacatctggcatgctattttggacacagacaagtggtccaggatctgttgaaggctggtgcagaagtgaatgtgttgaatgacatgggagacacgccgcttcatcgagctgcctttacaggacgaaagatctgttctcagggaagctgagatggagatgagtgggcagcaggtttatggagtgctcgtggcatcacacctgtgcacgagggtggggaagaagtggacaggagtggacaagtcaagtagtgctgccggctcaagcgatgcctcagcctttctgctgtgtgcgaagctttgcagaggagatgatgcttcaaagttgtccctgttggggatgagcagccaggcctttatacactgggacagtcagtcatggatacgtggatactctggaaaccctcatccctggaggtctgagcccctggataccatgcccttcttaggctggagttgctgcccttgtccatttaccataaaaattggacaagagaataccaggacacacctgagtttctcatcgtatgctaaacctgttcttccacgtacatccccaatgtgtacagccctacttttttctgctgatcaagttcaattacttctgctaagatggtgactattcttgcctgctggtccttggatgcaaggaccccaatgttcaggcagcctttggtgccttctagcatacgaatcagagcattatctttaggtgtggaataagctgccccaaaacctgttgaagccaaccaggcactgtgctcccttctgttatgggaagtgcaagatgcagtaatttattcttctgaggaagtgtcttgtcattgcccagaccagtgaacttctaaaaatttactgacatggaaaagctcctgaattcttcctaagttttacctcccacccactggatcagatatgtcttaccaaggctttgaacatcctagcctcgtggagaagaagcctcttctcctggttctgttagcatgatgttatgaaaggaaattaaattttgggaccccaaactcattttgccaaagggaaaaatcaagctgagaactgggtcatgcaaacctgcctcccccttttggttcctaaataaggtggctacaagaggaaaagctacatgcctcccccatattttgctcacaaggaaattcctagtgagcaatgcaaagtgatagcttatctttacaggtgcagtcacccaggcccaccacacgcaaatgcatatctaattgttcccctgccccattttgtctgtgttatgtagaatgcagattccctacgtttttcttctgccccgtttatgtcatcttatgtaaaaacatgcagattcatggagccagacaaaggcatgactatcttttcccacccacccccttacctgaaaattgtgtacttctcaatatcctgccctttcccctttaaatttgaagccctcaaaaatcatcttcagagaaagatgtctgtctcctgggtgcgtgtccttaactttggcaaataaatctaaaatgattg

SEQ ID NO: 21318 - DNA, 3318 bp, Homo sapiens
ccagggccggtgtctccaggagagggccgagcgcacagcagctctaggacctcgcaggcgcctcggcgcggcactcacgtagagcccaaggagcagtccccgacctctcctcggagggccgtgcaggcttccccggcggtccctacctgcgcctccgcccgccagcggcgctggggaaggggaggagcggcccggacgctgcccgccgcgcgcagggagccgcccgccgcaggccttgccgccgcccgcccgcgctctccccgcgagccccggagggcgggtctgcggccgagccagcggcggcggaggggcagcgcagacctctgcggcccgggcgggcgcggcgcgggagtcctgggccgctggcgggcaacgcctctgcccgacctcgctggggaaggctggcgctgctgcccggccggagccaggggcaggctgcgcaaaggtgacttagggagaccttgcgggccgccctgggtcgcgcctcccggatcggctcgcctcggctcgactggaggggaggaggaggagcaggccgagcgcattcgcgctggagcttgcgaggagcgcagggtggagcgcgccagccggggtcctcggatctggcccaggtgaggaattttaaattggaacaagagcaagaaaaaaacaaaatcttgtcagaagcactggagacgctggccactgaacatcatgaattagagcagtctctggtgaaaggctctccacccgccagcatccttagcgaggacgagttctatgatgcgctgtcagattccgagtccgaaaggtccctgagtagattggaagcagtgacagcacgctcctttgaagaggaaggagagcatttgggcagtagaaaacacagaatgtccgaagaaaaagactgtggtggcggagatgctctctccaatggcatcaagaaacacagaacaagtttgccttctcctatgttttccagaaatgacttcagtatctggagcatcctcagaaaatgtattggaatggaactatccaagatcacgatgccagttatatttaatgagcctctgagcttcctacagcgcctaactgaatacatggagcatacttacctcatccacaaggccagttcactctctgatcctgtggaaaggatgcagtgtgtagctgcgtttgctgtatctgctgttgcttctcagtgggaacggactggaaaacctttcaacccactgctgggagagacttatgaattagtgcgagatgaccttggatttagactcatctccgaacaggtcagccatcacccaccaatcagtgcatttcatgctgaaggattaaacaatgacttcatctttcatggctctatctatcccaaactgaaattctgggggaagagtgtagaagcagaacccaaaggaaccatcaccttggagctccttgaacacaatgaggcatatacatggacaaatcccacctgctgtgtgcataatatcattgtgggtaaactgtggatcgaacagtatggcaatgtggaaattataaaccacaagactggggacaaatgtgtgttgaattttaagccatgtggcctttttggtaaggaattacacaaagttgaaggctacattcaagataaaagcaaaaagaagctctgtgccctctatgggaagtggactgaatgtttatacagtgttgaccctgccacgtttgacgcttacaaaaaaaatgataagaaaaatacagaagagaagaagaacagcaaacagatgagcacctctgaggagttggatgaaatgccagtgccggattctgaaagtgtattcattatccctggaagcgttcttctatggcgaatagccccacggcctccaaattctgcccagatgtataattttactagttttgcaatggttttgaatgaagtagacaaagacatggagagtgtgattcccaagacagactgcaggttacggcctgacatcagagccatggaaaatggagagatagatcaagctagtgaagaaaaaaaacgacttgaggaaaaacaaagagcagcccgcaaaaacaggtccaagtcagaagaggactggaagacgaggtggttccatcaaggtcctaatccctacaatggagcacaggactggatttactctggcagctactgggacagaaattacttcaatttgcctgacatttattaaaatgcatacaagtcagggtgtttggctaatctacaaataagtcttaaacctatgtttttaaatttttttcccttggtttctacttatcttttaaaaaaaaaaatgaaaaaacactcatgagataactgcatttcacccaacaaaagcagggtataaggcgatattggtgatgaaagtcttaggaaaaatgcataattttgctataaaatgtacttatttggaatactattttatatagaggtaagagaacactgctggggaatatgctttttatggttgctgttgccatatttactgaaggtttatacctaaatgtaactttagctttatggaactatatagtaatcccaaatcaagttattttgaatatttttatgctgtcatgcttgaatgttttagatgtaacctttgacatatttagaactctcctcctatacaatgtttattctcagatatagaggttatgtcattttataaagacttcattgataagatggcttttattcatactaatcctcccaatgttaccccttccatcttccaagaagaaaaaaaatgcctgaatattcagaatagatatttctgatttgaaaattctaaagaattaaactggaaaagtatttcatttacttagtgctctgaatttacttttacagttttctgcagtcagtatcattaaaatggttaagtttacatttgaactgaaaatatgtataaaatctagcaattcacaaaaatgccctagaaatatagattttaatcaccattacataatgacaaaccttgttaaatgcttccacttccagtggcaaatgccactagggaaagtaagttgcactcatgtaagtatcaaactatataaaaggaggccttgtgcatttcaagtttgcaaagtacctgtgtacttaaaatatgtgtggagacctactgtacagtagttttgcccctttaattggggcacattcatcttaaatcttatagtatttatccacccaaaccccagactgagatactgctcccaggggcctaggtagctgccagtccgtgattttaattgctgtcttgaagttaacaagtgttataatgaaataatctacctgatgctaaataaaggctttagaatgttccccaaaag

SEQ ID NO: 21319 - DNA, 877 bp, Homo sapiens
gagggacccgcgtccagatcttcagtgtctattggatttttccaagagaaagtttgtaaaattccttacactgtagatgtggatcagatacgatgattcagtagaagagcacatgtcaggggcagtggaggctggctgctgaaggatgaacggagaggaagaattctttgatgccgtcacaggctttgattctgataactcttctggggaattttcagaggcaaatcagaaagtcacgggaatgattgacttagacaccagcaaaaataataggattgggaaaactggggagaggccctctcaagagaacggaattcagaaacacaggacatcgctgccggctcccatgttcagcagaagcgacttcagcgtgtggaccatcctgaagaagtgtgttggcctggagctgtccaagatcacgatgccaatcgccttcaacgagcctctgagcttcttgcagcggatcacggagtacatggagcacgtgtacctcatccacagggcctcctgccagccccagcccctggagaggatgcagtctgtggctgcttttgctgtttcggctgtggcttcccagtgggagaggaccggcaaaccatttaatccactcttgggagaaacgtatgaattaatcagggaagatttaggattcagatttatatcggaacaggtcagtcaccacccccccatcagtgcgttccactcggaaggtctcaaccatgacttcctgttccatggctccatctaccccaagctcaagttctggggcaaaagcgtggaggcggagccccgaggcaccatcaccctggagctgctcaatgtcaaccaaagacacctcagagcaaaacacaagtctccaacaaatgccggccgctaa

SEQ ID NO: 21320 - DNA, 3970 bp, Homo sapiens
agtgggtcgcgggcctacggggcgggggcggggcggcagtgagctcggccggcaaccgagggacccgcgtccagatcttcagtgtctattggatttttccaagagaaagtttgtaaaattccttacactgtagatgtggatcagatacgatgattcagtagaagagcacatgtcaggggcagtggaggctggctgctgaaggatgaacggagaggaagaattctttgatgccgtcacaggctttgattctgataactcttctggggaattttcagaggcaaatcagaaagtcacgggaatgattgacttagacaccagcaaaaataataggattgggaaaactggggagaggccctctcaagagaacggaattcagaaacacaggacatcgctgccggctcccatgttcagcagaagcgacttcagcgtgtggaccatcctgaagaagtgtgttggcctggagctgtccaagatcacgatgccaatcgccttcaacgagcctctgagcttcttgcagcggatcacggagtacatggagcacgtgtacctcatccacagggcctcctgccagccccagcccctggagaggatgcagtctgtggctgcttttgctgtttcggctgtggcttcccagtgggagaggaccggcaaaccatttaatccactcttgggagaaacgtatgaattaatcagggaagatttaggattcagatttatatcggaacaggtcagtcaccacccccccatcagtgcgttccactcggaaggtctcaaccatgacttcctgttccatggctccatctaccccaagctcaagttctggggcaaaagcgtggaggcggagccccgaggcaccatcaccctggagctgctcaaacataatgaagcctacacctggaccaaccccacctgctgcgtccacaacgtcatcatcgggaagctgtggatagagcagtatgggacagtggagattttaaaccacagaactggacataagtgtgtgcttcactttaaaccgtgtggattatttggaaaagaacttcacaaggtggaaggacacattcaagacaaaaacaaaaagaagctctttatgatctatggcaaatggacggaatgtttgtggggcatagatcctgtttcgtatgaatccttcaagaagcaggagaggagaggtgaccacctgagaaaggccaagctggatgaagactccgggaaggctgacagcgacgtggctgacgacgtgcctgtggcccaggagaccgtgcaggtcattcctggcagcaagctgctctggaggatcaacacccggccccccaactctgcccagatgtataatttcaccagtttcactgtgagcctcaacgagctggagacaggcatggagaagaccctgccacccacggactgccgcctgcgccctgacatccgcggcatggagaatggcaacatggatctggccagccaggagaaggagcggctggaggagaagcagagagaagcacggagggagcgggccaaggaggaggcagagtggcagacgaggtggttctacccaggcaataacccctacactgggacccccgactggttgtatgcaggggattactttgagcggaatttctccgactgcccagatatctactgagggcctggaggggcctggggcccgggaccggaggctgacgaggctggacttcctcgagtggccactgtgagcctcgtcacagcagaaaccaacttttctaacgactgagttcgcggagatagcatcatccctgatcaaggatgtaattctaattaactgttgattgccaaacatttcactctgctgtgccgtctcttcataaagcttcacttgggatcatcgtcttcattaaggtttcaacagggaaattcttcacggcgcccttttatgtggcagaaatcagctggggcttgtttagcttccagcacactctcagtcatagcatgtgtagctaaaggaagtaatgggaaggggttcatgttctctttataatgcagtggcaaaaggttctgaaagccttttaaactcgaaccagtgggggaaagatggatcttgaagctaatcctgcagagagttttatagaggccagggattgccttctaaattatgataaaacagaagtgaagagtttcagagcatcagattgagtgaaaagttgtcagattctgtattttttaacaatcttcaataatgtaaagattacttttaaaatatttaagttaaaactacttgaatagtattttgctgaagagcaagatatgcattaatcaccggttttatactgtccaaaatgaagcatccccgtgacaaaccagagtgggcagaagcatcgagagcgtgacaggaaatcccaagactgcttccgcctcagaggcgtcccggctgcgattcgctgccctgttgtcagtgaggcctggctgtcaccgcacaccgcgtccgtgtctccagggggttcctttcttctcacacgtcgcgtgtacccatagcactcttgtgtttctgtttttcccagtatgcatgtttaaaatagaagtgacaagaatcacatccggttgtgtcctgtgggagggtcagaggcagaatctacttacagtggtgtaattaaagttatttaaccaaaaataggtatgtgtccatctcagcattcacctttatcaagtgactgatttttttttcttttctttccttttttttttttttttgagacggagtttcactcttgttgcccaggctggagtgcaatggcatgatctcggctcaccgcaacctccgcctcccgggttcaagcgattctcctgcctcagcctcccaagtagctgggattacaggcacgcgccaccacacctggctgattttgtatttttagtagacacgggttttcaccatgttggtcaggctggtctcaaactcccgacctcaagtagtctgcctgcctcaacctcccaaagtgctgggattacaggcgtgagccactgcgcctggccgtgactgattttttttcatgtagaattgtcaacacgagagatcacagtggagcactttgaaagaccgtcggttgtgtgcacgcacgcacacactcatgcacacgctgacacgcggttgcatggagtccaggttactcaggccggcacttctgagtgacaggtgccacctgcgtgtgtcttggcgtccacatcacacctgtgacggaagcacttctggaagtgaacactcgttttgaaagcttgattttgtagctttggaagctggaagcgatggtgtttggtgccgagtcctgtgtcatcctcggggcctatgagctccgtaccagccactcaaaagtgtctgaacagaaccgctccgtgactggtagctgggtctgaggattcaggattgtggcgttattcaaagaggagactttgaaattccccgatggctggaatgtggagcccaggtgcctctggtggagggtcatctgcttttccagactgtggttgtgaaccggctccttctccaagaaaggttgcaagctgagaacatccagaggtgagactcagacacattgaaagtgactgcatttagggaggtttaacgagttcttactgatcattccacttgttactggttaagataatttgcccacgggtttgtttccaagtcctcttctaggaccaggctcctggtatttcaggggctggttggctgcacagacagcccctcttctgctgtccttgaggacagacaccaaaccagaggtggaggaagaacggtaggaaggctgatggcaaaagcggctgtgtgtcgaggttattttaactttttactactttttgttactgtttctgcaaatgctaacacataaaccatgacctaacttttgtcaccttggatatctattgaatgttaaacatctctaataaagatggccaccacttaatgtgtggaaagtgatggccttctcgtggg

SEQ ID NO: 21321 - DNA, 3934 bp, Homo sapiens
agtgggtcgcgggcctacggggcgggggcggggcggcagtgagctcggccggcaaccgagggacccgcgtccagatcttcagtgtctattggatttttccaagagaaagtttgtaaaattccttacactgtagatgtggatcagatacgatgattcagtagaagagcacatgtcaggggcagtggaggctggctgctgaaggatgaacggagaggaagaattctttgatgccgtcacagaggcaaatcagaaagtcacgggaatgattgacttagacaccagcaaaaataataggattgggaaaactggggagaggccctctcaagagaacggaattcagaaacacaggacatcgctgccggctcccatgttcagcagaagcgacttcagcgtgtggaccatcctgaagaagtgtgttggcctggagctgtccaagatcacgatgccaatcgccttcaacgagcctctgagcttcttgcagcggatcacggagtacatggagcacgtgtacctcatccacagggcctcctgccagccccagcccctggagaggatgcagtctgtggctgcttttgctgtttcggctgtggcttcccagtgggagaggaccggcaaaccatttaatccactcttgggagaaacgtatgaattaatcagggaagatttaggattcagatttatatcggaacaggtcagtcaccacccccccatcagtgcgttccactcggaaggtctcaaccatgacttcctgttccatggctccatctaccccaagctcaagttctggggcaaaagcgtggaggcggagccccgaggcaccatcaccctggagctgctcaaacataatgaagcctacacctggaccaaccccacctgctgcgtccacaacgtcatcatcgggaagctgtggatagagcagtatgggacagtggagattttaaaccacagaactggacataagtgtgtgcttcactttaaaccgtgtggattatttggaaaagaacttcacaaggtggaaggacacattcaagacaaaaacaaaaagaagctctttatgatctatggcaaatggacggaatgtttgtggggcatagatcctgtttcgtatgaatccttcaagaagcaggagaggagaggtgaccacctgagaaaggccaagctggatgaagactccgggaaggctgacagcgacgtggctgacgacgtgcctgtggcccaggagaccgtgcaggtcattcctggcagcaagctgctctggaggatcaacacccggccccccaactctgcccagatgtataatttcaccagtttcactgtgagcctcaacgagctggagacaggcatggagaagaccctgccacccacggactgccgcctgcgccctgacatccgcggcatggagaatggcaacatggatctggccagccaggagaaggagcggctggaggagaagcagagagaagcacggagggagcgggccaaggaggaggcagagtggcagacgaggtggttctacccaggcaataacccctacactgggacccccgactggttgtatgcaggggattactttgagcggaatttctccgactgcccagatatctactgagggcctggaggggcctggggcccgggaccggaggctgacgaggctggacttcctcgagtggccactgtgagcctcgtcacagcagaaaccaacttttctaacgactgagttcgcggagatagcatcatccctgatcaaggatgtaattctaattaactgttgattgccaaacatttcactctgctgtgccgtctcttcataaagcttcacttgggatcatcgtcttcattaaggtttcaacagggaaattcttcacggcgcccttttatgtggcagaaatcagctggggcttgtttagcttccagcacactctcagtcatagcatgtgtagctaaaggaagtaatgggaaggggttcatgttctctttataatgcagtggcaaaaggttctgaaagccttttaaactcgaaccagtgggggaaagatggatcttgaagctaatcctgcagagagttttatagaggccagggattgccttctaaattatgataaaacagaagtgaagagtttcagagcatcagattgagtgaaaagttgtcagattctgtattttttaacaatcttcaataatgtaaagattacttttaaaatatttaagttaaaactacttgaatagtattttgctgaagagcaagatatgcattaatcaccggttttatactgtccaaaatgaagcatccccgtgacaaaccagagtgggcagaagcatcgagagcgtgacaggaaatcccaagactgcttccgcctcagaggcgtcccggctgcgattcgctgccctgttgtcagtgaggcctggctgtcaccgcacaccgcgtccgtgtctccagggggttcctttcttctcacacgtcgcgtgtacccatagcactcttgtgtttctgtttttcccagtatgcatgtttaaaatagaagtgacaagaatcacatccggttgtgtcctgtgggagggtcagaggcagaatctacttacagtggtgtaattaaagttatttaaccaaaaataggtatgtgtccatctcagcattcacctttatcaagtgactgatttttttttcttttctttccttttttttttttttttgagacggagtttcactcttgttgcccaggctggagtgcaatggcatgatctcggctcaccgcaacctccgcctcccgggttcaagcgattctcctgcctcagcctcccaagtagctgggattacaggcacgcgccaccacacctggctgattttgtatttttagtagacacgggttttcaccatgttggtcaggctggtctcaaactcccgacctcaagtagtctgcctgcctcaacctcccaaagtgctgggattacaggcgtgagccactgcgcctggccgtgactgattttttttcatgtagaattgtcaacacgagagatcacagtggagcactttgaaagaccgtcggttgtgtgcacgcacgcacacactcatgcacacgctgacacgcggttgcatggagtccaggttactcaggccggcacttctgagtgacaggtgccacctgcgtgtgtcttggcgtccacatcacacctgtgacggaagcacttctggaagtgaacactcgttttgaaagcttgattttgtagctttggaagctggaagcgatggtgtttggtgccgagtcctgtgtcatcctcggggcctatgagctccgtaccagccactcaaaagtgtctgaacagaaccgctccgtgactggtagctgggtctgaggattcaggattgtggcgttattcaaagaggagactttgaaattccccgatggctggaatgtggagcccaggtgcctctggtggagggtcatctgcttttccagactgtggttgtgaaccggctccttctccaagaaaggttgcaagctgagaacatccagaggtgagactcagacacattgaaagtgactgcatttagggaggtttaacgagttcttactgatcattccacttgttactggttaagataatttgcccacgggtttgtttccaagtcctcttctaggaccaggctcctggtatttcaggggctggttggctgcacagacagcccctcttctgctgtccttgaggacagacaccaaaccagaggtggaggaagaacggtaggaaggctgatggcaaaagcggctgtgtgtcgaggttattttaactttttactactttttgttactgtttctgcaaatgctaacacataaaccatgacctaacttttgtcaccttggatatctattgaatgttaaacatctctaataaagatggccaccacttaatgtgtggaaagtgatggccttctcgtggg

SEQ ID NO: 21322 - DNA, 1780 bp, Homo sapiens
agtgggtcgcgggcctacggggcgggggcggggcggcagtgagctcggccggcaaccgagggacccgcgtccagatcttcagtgtctattggatttttccaagagaaagtttgtaaaattccttacactgtagatgtggatcagatacgatgattcagtagaagagcacatgtcaggggcagtggaggctggctgctgaaggatgaacggagaggaagaattctttgatgccgtcacaggacatcgctgccggctcccatgttcagcagaagcgacttcagcgtgtggaccatcctgaagaagtgtgttggcctgacttacggaaaatcacaaaatagcacagagcattcctgtagacccaccacccagctcccctgatgccggcatctctcggaataaccataggagctgtccaagatcacgatgccaatcgccttcaacgagcctctgagcttcttgcagcggatcacggagtacatggagcacgtgtacctcatccacagggcctcctgccagccccagcccctggagaggatgcagtctgtggctgcttttgctgtttcggctgtggcttcccagtgggagaggaccggcaaaccatttaatccactcttgggagaaacgtatgaattaatcagggaagatttaggattcagatttatatcggaacaggtcagtcaccacccccccatcagtgcgttccactcggaaggtctcaaccatgacttcctgttccatggctccatctaccccaagctcaagttctggggcaaaagcgtggaggcggagccccgaggcaccatcaccctggagctgctcaaacataatgaagcctacacctggaccaaccccacctgctgcgtccacaacgtcatcatcgggaagctgtggatagagcagtatgggacagtggagattttaaaccacagaactggacataagtgtgtgcttcactttaaaccgtgtggattatttggaaaagaacttcacaaggtggaaggacacattcaagacaaaaacaaaaagaagctctttatgatctatggcaaatggacggaatgtttgtggggcatagatcctgtttcgtatgaatccttcaagaagcaggagaggagaggtgaccacctgagaaaggccaagctggatgaagactccgggaaggctgacagcgacgtggctgacgacgtgcctgtggcccaggagaccgtgcaggtcattcctggcagcaagctgctctggaggatcaacacccggccccccaactctgcccagatctggccagccaggagaaggagcggctggaggagaagcagagagaagcacggagggagcgggccaaggaggaggcagagtggcagacgaggtggttctacccaggcaataacccctacactgggacccccgactggttgtatgcaggggattactttgagcggaatttctccgactgcccagatatctactgagggcctggaggggcctggggcccgggaccggaggctgacgaggctggacttcctcgagtggccactgtgagcctcgtcacagcagaaaccaacttttctaacgactgagttcgcggagatagcatcatccctgatcaaggatgtaattctaattaactgttgattgccaaacatttcactctgctgtgccgtctcttcataaagcttcacttgggatcatcgtcttcattaaggtttcaacagggaaattcttcacggcgcccttttatgtggcagaaatcagctggggcttgtttagcttccagcacactctc

SEQ ID NO: 21323 - DNA, 494 bp, Homo sapiens
tctgtggctgcttttgctgtttcggctgtggcttcccagtgggagaggaccggcaaaccatttaatccactcttgggagaaacgtatgaattaatcagggaagatttaggattcagatttatatcggaacaggtcagtcaccacccccccatcagtgcgttccactcggaaggtctcaaccatgacttcctgttccatggctccatctaccccaagctcaagttctggggcaaaagcgtggaggcggagccccgaggcaccatcaccctggagctgctcaatgtcaaccaaagacacctcagagcaaaacacaagtctccaacaaatgccggccgctaagacccgacagacacagaccggatgctggcgtcctcctgggccaccagttctgagacgtgagtcttgccaagccactgcctgcagtcttgttgtaggcagcaggtcctaacaaatacatacagaaataagtaataaacgacaccttgcctgatgaa

SEQ ID NO: 21324 - DNA, 6760 bp, Homo sapiens
ggcgcgcgccgagaagttctgggcaaagtactcagaactggccgcgtgctggtggcgcccgccagccggcccgggagaggggacttgagcgcttcgcggccggtgcgcagcgcggctccggccccgcagtctgtctgcaagtggccatccccgcccccgactcctgcggccggtgcgggagctgtcagctgcacgttgcgggggtaccggagaagccggggttgccttctcccggttctgtgcgctaaccccggagcccggccccggggaactagggagcgtctccggctgcacagcgctcaggttttagggtttcctttgggccacccaaaatgttttttaaatactttggataagagctaaaccacctgccactggggacttccatactctcggctcccttgtcatctgatggcattttgattgtctcgaggccaagtgacttgctgtccatgatgagtgatgagaagaaccttggtgtgtcccaaaaattggtatcaccttcaaggagcacaagtagctgctcttccaagcaaggaagtcgacaggacagctgggaagtggtggaaggactgaggggggagatgaattacacccaggagccaccagttcagaaaggatttttgctgaaaaagaggaagtggcccttaaaaggctggcataagagattcttctatctggacaaaggaatcttgaaatatgccaagagccaaaccgatatagagagagagaagctgcatggctgcattgatgtcgggctctcagtgatgtctgtaaagaagtcatcaaaatgcatagaccttgacaccgaggagcacatctaccatctgaaggtcaagtcagaagaagtctttgatgagtgggtatcgaaacttcgccaccacagaatgtatcgtcagaatgaaattgccatgtttccacatgaagttaaccactttttctcagggtccaccatcacagactcttcatctggggtgtttgactccatttcaagtaggaagcgtagcagtatatcaaagcagaatttatttcaaactggaagcaatgtatcattttcttgtggtggtgagacacgagttccattatggttacagtcttcagaggacatggaaaaatgctccaaagacctggcgcactgtcatgcctacctggtagaaatgagccagctcctgcaaagcatggacgtcctgcatcggacatactcggcaccagctatcaacgccatccagggtggatcttttgaaagtcccaaaaaggaaaaaagatcgcacaggaggtggcggtccagagctattggcaaagatgctaaaggaacactgcaggtcccgaaacctttttctggcccagtaagactacactcctccaatcctaatttgtcaacactagattttggagaagagaaaaattattctgatggctctgaaacctcatcagagttttctaaaatgcaagaagatctgtgtcatattgcccataaagtttacttcactttaaggtcagcttttaatatcatgtcagcggagagagagaaactgaagcagctgatggagcaggatgcctcctcctccccgtctgctcaggtcattggtctgaagaacgccctgtcatccgccctagcacaaaacacagatcttaaagaacgcttacgcagaatccatgccgagtctctgctcctcgactcccccgctgtcgccaagtcgggtgacaatctggcagaggaaaactccagagatgaaaaccgagctctagttcatcagctttctaatgaaagtagactctccatcactgactccctttctgagttttttgatgctcaggaagttctgttatctccaagctcttcagaaaacgagatttctgatgatgactcatatgtcagtgacataagtgataatctttccttagataatctcagtaatgatttagataatgagagacagaccttggggcctgtccttgatagtggtcgggaagcgaagtcccggagaagaacgtgcctgccggcgccctgcccgagcagcagtaacatcagcctgtggaacatcctgaggaacaacatcgggaaggacctgtccaaggtggccatgccggtggagctgaacgagcccctgaacacgctgcagaggctctgcgaggagctggagtacagcgagctcctggacaaggccgcgcagattcccagccccctggaaaggatggtatatgtggcagcctttgccatatcagcgtatgcatctagctactaccgagctggaagcaagccatttaatccggttcttggagaaacatatgaatgtattcgggaggacaagggcttccagtttttttcagaacaggtcagccaccatccgcctatctctgcgtgtcatgctgagtctagaaattttgttttctggcaagatgtgagatggaaaaacaaattctggggcaaatccatggaaattgttccaattggcacaacccatgtgactctgccagtttttggggatcattttgagtggaacaaagtgacctcttgcatccataacatcttaagcgggcagaggtggattgagcactatggagagattgtcatcaagaacctgcatgatgattcctgctactgcaaagtgaattttataaaggcaaaatactggagcactaatgcccatgagattgaaggcacagtgtttgacaggagtggaaaagcggttcatcggctgtttgggaaatggcatgaaagcatctactgtggcggcggctcctcttctgcctgtgtatggagagcaaatcctatgccgaaaggctacgagcaatactatagcttcacacagtttgcgctggaattaaatgaaatggatccatcatcaaagtctttattgccacctactgacactcgatttaggccagaccagaggtttctagaggaagggaacttagaagaagctgaaatacaaaagcagaggattgaacaactgcagagagaaaggcggcgggtcttagaagaaaatcatgtggagcaccagcctcggtttttcaggaaatccgacgatgactcttgggtgagcaacggcacctatttggaacttagaaaagatcttggtttttccaaactggaccatcctgtcttatggtgaaaaagtaaagaagaaagataacattagtgtatttctcctgtgcttgccttctgaagtggcacaaacctgtgtttatatatttaaaagatactctaggatgatcacttgtgcttagcttagcattgtaactctttaagtctatattttcctcagtgcgtttctttacaatttcaaatgttaccctgattgtttatatgaatgtagaacaccttgacatttctttttatatataaactatttaataaaaatgaaagattgaatgttcatgtgtgggttaaaaaaagaagctttaacactaattttccaaaggttagggaagattccaattaaatttatgccttataaaattatgttgtagaaaaaaaatcaacctctcccaggtgcattaagaaataagaattcccagggttactcacccatgcgtaagctacccaagtttaatttggtagctgaaatatctttttgcctcagacagctcttgaattgctcatacagaacaattctgctggtgctggagtctgaagaatattttcatttgcattttagtggttagggagaggatataagattaatggaatgtatatttttatataagacgtatacggcaccttcttgaaaaggaagcatttgaacttgttcctccctatagttctattgccttatatgcaaaattgtaccctgttgctcagagaaattattcataagagaaaagaattccaattaattaaatatcacaatagcatcccagagagacagtaggaaatttctccttagtgagagctgagtccttgagaagttaagagactgtttcctgcttcccaccccaccccgttttttgtccctccgtttgatcacctccctgttgagtatggaatgtcccagtttaatataaaacatacagtttattccacacagcagtttgactttgtaaaagtttagcaaaataactgattgttttggataactcaacatgtttttcttaaatgctgttttagtattttctacctcttaataagcaccatattttagatcttgtataaaaagttgccatctgccttatagacaaatgtagagaattgatgttcttgctttgtgttgtgttctggtaaagctttaagtgagtgtcttacccctttcctatactttcttgttatccatatcattcttttgtgagttttgcagcagtcttgaataatacagattataactactgaaaggggaaccttcgtctttttaaatgtgttatttcacattacaataatatgtgtagtagttgaattgtgttatcaaagcatgtccaacttctgtccagatgacattaaaaccaaagcctaattgttaagcctcttattctaaagtccatagcaatgctatggaatatcaagtataatgatgtagtaaaaagatttctccagaaaacactttgagatacttaaagaaattcagagcatatcgaatgttatgaatgaagagtaaaataattacaggaaaagaatgcatgatttttcattgtcacaccaaataaccagttggacaatattgcattttcaaaatggagagttatttaaagtggatgtgtagccttctggaatctgcacgtgactggcattttaaaacaactcattaaatattggattcattttatcgagatgccaagatgaacacaatgtgaatatcatttccatttctaagcagttgaatgacacagtcagattctttggtgtatgctttgttctttccatctcaagcatttatccaaattctgctcacagacatgaggaagcaggctgtagatttaagggcactcaaggggaaaacaaatgtagtttccacagtgtgaggataaatgtagaatcgtggtaatattggctgttaaattggcctgctccagagactggctcaaaaaagaaagaagcaacgaaaacaaaatgcacagcctgaatggacgtagcactgtcatgtggcatttggaaaatctttaattatcctaatgttatttcacttgcccttatgctttattttagagtcccagggacaactggatgaaacattacgtctgtagtcatcttatttgagatgggggtgggaacgaattaaaatatgatagagaactatatgcagattttaaaatctagtcagtactagcatctataaagggcttttctgaaatttaaacagcttggtgatgcatcctgatattataagcttaaaactatcttgagggggaaatgacttcttttctccttctgtcccttttctcaaaagcatctttcccccaaatgtatgtctctaggacattttatagttttaagaggaagaaaacagaaacgtggcatcatttgggaagaaccaaggtagaatttaattttctggactttaaatctcctggttaaataatgctaatcactgtaccatttgagttacatgttttaacctcttttttttttctaattattccatccaaaatttctggtgaattacacagaaatttttggaaatgggactttgtgcaggtaaccaccctgcacttcaggtaatgttcctgtcacagctgtcgactaccccacgctgcaggaaatccattcagaaatgagctaacagtctccagtgtagcaggagagccagtcacttccctccccaggccccaaagcaccccaaggctggtattccttgagtcataggtattaataataaaagcctcaatgcagcttctccatgtagttcctctcctacaagccaggtggattctggtcctaactaaagagatgggagttcacctgagggcaagaagtacccaggatgcccaaacagccgcacaggtgtcctgtgcttcctgtgagacttcctgggggaaatatacaaactaatatattttttaatgtttacgtcatttacactgctgcttttctcatattctgcttttaattacttgtagtaaatcatttgtttgggcttcaagcactgtcttccatctgcatcttccagatttatcatgagtgatcttgttctactgttaaagatgtcaagcctaaaaagtaataaagtttttatttggctgttgaaccttgatgtagcccctactacatacactacaagttatgccttctggctactacagaatctccgcagaccttttagttatgagtagaagcaataagaaggtgtccttatggtcttaggaataatagttccaatgtattggcataatttgtttgaatgtctttattttgatattaacaccggcataaatctatttttgctaccagatgatagctattttcatttgctctattttcctctgcattgtactaatctgttactcagtgttagtcttcatttttctgtgttggaaacctgcgtcatgtaaatatctgcaaatcatgacagtctaaagtgcaaaccattttcagagactttggggaatgcagtgatcagaagtggctaatttattttatttctgattattttatccagagggtacttttttaatggatatttgtaaatcttccacttaaccactgaaaattattttgttttaatcccacccttccatccatacctctgcctccccaaaaagctcctattaatttgcttatccccctcatgtagctagttgaatgtgaataaataacatggaaaaaaag

SEQ ID NO: 21325 - DNA, 6612 bp, Homo sapiens
gctggtggcgcccgccagccggcccgggagaggggacttgagcgcttcgcggccggtgcgcagcgcggctccggccccgcagtctgtctgcaagtggccatccccgcccccgactcctgcggccggtgcgggagctgtcagctgcacgttgcgggggtaccggagaagccggggttgccttctcccggttctgtgcgctaaccccggagcccggccccggggaactagggagcgtctccggctgcacagcgctcaggttttagggtttcctttgggccacccaaaatgttttttaaatactttggataagagctaaaccacctgccactggggacttccatactctcggctcccttgtcatctgatggcattttgattgtctcgaggccaagtgacttgctgtccatgatgagtgatgagaagaaccttggtgtgtcccaaaaattggtatcaccttcaaggagcacaagtagctgctcttccaagcaaggaagtcgacaggacagctgggaagtggtggaaggactgaggggggagatgaattacacccaggagccaccagttcagaaaggatttttgctgaaaaagaggaagtggcccttaaaaggctggcataagagattcttctatctggacaaaggaatcttgaaatatgccaagagccaaaccgatatagagagagagaagctgcatggctgcattgatgtcgggctctcagtgatgtctgtaaagaagtcatcaaaatgcatagaccttgacaccgaggagcacatctaccatctgaaggtcaagtcagaagaagtctttgatgagtgggtatcgaaacttcgccaccacagaatgtatcgtcagaatgaaattgccatgtttccacatgaagttaaccactttttctcagggtccaccatcacagactcttcatctggggtgtttgactccatttcaagtaggaagcgtagcagtatatcaaagcagaatttatttcaaactggaagcaatgtatcattttcttgtggtggtgagacacgagttccattatggttacagtcttcagaggacatggaaaaatgctccaaagacctggcgcactgtcatgcctacctggtagaaatgagccagctcctgcaaagcatggacgtcctgcatcggacatactcggcaccagctatcaacgccatccaggtcccgaaacctttttctggcccagtaagactacactcctccaatcctaatttgtcaacactagattttggagaagagaaaaattattctgatggctctgaaacctcatcagagttttctaaaatgcaagaagatctgtgtcatattgcccataaagtttacttcactttaaggtcagcttttaatatcatgtcagcggagagagagaaactgaagcagctgatggagcaggatgcctcctcctccccgtctgctcaggtcattggtctgaagaacgccctgtcatccgccctagcacaaaacacagatcttaaagaacgcttacgcagaatccatgccgagtctctgctcctcgactcccccgctgtcgccaagtcgggtgacaatctggcagaggaaaactccagagatgaaaaccgagctctagttcatcagctttctaatgaaagtagactctccatcactgactccctttctgagttttttgatgctcaggaagttctgttatctccaagctcttcagaaaacgagatttctgatgatgactcatatgtcagtgacataagtgataatctttccttagataatctcagtaatgatttagataatgagagacagaccttggggcctgtccttgatagtggtcgggaagcgaagtcccggagaagaacgtgcctgccggcgccctgcccgagcagcagtaacatcagcctgtggaacatcctgaggaacaacatcgggaaggacctgtccaaggtggccatgccggtggagctgaacgagcccctgaacacgctgcagaggctctgcgaggagctggagtacagcgagctcctggacaaggccgcgcagattcccagccccctggaaaggatggtatatgtggcagcctttgccatatcagcgtatgcatctagctactaccgagctggaagcaagccatttaatccggttcttggagaaacatatgaatgtattcgggaggacaagggcttccagtttttttcagaacaggtcagccaccatccgcctatctctgcgtgtcatgctgagtctagaaattttgttttctggcaagatgtgagatggaaaaacaaattctggggcaaatccatggaaattgttccaattggcacaacccatgtgactctgccagtttttggggatcattttgagtggaacaaagtgacctcttgcatccataacatcttaagcgggcagaggtggattgagcactatggagagattgtcatcaagaacctgcatgatgattcctgctactgcaaagtgaattttataaaggcaaaatactggagcactaatgcccatgagattgaaggcacagtgtttgacaggagtggaaaagcggttcatcggctgtttgggaaatggcatgaaagcatctactgtggcggcggctcctcttctgcctgtgtatggagagcaaatcctatgccgaaaggctacgagcaatactatagcttcacacagtttgcgctggaattaaatgaaatggatccatcatcaaagtctttattgccacctactgacactcgatttaggccagaccagaggtttctagaggaagggaacttagaagaagctgaaatacaaaagcagaggattgaacaactgcagagagaaaggcggcgggtcttagaagaaaatcatgtggagcaccagcctcggtttttcaggaaatccgacgatgactcttgggtgagcaacggcacctatttggaacttagaaaagatcttggtttttccaaactggaccatcctgtcttatggtgaaaaagtaaagaagaaagataacattagtgtatttctcctgtgcttgccttctgaagtggcacaaacctgtgtttatatatttaaaagatactctaggatgatcacttgtgcttagcttagcattgtaactctttaagtctatattttcctcagtgcgtttctttacaatttcaaatgttaccctgattgtttatatgaatgtagaacaccttgacatttctttttatatataaactatttaataaaaatgaaagattgaatgttcatgtgtgggttaaaaaaagaagctttaacactaattttccaaaggttagggaagattccaattaaatttatgccttataaaattatgttgtagaaaaaaaatcaacctctcccaggtgcattaagaaataagaattcccagggttactcacccatgcgtaagctacccaagtttaatttggtagctgaaatatctttttgcctcagacagctcttgaattgctcatacagaacaattctgctggtgctggagtctgaagaatattttcatttgcattttagtggttagggagaggatataagattaatggaatgtatatttttatataagacgtatacggcaccttcttgaaaaggaagcatttgaacttgttcctccctatagttctattgccttatatgcaaaattgtaccctgttgctcagagaaattattcataagagaaaagaattccaattaattaaatatcacaatagcatcccagagagacagtaggaaatttctccttagtgagagctgagtccttgagaagttaagagactgtttcctgcttcccaccccaccccgttttttgtccctccgtttgatcacctccctgttgagtatggaatgtcccagtttaatataaaacatacagtttattccacacagcagtttgactttgtaaaagtttagcaaaataactgattgttttggataactcaacatgtttttcttaaatgctgttttagtattttctacctcttaataagcaccatattttagatcttgtataaaaagttgccatctgccttatagacaaatgtagagaattgatgttcttgctttgtgttgtgttctggtaaagctttaagtgagtgtcttacccctttcctatactttcttgttatccatatcattcttttgtgagttttgcagcagtcttgaataatacagattataactactgaaaggggaaccttcgtctttttaaatgtgttatttcacattacaataatatgtgtagtagttgaattgtgttatcaaagcatgtccaacttctgtccagatgacattaaaaccaaagcctaattgttaagcctcttattctaaagtccatagcaatgctatggaatatcaagtataatgatgtagtaaaaagatttctccagaaaacactttgagatacttaaagaaattcagagcatatcgaatgttatgaatgaagagtaaaataattacaggaaaagaatgcatgatttttcattgtcacaccaaataaccagttggacaatattgcattttcaaaatggagagttatttaaagtggatgtgtagccttctggaatctgcacgtgactggcattttaaaacaactcattaaatattggattcattttatcgagatgccaagatgaacacaatgtgaatatcatttccatttctaagcagttgaatgacacagtcagattctttggtgtatgctttgttctttccatctcaagcatttatccaaattctgctcacagacatgaggaagcaggctgtagatttaagggcactcaaggggaaaacaaatgtagtttccacagtgtgaggataaatgtagaatcgtggtaatattggctgttaaattggcctgctccagagactggctcaaaaaagaaagaagcaacgaaaacaaaatgcacagcctgaatggacgtagcactgtcatgtggcatttggaaaatctttaattatcctaatgttatttcacttgcccttatgctttattttagagtcccagggacaactggatgaaacattacgtctgtagtcatcttatttgagatgggggtgggaacgaattaaaatatgatagagaactatatgcagattttaaaatctagtcagtactagcatctataaagggcttttctgaaatttaaacagcttggtgatgcatcctgatattataagcttaaaactatcttgagggggaaatgacttcttttctccttctgtcccttttctcaaaagcatctttcccccaaatgtatgtctctaggacattttatagttttaagaggaagaaaacagaaacgtggcatcatttgggaagaaccaaggtagaatttaattttctggactttaaatctcctggttaaataatgctaatcactgtaccatttgagttacatgttttaacctcttttttttttctaattattccatccaaaatttctggtgaattacacagaaatttttggaaatgggactttgtgcaggtaaccaccctgcacttcaggtaatgttcctgtcacagctgtcgactaccccacgctgcaggaaatccattcagaaatgagctaacagtctccagtgtagcaggagagccagtcacttccctccccaggccccaaagcaccccaaggctggtattccttgagtcataggtattaataataaaagcctcaatgcagcttctccatgtagttcctctcctacaagccaggtggattctggtcctaactaaagagatgggagttcacctgagggcaagaagtacccaggatgcccaaacagccgcacaggtgtcctgtgcttcctgtgagacttcctgggggaaatatacaaactaatatattttttaatgtttacgtcatttacactgctgcttttctcatattctgcttttaattacttgtagtaaatcatttgtttgggcttcaagcactgtcttccatctgcatcttccagatttatcatgagtgatcttgttctactgttaaagatgtcaagcctaaaaagtaataaagtttttatttggctgttgaaccttgatgtagcccctactacatacactacaagttatgccttctggctactacagaatctccgcagaccttttagttatgagtagaagcaataagaaggtgtccttatggtcttaggaataatagttccaatgtattggcataatttgtttgaatgtctttattttgatattaacaccggcataaatctatttttgctaccagatgatagctattttcatttgctctattttcctctgcattgtactaatctgttactcagtgttagtcttcatttttctgtgttggaaacctgcgtcatgtaaatatctgcaaatcatgacagtctaaagtgcaaaccattttcagagactttggggaatgcagtgatcagaagtggctaatttattttatttctgattattttatccagagggtacttttttaatggatatttgtaaatcttccacttaaccactgaaaattattttgttttaatcccacccttccatccatacctctgcctccccaaaaagctcctattaatttgcttatccccctcatgtagctagttgaatgtgaataaataacatgg

SEQ ID NO: 21326 - DNA, 6597 bp, Homo sapiens
gctggtggcgcccgccagccggcccgggagaggggacttgagcgcttcgcggccggtgcgcagcgcggctccggccccgcagtctgtctgcaagtggccatccccgcccccgactcctgcggccggtgcgggagctgtcagctgcacgttgcgggggtaccggagaagccggggttgccttctcccggttctgtgcgctaaccccggagcccggccccggggaactagggagcgtctccggctgcacagcgctcaggttttagggtttcctttgggccacccaaaatgttttttaaatactttggataagagctaaaccacctgccactggggacttccatactctcggctcccttgtcatctgatggcattttgattgtctcgaggccaagtgacttgctgtccatgatgagtgatgagaagaaccttggtgtgtcccaaaaattggtatcaccttcaaggagcacaagtagctgctcttccaagcaaggaagtcgacaggacagctgggaagtggtggaaggactgaggggggagatgaattacacccaggagccaccagttcagaaaggatttttgctgaaaaagaggaagtggcccttaaaaggctggcataagagattcttctatctggacaaaggaatcttgaaatatgccaagagccaaaccgatatagagagagagaagctgcatggctgcattgatgtcgggctctcagtgatgtctgtaaagaagtcatcaaaatgcatagaccttgacaccgaggagcacatctaccatctgaaggtcaagtcagaagaagtctttgatgagtgggtatcgaaacttcgccaccacagaatgtatcgtcagaatgaaattgccatgtttccacatgaagttaaccactttttctcagggtccaccatcacagactcttcatctggggtgtttgactccatttcaagtaggaagcgtagcagtatatcaaagcagaatttatttcaaactggaagcaatgtatcattttcttgtggtggtgagacacgagttccattatggttacagtcttcagaggacatggaaaaatgctccaaagacctggcgcactgtcatgcctacctggtagaaatgagccagctcctgcaaagcatggacgtcctgcatcggacatactcggcaccagctatcaacgccatccagggtggatcttttgaaagtcccaaaaaggaaaaaagatcgcacaggaggtggcggtccagagctattggcaaagatgctaaaggaacactgcaggtcccgaaacctttttctggcccagtaagactacactcctccaatcctaatttgtcaacactagattttggagaagagaaaaattattctgatggctctgaaacctcatcagagttttctaaaatgcaagaagatctgtgtcatattgcccataaagtttacttcactttaaggtcagcttttaatatcatgtcagcggagagagagaaactgaagcagctgatggagcaggatgcctcctcctccccgtctgctcaggtcattggtctgaagaacgccctgtcatccgaaaactccagagatgaaaaccgagctctagttcatcagctttctaatgaaagtagactctccatcactgactccctttctgagttttttgatgctcaggaagttctgttatctccaagctcttcagaaaacgagatttctgatgatgactcatatgtcagtgacataagtgataatctttccttagataatctcagtaatgatttagataatgagagacagaccttggggcctgtccttgatagtggtcgggaagcgaagtcccggagaagaacgtgcctgccggcgccctgcccgagcagcagtaacatcagcctgtggaacatcctgaggaacaacatcgggaaggacctgtccaaggtggccatgccggtggagctgaacgagcccctgaacacgctgcagaggctctgcgaggagctggagtacagcgagctcctggacaaggccgcgcagattcccagccccctggaaaggatggtatatgtggcagcctttgccatatcagcgtatgcatctagctactaccgagctggaagcaagccatttaatccggttcttggagaaacatatgaatgtattcgggaggacaagggcttccagtttttttcagaacaggtcagccaccatccgcctatctctgcgtgtcatgctgagtctagaaattttgttttctggcaagatgtgagatggaaaaacaaattctggggcaaatccatggaaattgttccaattggcacaacccatgtgactctgccagtttttggggatcattttgagtggaacaaagtgacctcttgcatccataacatcttaagcgggcagaggtggattgagcactatggagagattgtcatcaagaacctgcatgatgattcctgctactgcaaagtgaattttataaaggcaaaatactggagcactaatgcccatgagattgaaggcacagtgtttgacaggagtggaaaagcggttcatcggctgtttgggaaatggcatgaaagcatctactgtggcggcggctcctcttctgcctgtgtatggagagcaaatcctatgccgaaaggctacgagcaatactatagcttcacacagtttgcgctggaattaaatgaaatggatccatcatcaaagtctttattgccacctactgacactcgatttaggccagaccagaggtttctagaggaagggaacttagaagaagctgaaatacaaaagcagaggattgaacaactgcagagagaaaggcggcgggtcttagaagaaaatcatgtggagcaccagcctcggtttttcaggaaatccgacgatgactcttgggtgagcaacggcacctatttggaacttagaaaagatcttggtttttccaaactggaccatcctgtcttatggtgaaaaagtaaagaagaaagataacattagtgtatttctcctgtgcttgccttctgaagtggcacaaacctgtgtttatatatttaaaagatactctaggatgatcacttgtgcttagcttagcattgtaactctttaagtctatattttcctcagtgcgtttctttacaatttcaaatgttaccctgattgtttatatgaatgtagaacaccttgacatttctttttatatataaactatttaataaaaatgaaagattgaatgttcatgtgtgggttaaaaaaagaagctttaacactaattttccaaaggttagggaagattccaattaaatttatgccttataaaattatgttgtagaaaaaaaatcaacctctcccaggtgcattaagaaataagaattcccagggttactcacccatgcgtaagctacccaagtttaatttggtagctgaaatatctttttgcctcagacagctcttgaattgctcatacagaacaattctgctggtgctggagtctgaagaatattttcatttgcattttagtggttagggagaggatataagattaatggaatgtatatttttatataagacgtatacggcaccttcttgaaaaggaagcatttgaacttgttcctccctatagttctattgccttatatgcaaaattgtaccctgttgctcagagaaattattcataagagaaaagaattccaattaattaaatatcacaatagcatcccagagagacagtaggaaatttctccttagtgagagctgagtccttgagaagttaagagactgtttcctgcttcccaccccaccccgttttttgtccctccgtttgatcacctccctgttgagtatggaatgtcccagtttaatataaaacatacagtttattccacacagcagtttgactttgtaaaagtttagcaaaataactgattgttttggataactcaacatgtttttcttaaatgctgttttagtattttctacctcttaataagcaccatattttagatcttgtataaaaagttgccatctgccttatagacaaatgtagagaattgatgttcttgctttgtgttgtgttctggtaaagctttaagtgagtgtcttacccctttcctatactttcttgttatccatatcattcttttgtgagttttgcagcagtcttgaataatacagattataactactgaaaggggaaccttcgtctttttaaatgtgttatttcacattacaataatatgtgtagtagttgaattgtgttatcaaagcatgtccaacttctgtccagatgacattaaaaccaaagcctaattgttaagcctcttattctaaagtccatagcaatgctatggaatatcaagtataatgatgtagtaaaaagatttctccagaaaacactttgagatacttaaagaaattcagagcatatcgaatgttatgaatgaagagtaaaataattacaggaaaagaatgcatgatttttcattgtcacaccaaataaccagttggacaatattgcattttcaaaatggagagttatttaaagtggatgtgtagccttctggaatctgcacgtgactggcattttaaaacaactcattaaatattggattcattttatcgagatgccaagatgaacacaatgtgaatatcatttccatttctaagcagttgaatgacacagtcagattctttggtgtatgctttgttctttccatctcaagcatttatccaaattctgctcacagacatgaggaagcaggctgtagatttaagggcactcaaggggaaaacaaatgtagtttccacagtgtgaggataaatgtagaatcgtggtaatattggctgttaaattggcctgctccagagactggctcaaaaaagaaagaagcaacgaaaacaaaatgcacagcctgaatggacgtagcactgtcatgtggcatttggaaaatctttaattatcctaatgttatttcacttgcccttatgctttattttagagtcccagggacaactggatgaaacattacgtctgtagtcatcttatttgagatgggggtgggaacgaattaaaatatgatagagaactatatgcagattttaaaatctagtcagtactagcatctataaagggcttttctgaaatttaaacagcttggtgatgcatcctgatattataagcttaaaactatcttgagggggaaatgacttcttttctccttctgtcccttttctcaaaagcatctttcccccaaatgtatgtctctaggacattttatagttttaagaggaagaaaacagaaacgtggcatcatttgggaagaaccaaggtagaatttaattttctggactttaaatctcctggttaaataatgctaatcactgtaccatttgagttacatgttttaacctcttttttttttctaattattccatccaaaatttctggtgaattacacagaaatttttggaaatgggactttgtgcaggtaaccaccctgcacttcaggtaatgttcctgtcacagctgtcgactaccccacgctgcaggaaatccattcagaaatgagctaacagtctccagtgtagcaggagagccagtcacttccctccccaggccccaaagcaccccaaggctggtattccttgagtcataggtattaataataaaagcctcaatgcagcttctccatgtagttcctctcctacaagccaggtggattctggtcctaactaaagagatgggagttcacctgagggcaagaagtacccaggatgcccaaacagccgcacaggtgtcctgtgcttcctgtgagacttcctgggggaaatatacaaactaatatattttttaatgtttacgtcatttacactgctgcttttctcatattctgcttttaattacttgtagtaaatcatttgtttgggcttcaagcactgtcttccatctgcatcttccagatttatcatgagtgatcttgttctactgttaaagatgtcaagcctaaaaagtaataaagtttttatttggctgttgaaccttgatgtagcccctactacatacactacaagttatgccttctggctactacagaatctccgcagaccttttagttatgagtagaagcaataagaaggtgtccttatggtcttaggaataatagttccaatgtattggcataatttgtttgaatgtctttattttgatattaacaccggcataaatctatttttgctaccagatgatagctattttcatttgctctattttcctctgcattgtactaatctgttactcagtgttagtcttcatttttctgtgttggaaacctgcgtcatgtaaatatctgcaaatcatgacagtctaaagtgcaaaccattttcagagactttggggaatgcagtgatcagaagtggctaatttattttatttctgattattttatccagagggtacttttttaatggatatttgtaaatcttccacttaaccactgaaaattattttgttttaatcccacccttccatccatacctctgcctccccaaaaagctcctattaatttgcttatccccctcatgtagctagttgaatgtgaataaataacatgg

SEQ ID NO: 21327 - DNA, 2707 bp, Homo sapiens
tggataagagctaaaccacctgccactggggacttccatactctcggctcccttgtcatctgatggcattttgattgtctcgaggccaagtgacttgctgtccatgatgagtgatgagaagaaccttggtgtgtcccaaaaattggtatcaccttcaaggagcacaagtagctgctcttccaagcaaggaagtcgacaggacagctgggaagtggtggaaggactgaggggggagatgaattacacccaggagccaccagttcagaaaggatttttgctgaaaaagaggaagtggcccttaaaaggctggcataagagattcttctatctggacaaaggaatcttgaaatatgccaagagccaaaccgatatagagagagagaagctgcatggctgcattgatgtcgggctctcagtgatgtctgtaaagaagtcatcaaaatgcatagaccttgacaccgaggagcacatctaccatctgaaggtcaagtcagaagaagtctttgatgagtgggtatcgaaacttcgccaccacagaatgtatcgtcagaatgaaattgccatgtttccacatgaagttaaccactttttctcagggtccaccatcacagactcttcatctggggtgtttgactccatttcaagtaggaagcgtagcagtatatcaaagcagaatttatttcaaactggaagcaatgtatcattttcttgtggtggtgagacacgagttccattatggttacagtcttcagaggacatggaaaaatgctccaaagacctggcgcactgtcatgcctacctggtagaaatgagccagctcctgcaaagcatggacgtcctgcatcggacatactcggcaccagctatcaacgccatccagggtggatcttttgaaagtcccaaaaaggaaaaaagatcgcacaggaggtggcggtccagagctattggcaaagatgctaaaggaacactgcaggtcccgaaacctttttctggcccagtaagactacactcctccaatcctaatttgtcaacactagattttggagaagagaaaaattattctgatggctctgaaacctcatcagagttttctaaaatgcaagaagatctgtgtcatattgcccataaagtttacttcactttaaggtcagcttttaatatcatgtcagcggagagagagaaactgaagcagctgatggagcaggatgcctcctcctccccgtctgctcaggtcattggtctgaagaacgccctgtcatccgaaaactccagagatgaaaaccgagctctagttcatcagctttctaatgaaagtagactctccatcactgactccctttctgagttttttgatgctcaggaagttctgttatctccaagctcttcagaaaacgagatttctgatgatgactcatatgtcagtgacataagtgataatctttccttagataatctcagtaatgatttagataatgagagacagaccttggggcctgtccttgatagtggtcgggaagcgaagtcccggagaagaacgtgcctgccggcgccctgcccgagcagcagtaacatcagcctgtggaacatcctgaggaacaacatcgggaaggacctgtccaaggtggccatgccggtggagctgaacgagcccctgaacacgctgcagaggctctgcgaggagctggagtacagcgagctcctggacaaggccgcgcagattcccagccccctggaaaggatggtatatgtggcagcctttgccatatcagcgtatgcatctagctactaccgagctggaagcaagccatttaatccggttcttggagaaacatatgaatgtattcgggaggacaagggcttccagtttttttcagaacaggtcagccaccatccgcctatctctgcgtgtcatgctgagtctagaaattttgttttctggcaagatgtgagatggaaaaacaaattctggggcaaatccatggaaattgttccaattggcacaacccatgtgactctgccagtttttggggatcattttgagtggaacaaagtgacctcttgcatccataacatcttaagcgggcagaggtggattgagcactatggagagattgtcatcaagaacctgcatgatgattcctgctactgcaaagtgaattttataaaggcaaaatactggagcactaatgcccatgagattgaaggcacagtgtttgacaggagtggaaaagcggttcatcggctgtttgggaaatggcatgaaagcatctactgtggcggcggctcctcttctgcctgtgtatggagagcaaatcctatgccgaaaggctacgagcaatactatagcttcacacagtttgcgctggaattaaatgaaatggatccatcatcaaagtctttattgccacctactgacactcgatttaggccagaccagaggtttctagaggaagggaacttagaagaagctgaaatacaaaagcagaggattgaacaactgcagagagaaaggcggcgggtcttagaagaaaatcatgtggagcaccagcctcggtttttcaggaaatccgacgatgactcttgggtgagcaacggcacctatttggaacttagaaaagatcttggtttttccaaactggaccatcctgtcttatggtgaaaaagtaaagaagaaagataacattagtgtatttctcctgtgcttgcc

SEQ ID NO: 21328 - DNA, 2969 bp, Homo sapiens
tttcctttgggccacccaaaatgttttttaaatactttggataagagctaaaccacctgccactggggacttccatactctcggctcccttgtcatctgatggcattttgattgtctcgaggccaagtgacttgctgtccatgatgagtgatgagaagaaccttggtgtgtcccaaaaattggtatcaccttcaaggagcacaagtagctgctcttccaagcaaggaagtcgacaggacagctgggaagtggtggaaggactgaggggggagatgaattacacccaggagccaccagttcagaaaggatttttgctgaaaaagaggaagtggcccttaaaaggctggcataagagattcttctatctggacaaaggaatcttgaaatatgccaagagccaaaccgatatagagagagagaagctgcatggctgcattgatgtcgggctctcagtgatgtctgtaaagaagtcatcaaaatgcatagaccttgacaccgaggagcacatctaccatctgaaggtcaagtcagaagaagtctttgatgagtgggtatcgaaacttcgccaccacagaatgtatcgtcagaatgaaattgccatgtttccacatgaagttaaccactttttctcagggtccaccatcacagactcttcatctggggtgtttgactccatttcaagtaggaagcgtagcagtatatcaaagcagaatttatttcaaactggaagcaatgtatcattttcttgtggtggtgagacacgagttccattatggttacagtcttcagaggacatggaaaaatgctccaaagacctggcgcactgtcatgcctacctggtagaaatgagccagctcctgcaaagcatggacgtcctgcatcggacatactcggcaccagctatcaacgccatccaggtcccgaaacctttttctggcccagtaagactacactcctccaatcctaatttgtcaacactagattttggagaagagaaaaattattctgatggctctgaaacctcatcagagttttctaaaatgcaagaagatctgtgtcatattgcccataaagtttacttcactttaaggtcagcttttaatatcatgtcagcggagagagagaaactgaagcagctgatggagcaggatgcctcctcctccccgtctgctcaggtcattggtctgaagaacgccctgtcatccgccctagcacaaaacacagatcttaaagaacgcttacgcagaatccatgccgagtctctgctcctcgactcccccgctgtcgccaagtcgggtgacaatctggcagaggaaaactccagagatgaaaaccgagctctagttcatcagctttctaatgaaagtagactctccatcactgactccctttctgagttttttgatgctcaggaagttctgttatctccaagctcttcagaaaacgagatttctgatgatgactcatatgtcagtgacataagtgataatctttccttagataatctcagtaatgatttagataatgagagacagaccttggggcctgtccttgatagtggtcgggaagcgaagtcccggagaagaacgtgcctgccggcgccctgcccgagcagcagtaacatcagcctgtggaacatcctgaggaacaacatcgggaaggacctgtccaaggtggccatgccggtggagctgaacgagcccctgaacacgctgcagaggctctgcgaggagctggagtacagcgagctcctggacaaggccgcgcagattcccagccccctggaaaggatggtatatgtggcagcctttgccatatcagcgtatgcatctagctactaccgagctggaagcaagccatttaatccggttcttggagaaacatatgaatgtattcgggaggacaagggcttccagtttttttcagaacaggtcagccaccatccgcctatctctgcgtgtcatgctgagtctagaaattttgttttctggcaagatgtgagatggaaaaacaaattctggggcaaatccatggaaattgttccaattggcacaacccatgtgactctgccagtttttggggatcattttgagtggaacaaagtgacctcttgcatccataacatcttaagcgggcagaggtggattgagcactatggagagattgtcatcaagaacctgcatgatgattcctgctactgcaaagtgaattttataaaggcaaaatactggagcactaatgcccatgagattgaaggcacagtgtttgacaggagtggaaaagcggttcatcggctgtttgggaaatggcatgaaagcatctactgtggcggcggctcctcttctgcctgtgtatggagagcaaatcctatgccgaaaggctacgagcaatactatagcttcacacagtttgcgctggaattaaatgaaatggatccatcatcaaagtctttattgccacctactgacactcgatttaggccagaccagaggtttctagaggaagggaacttagaagaagctgaaatacaaaagcagaggattgaacaactgcagagagaaaggcggcgggtcttagaagaaaatcatgtggagcaccagcctcggtttttcaggaaatccgacgatgactcttgggtgagcaacggcacctatttggaacttagaaaagatcttggtttttccaaactggaccatcctgtcttatggtgaaaaagtaaagaagaaagataacattagtgtatttctcctgtgcttgccttctgaagtggcacaaacctgtgtttatatatttaaaagatactctaggatgatcacttgtgcttagcttagcattgtaactctttaagtctatattttcctcagtgcgtttctttacaatttcaaatgttaccctgattgtttatatgaatgtagaacaccttgacatttctttttatatataaactatttaataaaaatgaaagattg

SEQ ID NO: 21329 - DNA, 2614 bp, Homo sapiens
tggataagagctaaaccacctgccactggggacttccatactctcggctcccttgtcatctgatggcattttgattgtctcgaggccaagtgacttgctgtccatgatgagtgatgagaagaaccttggtgtgtcccaaaaattggtatcaccttcaaggagcacaagtagctgctcttccaagcaaggaagtcgacaggacagctgggaagtggtggaaggactgaggggggagatgaattacacccaggagccaccagttcagaaaggatttttgctgaaaaagaggaagtggcccttaaaaggctggcataagagattcttctatctggacaaaggaatcttgaaatatgccaagagccaaaccgatatagagagagagaagctgcatggctgcattgatgtcgggctctcagtgatgtctgtaaagaagtcatcaaaatgcatagaccttgacaccgaggagcacatctaccatctgaaggtcaagtcagaagaagtctttgatgagtgggtatcgaaacttcgccaccacagaatgtatcgtcagaatgaaattgccatgtttccacatgaagttaaccactttttctcagggtccaccatcacagactcttcatctggggtgtttgactccatttcaagtaggaagcgtagcagtatatcaaagcagaatttatttcaaactggaagcaatgtatcattttcttgtggtggtgagacacgagttccattatggttacagtcttcagaggacatggaaaaatgctccaaagacctggcgcactgtcatgcctacctggtagaaatgagccagctcctgcaaagcatggacgtcctgcatcggacatactcggcaccagctatcaacgccatccaggtcccgaaacctttttctggcccagtaagactacactcctccaatcctaatttgtcaacactagattttggagaagagaaaaattattctgatggctctgaaacctcatcagagttttctaaaatgcaagaagatctgtgtcatattgcccataaagtttacttcactttaaggtcagcttttaatatcatgtcagcggagagagagaaactgaagcagctgatggagcaggatgcctcctcctccccgtctgctcaggtcattggtctgaagaacgccctgtcatccgaaaactccagagatgaaaaccgagctctagttcatcagctttctaatgaaagtagactctccatcactgactccctttctgagttttttgatgctcaggaagttctgttatctccaagctcttcagaaaacgagatttctgatgatgactcatatgtcagtgacataagtgataatctttccttagataatctcagtaatgatttagataatgagagacagaccttggggcctgtccttgatagtggtcgggaagcgaagtcccggagaagaacgtgcctgccggcgccctgcccgagcagcagtaacatcagcctgtggaacatcctgaggaacaacatcgggaaggacctgtccaaggtggccatgccggtggagctgaacgagcccctgaacacgctgcagaggctctgcgaggagctggagtacagcgagctcctggacaaggccgcgcagattcccagccccctggaaaggatggtatatgtggcagcctttgccatatcagcgtatgcatctagctactaccgagctggaagcaagccatttaatccggttcttggagaaacatatgaatgtattcgggaggacaagggcttccagtttttttcagaacaggtcagccaccatccgcctatctctgcgtgtcatgctgagtctagaaattttgttttctggcaagatgtgagatggaaaaacaaattctggggcaaatccatggaaattgttccaattggcacaacccatgtgactctgccagtttttggggatcattttgagtggaacaaagtgacctcttgcatccataacatcttaagcgggcagaggtggattgagcactatggagagattgtcatcaagaacctgcatgatgattcctgctactgcaaagtgaattttataaaggcaaaatactggagcactaatgcccatgagattgaaggcacagtgtttgacaggagtggaaaagcggttcatcggctgtttgggaaatggcatgaaagcatctactgtggcggcggctcctcttctgcctgtgtatggagagcaaatcctatgccgaaaggctacgagcaatactatagcttcacacagtttgcgctggaattaaatgaaatggatccatcatcaaagtctttattgccacctactgacactcgatttaggccagaccagaggtttctagaggaagggaacttagaagaagctgaaatacaaaagcagaggattgaacaactgcagagagaaaggcggcgggtcttagaagaaaatcatgtggagcaccagcctcggtttttcaggaaatccgacgatgactcttgggtgagcaacggcacctatttggaacttagaaaagatcttggtttttccaaactggaccatcctgtcttatggtgaaaaagtaaagaagaaagataacattagtgtatttctcctgtgcttgcc

SEQ ID NO: 21330 - DNA, 534 bp, Homo sapiens
acctgtgcttgtcattatgtgcgtcgaggataagccaacctttataggttttagggtttcctttgggccacccaaaatgttttttaaatactttggataagagctaaaccacctgccactggggacttccatactctcggctcccttgtcatctgatggcattttgattgtctcgaggccaagtgacttgctgtccatgatgagtgatgagaagaaccttggtgtgtcccaaaaattggtatcaccttcaaggagcacaagtagctgctcttccaagcaaggaagtcgacaggacagctgggaagtggtggaaggactgaggggggagatgaattacacccaggagccaccagttcagaaaggatttttgctgaaaaagaggaagtggcccttaaaaggctggcataagagattcttctatctggacaaaggaatcttgaaatatgccaagagccaaaccgatatagagagagagaagctgcatggctgcattgatgtcgggctctcagtgatgtctgtaaagaagtcatcaaa

SEQ ID NO: 21331 - DNA, 568 bp, Homo sapiens
agacatttcgcgagggggatggttccagaaagcgaagatctgagcgtggtgaatgaaatgtgaacagaatagctccggaaagagtctcagaaaccttgaattggggtcagtttggagactgaaaatgcgtcgagcgctgcaggtggtggttggcagggggatttaacactgtggagcccttactccgtcccaggcgctgagcccagcgagccacgcgcggtgcccagctcggtgaggttttagggtttcctttgggccacccaaaatgttttttaaatactttggataagagctaaaccacctgccactggggacttccatactctcggctcccttgtcatctgatggcattttgattgtctcgaggccaagtgacttgctgtccatgatgagtgatgagaagaaccttggtgtgtcccaaaaattggtatcaccttcaaggagcacaagtagctgctcttccaagcaaggaagtcgacaggacagctgggaagtggtggaaggactgaggggggagatgaattacacccaggagccaccagttcagaaaggatttttgctgaaaaag

SEQ ID NO: 21332 - DNA, 6504 bp, Homo sapiens
gctggtggcgcccgccagccggcccgggagaggggacttgagcgcttcgcggccggtgcgcagcgcggctccggccccgcagtctgtctgcaagtggccatccccgcccccgactcctgcggccggtgcgggagctgtcagctgcacgttgcgggggtaccggagaagccggggttgccttctcccggttctgtgcgctaaccccggagcccggccccggggaactagggagcgtctccggctgcacagcgctcaggttttagggtttcctttgggccacccaaaatgttttttaaatactttggataagagctaaaccacctgccactggggacttccatactctcggctcccttgtcatctgatggcattttgattgtctcgaggccaagtgacttgctgtccatgatgagtgatgagaagaaccttggtgtgtcccaaaaattggtatcaccttcaaggagcacaagtagctgctcttccaagcaaggaagtcgacaggacagctgggaagtggtggaaggactgaggggggagatgaattacacccaggagccaccagttcagaaaggatttttgctgaaaaagaggaagtggcccttaaaaggctggcataagagattcttctatctggacaaaggaatcttgaaatatgccaagagccaaaccgatatagagagagagaagctgcatggctgcattgatgtcgggctctcagtgatgtctgtaaagaagtcatcaaaatgcatagaccttgacaccgaggagcacatctaccatctgaaggtcaagtcagaagaagtctttgatgagtgggtatcgaaacttcgccaccacagaatgtatcgtcagaatgaaattgccatgtttccacatgaagttaaccactttttctcagggtccaccatcacagactcttcatctggggtgtttgactccatttcaagtaggaagcgtagcagtatatcaaagcagaatttatttcaaactggaagcaatgtatcattttcttgtggtggtgagacacgagttccattatggttacagtcttcagaggacatggaaaaatgctccaaagacctggcgcactgtcatgcctacctggtagaaatgagccagctcctgcaaagcatggacgtcctgcatcggacatactcggcaccagctatcaacgccatccaggtcccgaaacctttttctggcccagtaagactacactcctccaatcctaatttgtcaacactagattttggagaagagaaaaattattctgatggctctgaaacctcatcagagttttctaaaatgcaagaagatctgtgtcatattgcccataaagtttacttcactttaaggtcagcttttaatatcatgtcagcggagagagagaaactgaagcagctgatggagcaggatgcctcctcctccccgtctgctcaggtcattggtctgaagaacgccctgtcatccgaaaactccagagatgaaaaccgagctctagttcatcagctttctaatgaaagtagactctccatcactgactccctttctgagttttttgatgctcaggaagttctgttatctccaagctcttcagaaaacgagatttctgatgatgactcatatgtcagtgacataagtgataatctttccttagataatctcagtaatgatttagataatgagagacagaccttggggcctgtccttgatagtggtcgggaagcgaagtcccggagaagaacgtgcctgccggcgccctgcccgagcagcagtaacatcagcctgtggaacatcctgaggaacaacatcgggaaggacctgtccaaggtggccatgccggtggagctgaacgagcccctgaacacgctgcagaggctctgcgaggagctggagtacagcgagctcctggacaaggccgcgcagattcccagccccctggaaaggatggtatatgtggcagcctttgccatatcagcgtatgcatctagctactaccgagctggaagcaagccatttaatccggttcttggagaaacatatgaatgtattcgggaggacaagggcttccagtttttttcagaacaggtcagccaccatccgcctatctctgcgtgtcatgctgagtctagaaattttgttttctggcaagatgtgagatggaaaaacaaattctggggcaaatccatggaaattgttccaattggcacaacccatgtgactctgccagtttttggggatcattttgagtggaacaaagtgacctcttgcatccataacatcttaagcgggcagaggtggattgagcactatggagagattgtcatcaagaacctgcatgatgattcctgctactgcaaagtgaattttataaaggcaaaatactggagcactaatgcccatgagattgaaggcacagtgtttgacaggagtggaaaagcggttcatcggctgtttgggaaatggcatgaaagcatctactgtggcggcggctcctcttctgcctgtgtatggagagcaaatcctatgccgaaaggctacgagcaatactatagcttcacacagtttgcgctggaattaaatgaaatggatccatcatcaaagtctttattgccacctactgacactcgatttaggccagaccagaggtttctagaggaagggaacttagaagaagctgaaatacaaaagcagaggattgaacaactgcagagagaaaggcggcgggtcttagaagaaaatcatgtggagcaccagcctcggtttttcaggaaatccgacgatgactcttgggtgagcaacggcacctatttggaacttagaaaagatcttggtttttccaaactggaccatcctgtcttatggtgaaaaagtaaagaagaaagataacattagtgtatttctcctgtgcttgccttctgaagtggcacaaacctgtgtttatatatttaaaagatactctaggatgatcacttgtgcttagcttagcattgtaactctttaagtctatattttcctcagtgcgtttctttacaatttcaaatgttaccctgattgtttatatgaatgtagaacaccttgacatttctttttatatataaactatttaataaaaatgaaagattgaatgttcatgtgtgggttaaaaaaagaagctttaacactaattttccaaaggttagggaagattccaattaaatttatgccttataaaattatgttgtagaaaaaaaatcaacctctcccaggtgcattaagaaataagaattcccagggttactcacccatgcgtaagctacccaagtttaatttggtagctgaaatatctttttgcctcagacagctcttgaattgctcatacagaacaattctgctggtgctggagtctgaagaatattttcatttgcattttagtggttagggagaggatataagattaatggaatgtatatttttatataagacgtatacggcaccttcttgaaaaggaagcatttgaacttgttcctccctatagttctattgccttatatgcaaaattgtaccctgttgctcagagaaattattcataagagaaaagaattccaattaattaaatatcacaatagcatcccagagagacagtaggaaatttctccttagtgagagctgagtccttgagaagttaagagactgtttcctgcttcccaccccaccccgttttttgtccctccgtttgatcacctccctgttgagtatggaatgtcccagtttaatataaaacatacagtttattccacacagcagtttgactttgtaaaagtttagcaaaataactgattgttttggataactcaacatgtttttcttaaatgctgttttagtattttctacctcttaataagcaccatattttagatcttgtataaaaagttgccatctgccttatagacaaatgtagagaattgatgttcttgctttgtgttgtgttctggtaaagctttaagtgagtgtcttacccctttcctatactttcttgttatccatatcattcttttgtgagttttgcagcagtcttgaataatacagattataactactgaaaggggaaccttcgtctttttaaatgtgttatttcacattacaataatatgtgtagtagttgaattgtgttatcaaagcatgtccaacttctgtccagatgacattaaaaccaaagcctaattgttaagcctcttattctaaagtccatagcaatgctatggaatatcaagtataatgatgtagtaaaaagatttctccagaaaacactttgagatacttaaagaaattcagagcatatcgaatgttatgaatgaagagtaaaataattacaggaaaagaatgcatgatttttcattgtcacaccaaataaccagttggacaatattgcattttcaaaatggagagttatttaaagtggatgtgtagccttctggaatctgcacgtgactggcattttaaaacaactcattaaatattggattcattttatcgagatgccaagatgaacacaatgtgaatatcatttccatttctaagcagttgaatgacacagtcagattctttggtgtatgctttgttctttccatctcaagcatttatccaaattctgctcacagacatgaggaagcaggctgtagatttaagggcactcaaggggaaaacaaatgtagtttccacagtgtgaggataaatgtagaatcgtggtaatattggctgttaaattggcctgctccagagactggctcaaaaaagaaagaagcaacgaaaacaaaatgcacagcctgaatggacgtagcactgtcatgtggcatttggaaaatctttaattatcctaatgttatttcacttgcccttatgctttattttagagtcccagggacaactggatgaaacattacgtctgtagtcatcttatttgagatgggggtgggaacgaattaaaatatgatagagaactatatgcagattttaaaatctagtcagtactagcatctataaagggcttttctgaaatttaaacagcttggtgatgcatcctgatattataagcttaaaactatcttgagggggaaatgacttcttttctccttctgtcccttttctcaaaagcatctttcccccaaatgtatgtctctaggacattttatagttttaagaggaagaaaacagaaacgtggcatcatttgggaagaaccaaggtagaatttaattttctggactttaaatctcctggttaaataatgctaatcactgtaccatttgagttacatgttttaacctcttttttttttctaattattccatccaaaatttctggtgaattacacagaaatttttggaaatgggactttgtgcaggtaaccaccctgcacttcaggtaatgttcctgtcacagctgtcgactaccccacgctgcaggaaatccattcagaaatgagctaacagtctccagtgtagcaggagagccagtcacttccctccccaggccccaaagcaccccaaggctggtattccttgagtcataggtattaataataaaagcctcaatgcagcttctccatgtagttcctctcctacaagccaggtggattctggtcctaactaaagagatgggagttcacctgagggcaagaagtacccaggatgcccaaacagccgcacaggtgtcctgtgcttcctgtgagacttcctgggggaaatatacaaactaatatattttttaatgtttacgtcatttacactgctgcttttctcatattctgcttttaattacttgtagtaaatcatttgtttgggcttcaagcactgtcttccatctgcatcttccagatttatcatgagtgatcttgttctactgttaaagatgtcaagcctaaaaagtaataaagtttttatttggctgttgaaccttgatgtagcccctactacatacactacaagttatgccttctggctactacagaatctccgcagaccttttagttatgagtagaagcaataagaaggtgtccttatggtcttaggaataatagttccaatgtattggcataatttgtttgaatgtctttattttgatattaacaccggcataaatctatttttgctaccagatgatagctattttcatttgctctattttcctctgcattgtactaatctgttactcagtgttagtcttcatttttctgtgttggaaacctgcgtcatgtaaatatctgcaaatcatgacagtctaaagtgcaaaccattttcagagactttggggaatgcagtgatcagaagtggctaatttattttatttctgattattttatccagagggtacttttttaatggatatttgtaaatcttccacttaaccactgaaaattattttgttttaatcccacccttccatccatacctctgcctccccaaaaagctcctattaatttgcttatccccctcatgtagctagttgaatgtgaataaataacatgg

SEQ ID NO: 21333 - DNA, 540 bp, Homo sapiens
attatgtgcgtcgaggataagccaacctttataggtaagagtgctagtcattttatggactcataggatcactgaatttgaaagctagacaggatcgtcaggctgaaggaatcttggtaaatgggttttagggtttcctttgggccacccaaaatgttttttaaatactttggataagagctaaaccacctgccactggggacttccatactctcggctcccttgtcatctgatggcattttgattgtctcgaggccaagtgacttgctgtccatgatgagtgatgagaagaaccttggtgtgtcccaaaaattggtatcaccttcaaggagcacaagtagctgctcttccaagcaaggaagtcgacaggacagctgggaagtggtggaaggactgaggggggagatgaattacacccaggagccaccagttcagaaaggatttttgctgaaaaagaggaagtggcccttaaaaggctggcataagagattcttctatctggacaaaggaatcttgaaatatgccaagagccaaaccgat

SEQ ID NO: 21334 - DNA, 3889 bp, Homo sapiens
tcctccctccgccgcgccctcgctccgcctcgcgcggggggaccatctgctggcatttcctgcagccaggcccgcgccgccagtggagcccccgcgcgcccggccggcccggagcaccgagctcgcggcacggtaggagaagcccccgagcgcccacagcatgaaggaggaggccttcctccggcgccgcttctccctgtgtccaccttcctccacccctcagaaagtcgacccccggaagctcacccggaacttgctcctcagcggagacaatgagctctacccactcagcccagggaaggacatggagcccaacggcccgtcgctgcccagggatgaagggcccccgaccccaagctctgccacgaaggtgccaccggcagagtacaggctgtgcaacgggtcagacaaggaatgtgtgtcccccaccgccagggtcaccaagaaggagactctcaaggcgcagaaggagaactaccggcaggagaagaagcgcgccacacggcagctgctcagcgctctgacagaccccagcgtggtcatcatggctgacagcctgaagatccgcggcaccctgaagagctggaccaagctgtggtgcgtgctgaagccgggggtgctgctcatctacaagacgcccaaggtgggccagtgggtgggcacggtgctgctgcactgctgcgagctcatcgagcggccctccaagaaggacggcttctgcttcaagctcttccacccgctggatcagtccgtctgggccgtgaagggccccaaaggtgagagcgtgggctccatcacacagcccctgcccagcagctacctgatcttcagggccgcctccgagtcagatggtcgctgctggctggacgccctggagctggccctgcgctgctctagcctactgagactgggcacctgcaagccgggccgagacggggagccagggacctcgccagacgcatcaccctcatcgctctgtgggctgccagcctcagccaccgtccacccagaccaagacctgttcccactgaacgggtcttccctggagaacgatgcattctcagacaagtcggagagagagaaccctgaggagtcagataccgagacccaggaccatagccggaagacggagagtggcagcgaccagtcagagacccctggggccccggtgcggagagggaccacctatgtggagcaggtccaggaggagctgggggagctgggcgaggcgtcccaggtggagacagtgtcagaggagaacaagagtctgatgtggaccctgctgaagcagctacggccaggcatggacctgtcccgcgtggtgctacccacgttcgtactggagccgcgctccttcctgaacaagctctccgactactactaccacgcagacctgctctccagggctgcggtggaggaggatgcctacagccgcatgaagctggtgctgcggtggtacctgtctggcttctacaagaagcccaagggaatcaagaagccgtacaaccccatcctgggggagaccttccgctgctgctggttccacccgcagactgacagccgcacattctacatagcagagcaggtgtcccaccacccgcccgtgtctgccttccacgtcagcaaccggaaggacggcttctgcatcagtggcagcatcacagccaagtccaggttttatgggaactcgctgtcggcgctgctggacggcaaagccacgctcaccttcctgaaccgagccgaggattacacccttaccatgccctacgcccactgcaaaggaatcctgtatggcacgatgaccctggagctgggtgggaaggtcaccatcgagtgtgcgaagaacaacttccaggcccagctggaattcaaactcaagcccttcttcgggggtagcaccagcatcaaccagatctcgggaaagatcacgtcgggagaggaagtcctggcgagcctcagtggccactgggacagggacgtgtttatcaaggaggaagggagcggaagcagtgcgcttttctggaccccgagcggggaggtccgcagacagaggctgaggcagcacacggtgccgctggaggagcagacggagctggagtccgagaggctctggcagcacgtcaccagggccatcagcaagggcgaccagcacagggccacacaggagaagtttgcactggaggaggcacagcggcagcgggcccgtgagcggcaggagagcctcatgccctggaagccgcagctgttccacctggaccccatcacccaggagtggcactaccgatacgaggaccacagcccctgggaccccctgaaggacatcgcccagtttgagcaagacgggatcctgcggaccttgcagcaggaggccgtggcccgccagaccaccttcctgggcagcccagggcccaggcacgagaggtctggcccagaccagcggcttcgcaaggccagcgaccagccctccggccacagccaggccacggagagcagcggatccacgcctgagtcctgcccagagctctcagacgaggagcaggatggtgactttgtccctggcggtgagagcccatgccctcggtgcaggaaggaggcgcggcggctgcaggccctgcacgaggccatcctctccatccgagaggcccagcaggagctgcacaggcacctctcggccatgctgagctccacggcacgggcagcacaggcaccgaccccaggcctcctgcagagcccccgatcctggttcctgctctgcgtgttcctggcgtgtcagctgttcattaaccacatcctcaaataggagccctgagggcagagctcctggccggtcctgagccctccctcccaggcacccagcactttaagcctgctccatggaggcagagaggcccggcaagcacagccactgtgacggggagtccaggcgcaggagggacccggggccacaaggcgctgcgggcccaggtgtgctgggcccctctcaggggcactggcctctctgcagggccttccgcccagcgctggccttaatgctaaagccaaatgcagcttctgctgtgcgacgcactcctggccatcttgccgtgtcaccccctgtccggcctccacttgccatgggggatggatggatttagggtgggagggcctgtgggggccctggacagtcacaccccagcagcagtgagtgggcaggtttggaggagccccgagtggcccaggagtccccccacacacagatgcataggcctgccttccggagaccctgtccacattgccgggaccaccctggtggggccactggtgggtgccagggacaggttagggccactctggggaaggcattttggttttttattccacgctgtgctgtttggatgggagccccacagaggcaggtcctggaaccaccccacccccacacctggacgctcgctctggtgggggcacacgcaggtggaggtggttgtgggtgcaggtgtgtgcaggggtgtggggggcgcaggggtgtggcttagctggccccgcacccaggccggggaggctcaagttcgccactttactcagaccgatgcacagtcttcccattttacacttttttaataaacataattgcaatattttaggtgggctgcgagctgcagtcagccttcacgtctggcctcagtccccgtgtcagtgccgctctgcgtgtgcgtgtgcgcgtgtgtgagcctctacacatatatatacgtacagagccttaaaccacatcgtggcggtgccgtctgagctgtagcgggtggctttgtttccagtttttgtacccgtgtccttgtctcccctcctcccccatctggggatgtgtctgtgttccacaccttgaaataaacagacacatacgtgttctctt

SEQ ID NO: 21335 - DNA, 2798 bp, Homo sapiens
ctccctccgccgcgccctcgctccgcctcgcgcggggggaccatctgctggcatttcctgcagccaggcccgcgccgccagtggagcccccgcgcgcccggccggcccggagcaccgagctcgcggcacggtaggagaagcccccgagcgcccacagcatgaaggaggaggccttcctccggcgccgcttctccctgtgtccaccttcctccacccctcagaaagtcgacccccggaagctcacccggaacttgctcctcagcggagacaatgagctctacccactcagcccagggaaggacatggagcccaacggcccgtcgctgcccagggatgaagggcccccgaccccaagctctgccacgaaggtgccaccggcagagtacaggctgtgcaacgggtcagacaaggaatgtgtgtcccccaccgccagggtcaccaagaaggagactctcaaggcgcagaaggagaactaccggcaggagaagaagcgcgccacacggcagctgctcagcgctctgacagaccccagcgtggtcatcatggctgacagcctgaagggccccaaaggtgagagcgtgggctccatcacacagcccctgcccagcagctacctgatcttcagggccgcctccgagtcagatggtcgctgctggctggacgccctggagctggccctgcgctgctctagcctactgagactgggcacctgcaagccgggccgagacggggagccagggacctcgccagacgcatcaccctcatcgctctgtgggctgccagcctcagccaccgtccacccagaccaagacctgttcccactgaacgggtcttccctggagaacgatgcattctcagacaagtcggagagagagaaccctgaggagtcagataccgagacccaggaccatagccggaagacggagagtggcagcgaccagtcagagacccctggggccccggtgcggagagggaccacctatgtggagcaggtccaggaggagctgggggagctgggcgaggcgtcccaggtggagacagtgtcagaggagaacaagagtctgatgtggaccctgctgaagcagctacggccaggcatggacctgtcccgcgtggtgctacccacgttcgtactggagccgcgctccttcctgaacaagctctccgactactactaccacgcagacctgctctccagggctgcggtggaggaggatgcctacagccgcatgaagctggtgctgcggtggtacctgtctggcttctacaagaagcccaagggaatcaagaagccgtacaaccccatcctgggggagaccttccgctgctgctggttccacccgcagactgacagccgcacattctacatagcagagcaggtgtcccaccacccgcccgtgtctgccttccacgtcagcaaccggaaggacggcttctgcatcagtggcagcatcacagccaagtccaggttttatgggaactcgctgtcggcgctgctggacggcaaagccacgctcaccttcctgaaccgagccgaggattacacccttaccatgccctacgcccactgcaaaggaatcctgtatggcacgatgaccctggagctgggtgggaaggtcaccatcgagtgtgcgaagaacaacttccaggcccagctggaattcaaactcaagcccttcttcgggggtagcaccagcatcaaccagatctcgggaaagatcacgtcgggagaggaagtcctggcgagcctcagtggccactgggacagggacgtgtttatcaaggaggaagggagcggaagcagtgcgcttttctggaccccgagcggggaggtccgcagacagaggctgaggcagcacacggtgccgctggaggagcagacggagctggagtccgagaggctctggcagcacgtcaccagggccatcagcaagggcgaccagcacagggccacacaggagaagtttgcactggaggaggcacagcggcagcgggcccgtgagcggcaggagagcctcatgccctggaagccgcagctgttccacctggaccccatcacccaggagtggcactaccgatacgaggaccacagcccctgggaccccctgaaggacatcgcccagtttgagcaagacgggatcctgcggaccttgcagcaggaggccgtggcccgccagaccaccttcctgggcagcccagggcccaggcacgagaggtctggcccagaccagcggcttcgcaaggccagcgaccagccctccggccacagccaggccacggagagcagcggatccacgcctgagtcctgcccagagctctcagacgaggagcaggatggtgactttgtccctggcggtgagagcccatgccctcggtgcaggaaggaggcgcggcggctgcaggccctgcacgaggccatcctctccatccgagaggcccagcaggagctgcacaggcacctctcggccatgctgagctccacggcacgggcagcacaggcaccgaccccaggcctcctgcagagcccccgatcctggttcctgctctgcgtgttcctggcgtgtcagctgttcattaaccacatcctcaaataggagccctgagggcagagctcctggccggtcctgagccctccctcccaggcacccagcactttaagcctgctccatggaggcagagaggcccggcaagcacagccactgtgacggggagtccaggcgcaggagggacccggggccacaaggcgctgcgggcccaggtgtgctgggcccctctcaggggcactggcctctctgcag

SEQ ID NO: 21336 - DNA, 2621 bp, Homo sapiens
ctccctccgccgcgccctcgctccgcctcgcgcggggggaccatctgctggcatttcctgcagccaggcccgcgccgccagtggagcccccgcgcgcccggccggcccggagcaccgagctcgcggcacggtaggagaagcccccgagcgcccacagcatgaaggaggaggccttcctccggcgccgcttctccctgtgtccaccttcctccacccctcagaaagtcgacccccggaagctcacccggaacttgctcctcagcggagacaatgagctctacccactcagcccagggaaggacatggagcccaacggcccgtcgctgcccagggatgaagggcccccgaccccaagctctgccacgaaggtgccaccggcagagtacaggctgtgcaacgggtcagacaaggaatgtgtgtcccccaccgccagggtcaccaagaaggagactctcaaggcgcagaaggagaactaccggcaggagaagaagcgcgccacacggcagctgctcagcgctctgacagaccccagcgtggtcatcatggctgacagcctgaagatccgcggcaccctgaagagctggaccaagctgtggtgcgtgctgaagccgggggtgctgctcatctacaagacgcccaaggtgggccagtgggtgggcacggtgctgctgcactgctgcgagctcatcgagcggccctccaagaaggacggcttctgcttcaagctcttccacccgctggatcagtccgtctgggccgtgaagggccccaaaggtgagagcgtgggctccatcacacagcccctgcccagcagctacctgatcttcagggccgcctccgagtcagatggtcgctgctggctggacgccctggagctggccctgcgctgctctagcctactgagactgggcacctgcaagccgggccgagacggggagccagggacctcgccagacgcatcaccctcatcgctctgtgggctgccagcctcagccaccgtccacccagaccaagacctgttcccactgaacgggtcttccctggagaacgatgcattctcagacaagtcggagagagagaaccctgaggagtcagataccgagacccaggaccatagccggaagacggagagtggcagcgaccagtcagagacccctggggccccggtgcggagagggaccacctatgtggagcaggtccaggaggagctgggggagctgggcgaggcgtcccaggtggagacagtgtcagaggagaacaagagtctgatgtggaccctgctgaagcagctacggccaggcatggacctgtcccgcgtggtgctacccacgttcgtactggagccgcgctccttcctgaacaagctctccgactactactaccacgcagacctgctctccagggctgcggtggaggaggatgcctacagccgcatgaagctggtgctgcggtggtacctgtctggcttctacaagaagcccaagggaatcaagaagccgtacaaccccatcctgggggagaccttccgctgctgctggttccacccgcagactgacagccgcacattctacatagcagagcaggtgtcccaccacccgcccgtgtctgccttccacgtcagcaaccggaaggacggcttctgcatcagtggcagcatcacagccaagtccaggttttatgggaactcgctgtcggcgctgctggacggcaaagccacgctcaccttcctgaaccgagccgaggattacacccttaccatgccctacgcccactgcaaaggaatcctgtatggcacgatgaccctggagctgggtgggaaggtcaccatcgagtgtgcgaagaacaacttccaggcccagctggaattcaaactcaagcccttcttcgggggtagcaccagcatcaaccagatctcgggaaagatcacgtcgggagaggaagtcctggcgagcctcagtggccactgggacagggacgtgtttatcaaggaggaagggagcggaagcagtgcgcttttctggaccccgagcggggaggtccgcagacagaggctgaggcagcacacggtgccgctggaggagcagacggagctggagtccgagaggctctggcagcacgtcaccagggccatcagcaagggcgaccagcacagggccacacaggagaagtttgcactggaggaggcacagcggcagcgggcccgtgagcggcaggagagcctcatgccctggaagccgcagctgttccacctggaccccatcacccaggagtggcactaccgatacgaggaccacagcccctgggaccccctgaaggacatcgcccagtttgagcaagacgggatcctgcggaccttgcagcaggaggccgtggcccgccagaccaccttcctgggcagcccagggcccaggcacgagaggtctggcccagaccagcggcttcgcaaggccagcgaccagccctccggccacagccaggccacggagagcagcggatccacgcctgagtcctgcccagagctccacggcacgggcagcacaggcaccgaccccaggcctcctgcagagcccccgatcctggttcctgctctgcgtgttcctggcgtgtcagctgttcattaa

SEQ ID NO: 21337 - DNA, 3619 bp, Homo sapiens
atttcctgcagccaggcccgcgccgccagtggagcccccgcgcgcccggccggcccggagcaccgagctcgcggcacgaagcccccgagcgcccacagcatgaaggaggaggccttcctccggcgccgcttctccctgtgtccaccttcctccacccctcagaaagtcgacccccggaagctcacccggaacttgctcctcagcggagacaatgagctctacccactcagcccagggaaggacatggagcccaacggcccgtcgctgcccagggatgaagggcccccgaccccaagctctgccacgaaggtgccaccggcagagtacaggctgtgcaacgggtcagacaaggaatgtgtgtcccccaccgccagggtcaccaagaaggagactctcaaggcgcagaaggagaactaccggcaggagaagaagcgcgccacacggcagctgctcagcgctctgacagaccccagcgtggtcatcatggctgacagcctgaagggccccaaaggtgagagcgtgggctccatcacacagcccctgcccagcagctacctgatcttcagggccgcctccgagtcagatggtcgctgctggctggacgccctggagctggccctgcgctgctctagcctactgagactgggcacctgcaagccgggccgagacggggagccagggacctcgccagacgcatcaccctcatcgctctgtgggctgccagcctcagccaccgtccacccagaccaagacctgttcccactgaacgggtcttccctggagaacgatgcattctcagacaagtcggagagagagaaccctgaggagtcagataccgagacccaggaccatagccggaagacggagagtggcagcgaccagtcagagacccctggggccccggtgcggagagggaccacctatgtggagcaggtccaggaggagctgggggagctgggcgaggcgtcccaggtggagacagtgtcagaggagaacaagagtctgatgtggaccctgctgaagcagctacggccaggcatggacctgtcccgcgtggtgctacccacgttcgtactggagccgcgctccttcctgaacaagctctccgactactactaccacgcagacctgctctccagggctgcggtggaggaggatgcctacagccgcatgaagctggtgctgcggtggtacctgtctggcttctacaagaagcccaagggaatcaagaagccgtacaaccccatcctgggggagaccttccgctgctgctggttccacccgcagactgacagccgcacattctacatagcagagcaggtgtcccaccacccgcccgtgtctgccttccacgtcagcaaccggaaggacggcttctgcatcagtggcagcatcacagccaagtccaggttttatgggaactcgctgtcggcgctgctggacggcaaagccacgctcaccttcctgaaccgagccgaggattacacccttaccatgccctacgcccactgcaaaggaatcctgtatggcacgatgaccctggagctgggtgggaaggtcaccatcgagtgtgcgaagaacaacttccaggcccagctggaattcaaactcaagcccttcttcgggggtagcaccagcatcaaccagatctcgggaaagatcacgtcgggagaggaagtcctggcgagcctcagtggccactgggacagggacgtgtttatcaaggaggaagggagcggaagcagtgcgcttttctggaccccgagcggggaggtccgcagacagaggctgaggcagcacacggtgccgctggaggagcagacggagctggagtccgagaggctctggcagcacgtcaccagggccatcagcaagggcgaccagcacagggccacacaggagaagtttgcactggaggaggcacagcggcagcgggcccgtgagcggcaggagagcctcatgccctggaagccgcagctgttccacctggaccccatcacccaggagtggcactaccgatacgaggaccacagcccctgggaccccctgaaggacatcgcccagtttgagcaagacgggatcctgcggaccttgcagcaggaggccgtggcccgccagaccaccttcctgggcagcccagggcccaggcacgagaggtctggcccagaccagcggcttcgcaaggccagcgaccagccctccggccacagccaggccacggagagcagcggatccacgcctgagtcctgcccagagctctcagacgaggagcaggatggtgactttgtccctggcggtgagagcccatgccctcggtgcaggaaggaggcgcggcggctgcaggccctgcacgaggccatcctctccatccgagaggcccagcaggagctgcacaggcacctctcggccatgctgagctccacggcacgggcagcacaggcaccgaccccaggcctcctgcagagcccccgatcctggttcctgctctgcgtgttcctggcgtgtcagctgttcattaaccacatcctcaaataggagccctgagggcagagctcctggccggtcctgagccctccctcccaggcacccagcactttaagcctgctccatggaggcagagaggcccggcaagcacagccactgtgacggggagtccaggcgcaggagggacccggggccacaaggcgctgcgggcccaggtgtgctgggcccctctcaggggcactggcctctctgcagggccttccgcccagcgctggccttaatgctaaagccaaatgcagcttctgctgtgcgacgcactcctggccatcttgccgtgtcaccccctgtccggcctccacttgccatgggggatggatggatttagggtgggagggcctgtgggggccctggacagtcacaccccagcagcagtgagtgggcaggtttggaggagccccgagtggcccaggagtccccccacacacagatgcataggcctgccttccggagaccctgtccacattgccgggaccaccctggtggggccactggtgggtgccagggacaggttagggccactctggggaaggcattttggttttttattccacgctgtgctgtttggatgggagccccacagaggcaggtcctggaaccaccccacccccacacctggacgctcgctctggtgggggcacacgcaggtggaggtggttgtgggtgcaggtgtgtgcaggggtgtggggggcgcaggggtgtggcttagctggccccgcacccaggccggggaggctcaagttcgccactttactcagaccgatgcacagtcttcccattttacacttttttaataaacataattgcaatattttaggtgggctgcgagctgcagtcagccttcacgtctggcctcagtccccgtgtcagtgccgctctgcgtgtgcgtgtgcgcgtgtgtgagcctctacacatatatatacgtacagagccttaaaccacatcgtggcggtgccgtctgagctgtagcgggtggctttgtttccagtttttgtacccgtgtccttgtctcccctcctcccccatctggggatgtgtctgtgttccacaccttgaaataaacagacacatacgtgtt

SEQ ID NO: 21338 - DNA, 554 bp, Homo sapiens
tgaccacccaccaccaggctcccagggcccaggccctcctcaccctgcctcagaagtcccctgagagggggacttcttagccaggggcacccccaccatgtggctctgaagccccttccggggcggtgacctcctgctgcccctccttccttccttccagaagcccccgagcgcccacagcatgaaggaggaggccttcctccggcgccgcttctccctgtgtccaccttcctccacccctcagaaagtcgacccccggaagctcacccggaacttgctcctcagcggagacaatgagctctacccactcagcccagggaaggacatggagcccaacggcccgtcgctgcccagggatgaagggcccccgaccccaagctctgccacgaaggtgccaccggcagagtacaggctgtgcaacgggtcagacaaggaatgtgtgtcccccaccgccagggtcaccaagaaggagactctcaaggcgcagaaggagaactaccggcaggagaagaagcgcgccacacggcagctgctcagcgctctgacagacccca

SEQ ID NO: 21339 - DNA, 575 bp, Homo sapiens
agcacataaggggcagggacaacgggctcagatgtctggggctcctcttgtgttctgatggctcctgagacggggagaaacggcgacagtttcctgggttcaggaagggagaggaggcgcctcgcaccctggctagggtgggctgggggcctgcacccctaagttggagaaccccacgaagctgaccccactcaccgctgcccaccccgccaagcctcctggccattttcagcggagtgtcccgacctctggccgcccggaagcccccgagcgcccacagcatgaaggaggaggccttcctccggcgccgcttctccctgtgtccaccttcctccacccctcagaaagtcgacccccggaagctcacccggaacttgctcctcagcggagacaatgagctctacccactcagcccagggaaggacatggagcccaacggcccgtcgctgcccagggatgaagggcccccgaccccaagctctgccacgaaggtgccaccggcagagtacaggctgtgcaacgggtcagacaaggaatgtgtgtcccccaccgccagggtcaccaagaaggagact

SEQ ID NO: 21340 - DNA, 554 bp, Homo sapiens
ctcgctccgcctcgcgcggggggaccatctgctggcatttcctgcagccaggcccgcgccgccagtggagcccccgcgcgcccggccggcccggagcaccgagctcgcggcacgaagcccccgagcgcccacagcatgaaggaggaggccttcctccggcgccgcttctccctgtgtccaccttcctccacccctcagaaagtcgacccccggaagctcacccggaacttgctcctcagcggagacaatgagctctacccactcagcccagggaaggacatggagcccaacggcccgtcgctgcccagggatgaagggcccccgaccccaagctctgccacgaaggtgccaccggcagagtacaggctgtgcaacgggtcagacaaggaatgtgtgtcccccaccgccagggtcaccaagaaggagactctcaaggcgcagaaggagaactaccggcaggagaagaagcgcgccacacggcagctgctcagcgctctgacagaccccagcgtggtcatcatggctgacagcctgaagatccgcggcaccctgaa

SEQ ID NO: 21341 - DNA, 774 bp, Homo sapiens
agaccgctgggctgcctcctgtcagaagccaactggagttagggtttggggtgactcctgggggtatggaggggtcacagggtgggcttacctgcccctccctcgtccctgggctgagcccagcccctccctcatccttgggctgagcgggtctgccccgccgaagcggctgggtggatttcctctcttgccgtttcgcaacttgctcccctctgtgtgtctgccccagtctcttcaaggtgccttttacaggaagacttctgtaagggtcccaccccacctgatacagcctcccaaagcctggagaagtgggccagcctttgggatcctagatagatgctcttgggtctgcctgcaccagggctgatccagatcccagactgaacagaaactctgctccccaaccccaggagtaaggcccctctgcacgtttttatcccacctccttggtacacagggccttgctgttccttgaacctgccagaagcccccgagcgcccacagcatgaaggaggaggccttcctccggcgccgcttctccctgtgtccaccttcctccacccctcagaaagtcgacccccggaagctcacccggaacttgctcctcagcggagacaatgagctctacccactcagcccagggaaggacatggagcccaacggcccgtcgctgcccagggatgaagggcccccgaccccaagctctgccacgaaggtgccaccggcagagtacaggctgtgcaacgggtcagacaaggaatgtgtgtcccccac

SEQ ID NO: 21342 - DNA, 706 bp, Homo sapiens
atttcctccatgctctaggatgggaaggacaagagggcgtgactcttcccagagtcccatcatctctgatttaggaatggagcccttagggtgtctcacctcctcgggatgcctaatagtgtgtttggtgaatgcagatggacttaactggtccatagatcccctctcaccctgctgacacgaagacaaggatgaaggggaaagttgaggctcaacaactgaacagtattccttctaaatatgtacattcttagggattttaagtggaaaacagggaggagatttgagggataccccacctcggcaggcagctggtcaggctgcctgttgtgaccagcctggggtcgccttcccttcatccaaggccaggggagatggcaaaccttcagtaagcgctgccgtacctggcagagcagaagcaccaccccagcttggagacagcatgcccctgactgctggtcacggatggccccttgaagcccccgagcgcccacagcatgaaggaggaggccttcctccggcgccgcttctccctgtgtccaccttcctccacccctcagaaagtcgacccccggaagctcacccggaacttgctcctcagcggagacaatgagctctacccactcagcccagggaaggacatggagcccaacggcccgtcgctgcccagggatgaagggcccccgaccccaagctctgccacgaa

SEQ ID NO: 21343 - DNA, 1731 bp, Homo sapiens
tacaaccccatcctgggggagaccttccgctgctgctggttccacccgcagactgacagccgcacattctacatagcagagcaggtgtcccaccacccgcccgtgtctgccttccacgtcagcaaccggaaggacggcttctgcatcagtggcagcatcacagccaagtccaggttttatgggaactcgctgtcggcgctgctggacggcaaagccacgctcaccttcctgaaccgagccgaggattacacccttaccatgccctacgcccactgcaaaggaatcctgtatggcacgatgaccctggagctgggtgggaaggtcaccatcgagtgtgcgaagaacaacttccaggcccagctggaattcaaactcaagcccttcttcgggggtagcaccagcatcaaccagatctcgggaaagatcacgtcgggagaggaagtcctggcgagcctcagtggccactgggacagggacgtgtttatcaaggaggaagggagcggaagcagtgcgcttttctggaccccgagcggggaggtccgcagacagaggctgaggcagcacacggtgccgctggaggagcagacggagctggagtccgagaggctctggcagcacgtcaccagggccatcagcaagggcgaccagcacagggccacacaggagaagtttgcactggaggaggcacagcggcagcgggcccgtgagcggcaggagagcctcatgccctggaagccgcagctgttccacctggaccccatcacccaggagtggcactaccgatacgaggaccacagcccctgggaccccctgaaggacatcgcccagtttgagcaagacgggatcctgcggaccttgcagcaggaggccgtggcccgccagaccaccttcctgggcagcccagggcccaggcacgagaggtctggcccagaccagcggcttcgcaaggccagcgaccagccctccggccacagccaggccacggagagcagcggatccacgcctgagtcctgcccagagctctcagacgaggagcaggatggtgactttgtccctggcggtgagagcccatgccctcggtgcaggaaggaggcgcggcggctgcaggccctgcacgaggccatcctctccatccgagaggcccagcaggagctgcacaggcacctctcggccatgctgagctccacggcacgggcagcacaggcaccgaccccaggcctcctgcagagcccccgatcctggttcctgctctgcgtgttcctggcgtgtcagctgttcattaaccacatcctcaaataggagccctgagggcagagctcctggccgtccccccacacacagatgcataggcctgccttccggagaccctgtccacattgccgggaccaccctggtggggccactggtgggtgccagggacaggttagggccactctggggaaggcattttggttttttattccacgctgtgctgtttggatgggagccccacagaggcaggtcctggaaccaccccacccccacacctggacgctcgctctggtgggggcacacgcaggtggaggtggttgtgggtgcaggtgtgtgcaggggtgtggggggcgcaggggtgtggcttagctggccccgcacccaggccggggaggctcaagttcgccactttactcagaccgatgcacagtcttcccattttacacttttttaataaacataattgcaatattttaggtg

SEQ ID NO: 21344 - DNA, 2182 bp, Homo sapiens
atttcctgcagccaggcccgcgccgccagtggagcccccgcgcgcccggccggcccggagcaccgagctcgcggcacggtaggagaagcccccgagcgcccacagcatgaaggaggaggccttcctccggcgccgcttctccctgtgtccaccttcctccacccctcagaaagtcgacccccggaagctcacccggaacttgctcctcagcggagacaatgagctctacccactcagcccagggaaggacatggagcccaacggcccgtcgctgcccagggatgaagggcccccgaccccaagctctgccacgaaggtgccaccggcagagtacaggctgtgcaacgggtcagacaaggaatgtgtgtcccccaccgccagggtcaccaagaaggagactctcaaggcgcagaaggagaactaccggcaggagaagaaccgcgctccttcctgaacaagctctccgactactactaccacgcagacctgctctccagggctgcggtggaggaggatgcctacagccgcatgaagctggtgctgcggtggtacctgtctggcttctacaagaagcccaagggaatcaagaagccgtacaaccccatcctgggggagaccttccgctgctgctggttccacccgcagactgacagccgcacattctacatagcagagcaggtgtcccaccacccgcccgtgtctgccttccacgtcagcaaccggaaggacggcttctgcatcagtggcagcatcacagccaagtccaggttttatgggaactcgctgtcggcgctgctggacggcaaagccacgctcaccttcctgaaccgagccgaggattacacccttaccatgccctacgcccactgcaaaggaatcctgtatggcacgatgaccctggagctgggtgggaaggtcaccatcgagtgtgcgaagaacaacttccaggcccagctggaattcaaactcaagcccttcttcgggggtagcaccagcatcaaccagatctcgggaaagatcacgtcgggagaggaagtcctggcgagcctcagtggccactgggacagggacgtgtttatcaaggaggaagggagcggaagcagtgcgcttttctggaccccgagcggggaggtccgcagacagaggctgaggcagcacacggtgccgctggaggagcagacggagctggagtccgagaggctctggcagcacgtcaccagggccatcagcaagggcgaccagcacagggccacacaggagaagtttgcactggaggaggcacagcggcagcgggcccgtgagcggcaggagagcctcatgccctggaagccgcagctgttccacctggaccccatcacccaggagtggcactaccgatacgaggaccacagcccctgggaccccctgaaggacatcgcccagtttgagcaagacgggatcctgcggaccttgcagcaggaggccgtggcccgccagaccaccttcctgggcagcccagggcccaggcacgagaggtctggcccagaccagcggcttcgcaaggccagcgaccagccctccggccacagccaggccacggagagcagcggatccacgcctgagtcctgcccagagctctcagacgaggagcaggatggtgactttgtccctggcggtgagagcccatgccctcggtgcaggaaggaggcgcggcggctgcaggccctgcacgaggccatcctctccatccgagaggcccagcaggagctgcacaggcacctctcggccatgctgagctccacggcacgggcagcacaggcaccgaccccaggcctcctgcagagcccccgatcctggttcctgctctgcgtgttcctggcgtgtcagctgttcattaaccacatcctcaaataggagccctgagggcagagctcctggccggtcctgagccctccctcccaggcacccagcactttaagcctgctccatggaggcagagaggcccggcaagcacagccactgtgacggggagtccaggcgcaggagggacccggggccacaaggcgctgcgggcccaggtgtgctgggcccctctcaggggcactggcctctctgcagggccttccgcccagcgctggccttaatgctaaagccaaatgcagcttctgctgtgcgacgcactcctggccatcttgccgtgtca

SEQ ID NO: 21345 - DNA, 7055 bp, Homo sapiens
ccgcggcgccaccgctcgccctccaggttctgccacttgctgggaaaacagcaacagaaggatattaaggagccacccctataatttacccagatagccccagcaaggtcaaagacatatcatgtcccaaggagaaaagctgcaggcatctgaggataaatcactgtgaaacagctttgaccataaagctgacttggaagactttgactccaaggtgcaaggtggtttggacaccctcaatattgcctgctcttttctagtcaaacctgattcatgaaatggaatgaagctgaaaaatcatctacttctttgtttgtggatttgagagaagattgggatggtcttaagtgcataaaacgagactctaactgcagcgatgagttcagatgagaagggcatttcccctgctcataaaacatccactccaacccatagaagtgcctcctcttcaacatcctcccaaagggacagtaggcagagtattcacatactggagaggactgcttcctctagcaccgagccctctgtaagtcggcaattgctagaaccggagccagtccccctctccaaggaagctgacagctgggaaattatagaagggctgaaaataggccaaaccaatgtccagaaaccagacaaacatgagggctttatgctgaagaaaagaaaatggcctttaaaaggctggcacaagcgtttttttgtcctggataatggaatgttaaagtattcaaaggcaccactcgatattcagaaaggaaaggtccatgggagcatagatgtgggactctcagtcatgtcaattaaaaagaaagctcgaagaatagaccttgacaccgaagagcacatctatcatttgaaggtgaaatcccaggactggtttgatgcatgggtctccaaactgcgacatcatcggttgtatcgtcagaatgaaattgtgagatcaccaagagatgctagttttcacatatttccttcaacgtccacagctgaatcctcaccagctgctaatgtttctgtaatggatggaaagatgcaaccaaacagctttccgtggcagtcccctttaccatgcagcaatagcctccctgcaacgtgcacaactggccagagtaaagtggcagcctggttacaggactcggaagagatggacaggtgtgcagaagatcttgcacattgccagtcaaaccttgtggaacttagcaaactcctgcaaaatttggaaatacttcagagaactcagtcggcacctaactttactgacatgcaggctaactgtgtagatatttcaaagaaagacaagcgggtcacaagacgatggagaacaaaaagtgtcagcaaagatacaaaaatacaactgcaggttcctttcagtgctaccatgtcaccagttcgcttgcattcctccaaccccaacctttgtgcagatattgaatttcagactccccctagccacctcactgaccctctggaaagttcaacagattatacaaagctgcaagaagaattttgtctaatcgcacagaaagtgcattctcttttgaagtctgcatttaatagcatagctatagagaaggagaagctgaagcagatggtttccgagcaggatcacagtaaaggccacagcacgcagatggcacggctccgacagtcactgtctcaggcactcaaccagaatgctgaactaaggagtcggttgaacagaatacattcagagtctattatttgtgatcaggttgtcagtgtaaatattattcctagccctgatgaggctggtgagcaaatccatgtcagtctccccttatcacagcaagtagccaatgagagccgcctctccatgtcagagtctgtttctgagttctttgatgcccaagaggtgctcctctctgcaagttcgtcagagaatgaggcttcagatgatgagtcttacatcagtgatgtgagtgataatatatctgaagacaacaccagtgttgcagacaatatttctcggcaaatcctgaatggggagcttacaggaggggccttccgaaatgggcgtcgagcatgcctgccagctccttgtcctgacaccagtaacattaacctgtggaatatcttgaggaacaacattggtaaagacctgtctaaagtctctatgcctgtggagctaaacgagccgctcaacaccctgcagcacctctgtgaggaaatggaatacagcgagctcctggacaaggcttcggaaactgatgatccatatgagcgcatggttctcgttgccgcatttgcagtttcaggatactgctccacctatttcagagcaggaagtaagccattcaacccagtccttggggagacttatgaatgcattagagaagacaagggattccgctttttctcagaacaggttagccatcatccacccatttctgcctgtcactgtgaatcaaagaattttgtgttttggcaagatatcagatggaaaaacaagttctgggggaagtcgatggaaatcctgcctgttggaacactgaatgtcatgcttccaaagtatggagattactatgtgtggaataaagtcaccacttgcatacacaacatcctcagtgggagaagatggatagaacattatggagaagtaaccatcagaaataccaaaagcagtgtttgcatttgcaaactcacatttgtcaaggtgaattattggaattctaacatgaatgaagtccagggggtggtgatagatcaggaggggaaggcggtgtaccggctgtttggaaagtggcatgaaggactctactgtggtgtggccccctctgcaaagtgcatttggagaccaggttccatgccaacaaactatgagctgtactatggcttcacaaggtttgctattgagctcaatgagttagatccagtactaaaagatctccttccaccaacagacgcccggttccggccagatcaaagatttttggaagaaggaaatttagaagctgcagcatcagagaagcaaagagtagaggaactccagagatctcggagacgatatatggaagaaaacaatcttgaacatataccaaaattttttaaaaaagttattgatgccaatcaaagagaagcctgggtttctaacgacacctactgggagcttcgaaaggaccctgggtttagcaaagtagacagccctgttctttggtagactgggaatgtagagctagccaacatatcacattctgaatgaataaataactatgcacaattatgtttcttatagctatgtgtggtttctgggtcaactgaaaacctaccatttgcttttctattcatctttataatggactttcagaagtgcattagacaaggcccctaaccactttgggatcctttctgttttgctgcaaccatattccttaaaaaaaaaaaaaaaaaaaaaaaaaaaatccacaccgtccttggaaagcagaataaaaggagcagaatataaaatccaaagtctgaccagtttgtaaagaaaaacaaatggtaactggtgcttaaagctgatcaagaaagttaacaacaacatagaaaccacacgattgttccactgtctggaagcaccatcccctatcgcaggactcctgggccacaagcagtcggtcagtgcagacttcaagtgtgtctgtttgatgtggtgtgattgtgctggccttgtcgaaaaagatgtgatgcttctcagaacctgttccatctgtatgccattgttcatgccttaagaaatgcaaagatgtacaataaatcatttttaaaatgtgtgctcataggtttatgtgaagaacagattttttgaatcatggcatgattcactttctcaatcaggacaattatgagactaacttaaatgggttttttaaaagtgaacaacacgtgctttactctgataagtcagttaccatatggtatgtctgaagggaaagaaggaaaagacgtgctaagtagatctctgtatttacgtggctcgttaatttcctgtcctgcgtccagataataaaccatccctcttccacctaacctcacagtgtgccctattatttggaaaaatctgtctttgatttggacatttggtcatcagtgttaaaaccttaaaaggaaataacaaaaagcatatggaattcctgtgtgggcttagtagtactataaatgtaattgtttttgagtgaagcaccatgtaatccatgtctcaatcccatgcccgctccactgacactagtcgaattccactgagaacagaagcaagaataatagtagtttatttgcattgtttaaatgaattctatgcaaaatcatatttcaaattttcatcaagtgattccatatggtacatggctacatattaagcatttaccttgctattggcagagatatgaaacttaagctaaggaatgtatccatcccaaagcaggaaagcagaagtgtgttttgcatacttcaggatttgtttttcctccactaatatacagaggcttttgcagaaaacttgcatcagtattcctgtttctgcacgtaggtgactatataaatgcctgtatgttttttttaaaatatctcctcagagattttcctagggaattataaaattacatatattttattgttagttagatgtttattcttggattcttaccattagaatttaagtgttatttaaaactctgatacagttacagacactttacattttattatgaggtgttgattttagtggtatttctcctcagcaaagcattcctaataatggctaatacaccatcaaatgaaaaactgctgatgagagtgtaagagaaagcgctaacgtttccactagatggcgcaatattttatttatccaaaactcctcccttgcatctgagtttttatgttatgtgtacagtctgcattagcttagaatggaatttcattctcaggtaaattttcgaatccatcaccagatctaagcattctgcttcaacaataccctctctattcctctcattcccattttaaatccataggtggcttgccctgcggcagtaaaatcttccccttgatattgattctttttctgctcattcatcttgatgttctttttctgcatcctgagatacatgtcgttaattttaataagaatcctattgacttcctcacgggagtctgttctcctatggttgataaagctttaaatactatttaaagtggttctggtctgtacttactagcacttccctgaacagtctcaaaatagcctaaacataagaaaacaatcctgcaaagtaaaggtttttacaagcagagatgaaggaaagggagcagcagctgaccatcagatgtggtatcaggtagctggaagaggatccaggacccatcagggaagcaacgactgtacttagcaatttgggttataattacaaaaaagaaaaaatagtagaaaggatctttaccagacagtaaggtcatggtacaaatcaggtgagtgaatgttggtcagaggtagcctgacactctgatgaggacttcaagatgagaatgagaaaaatgtctattaaaatcactacatttgataatatctcagatttagaatctcttttgggattcagatagtctgattattccaattcaagtgttcagttaagttttagttactattcctataatacccaattcactaatatcatatctcctgtggaatattcattggtgcgatggcctcatccccttttttactttttattgacatggtggttataaaatgaagagacttactctattggaattttcatctacgtagtatttgggctgtcaagactaaatagcaaaagggtagaatattagatcattctcttaataagacctgatttattccttaggatgttatacaaacctttttatttcaggcctactttcttgttttttcctaaaaggatctaggatagaggagaacataatatgcctgtatacttctcccatggtttattcataagctgcttcatctcattggagatggtcattgaggagagcagtaataagtgacgatgattctgaggacttggctagactgagcggatcaatggcacacaccagcactggtagaggctgaccagaagctcatcgattccatatgctgtcacccagggtgcagatttactctcttttgctgttattttattgtttttcttaaattaagccattgtttttcatggattatttttaaaatacctaccccataattttcaggcaattgtaaaaataaaccttatttaagataacttttaatggtacatatcaactatatgtggggaaaaaatgcaattttctgggcaagagaaaccaaaggattttcaatatatgagatgccaggttgtcaattttctaaaccttttcctctagattattctggccctaggcctttcagcaaccccactaatcaattattagatcctgccccaaggagcagtggcttgggggctggatttagggaggaaaacctgattaaactgttttgcttagtactggttacagctgtagctggagaagagtttataatcataaagtacatttttgttattaccttgtggattttaattatccatcttgtctaatcttgttctctgtcatcctagataatgaggtgtttgtgggagcagagctctgcacacaccaggggatgtaataaatgtttgcacttggcccagtatattatgaatgtggcacagtaaataaagtttgtgtacaaaatactagtttatttctatgggagccattatgttcaggatatataaaatgtatctaattaaacaattttgaatctattttgtgctctagaaatgttcttttggggaaagatggaaagaaatgtataaatggagttaagattaaagtatttggggttttttttccccaaaagcttcccagttgtttagaaataatactatccaaagtaggattcggtcctgtaagtcctaactgaatttcttttgtaaaactgatacgtttaaactgtacattgcataatcattctgttaaactaaacctttgtttaatacataattgtaagagca

SEQ ID NO: 21346 - DNA, 2999 bp, Homo sapiens
tttccacttgctgctcaggaggtattgagatcaatgaacactaacctgaggagcatatttttaccaaattaaagagctacagtgaaatatgtgttccaggttcctggttttaagctaaatatgcatcagttatctctgatcaggggaaacagagggcggagtattcacatactggagaggactgcttcctctagcaccgagccctctgtaagtcggcaattgctagaaccggagccagtccccctctccaaggaagctgacagctgggaaattatagaagggctgaaaataggccaaaccaatgtccagaaaccagacaaacatgagggctttatgctgaagaaaagaaaatggcctttaaaaggctggcacaagcgtttttttgtcctggataatggaatgttaaagtattcaaaggcaccactcgatattcagaaaggaaaggtccatgggagcatagatgtgggactctcagtcatgtcaattaaaaagaaagctcgaagaatagaccttgacaccgaagagcacatctatcatttgaaggtgaaatcccaggactggtttgatgcatgggtctccaaactgcgacatcatcggttgtatcgtcagaatgaaattgtgagatcaccaagagatgctagttttcacatatttccttcaacgtccacagctgaatcctcaccagctgctaatgtttctgtaatggatggaaagatgcaaccaaacagctttccgtggcagtcccctttaccatgcagcaatagcctccctgcaacgtgcacaactggccagagtaaagtggcagcctggttacaggactcggaagagatggacaggtgtgcagaagatcttgcacattgccagtcaaaccttgtggaacttagcaaactcctgcaaaatttggaaatacttcagagaactcagtcggcacctaactttactgacatgcaggctaactgtgtagatatttcaaagaaagacaagcgggtcacaagacgatggagaacaaaaagtgtcagcaaagatacaaaaatacaactgcaggaagggccacccgcgaagggccagttcagcacaactcggcgccggcagaggctagcggcagcagtggctacaacagttcctttcagtgctaccatgtcaccagttcgcttgcattcctccaaccccaacctttgtgcagatattgaatttcagactccccctagccacctcactgaccctctggaaagttcaacagattatacaaagctgcaagaagaattttgtctaatcgcacagaaagtgcattctcttttgaagtctgcatttaatagcatagctatagagaaggagaagctgaagcagatggtttccgagcaggatcacagtaaaggccacagcacgcagatggcacggctccgacagtcactgtctcaggcactcaaccagaatgctgaactaaggagtcggttgaacagaatacattcagagtctattatttgtgatcaggttgtcagtgtaaatattattcctagccctgatgaggctggtgagcaaatccatgtcagtctccccttatcacagcaagtagccaatgagagccgcctctccatgtcagagtctgtttctgagttctttgatgcccaagaggtgctcctctctgcaagttcgtcagagaatgaggcttcagatgatgagtcttacatcagtgatgtgagtgataatatatctgaagacaacaccagtgttgcagacaatatttctcggcaaatcctgaatggggagcttacaggaggggccttccgaaatgggcgtcgagcatgcctgccagctccttgtcctgacaccagtaacattaacctgtggaatatcttgaggaacaacattggtaaagacctgtctaaagtctctatgcctgtggagctaaacgagccgctcaacaccctgcagcacctctgtgaggaaatggaatacagcgagctcctggacaaggcttcggaaactgatgatccatatgagcgcatggttctcgttgccgcatttgcagtttcaggatactgctccacctatttcagagcaggaagtaagccattcaacccagtccttggggagacttatgaatgcattagagaagacaagggattccgctttttctcagaacaggttagccatcatccacccatttctgcctgtcactgtgaatcaaagaattttgtgttttggcaagatatcagatggaaaaacaagttctgggggaagtcgatggaaatcctgcctgttggaacactgaatgtcatgcttccaaagtatggagattactatgtgtggaataaagtcaccacttgcatacacaacatcctcagtgggagaagatggatagaacattatggagaagtaaccatcagaaataccaaaagcagtgtttgcatttgcaaactcacatttgtcaaggtgaattattggaattctaacatgaatgaagtccagggggtggtgatagatcaggaggggaaggcggtgtaccggctgtttggaaagtggcatgaaggactctactgtggtgtggccccctctgcaaagtgcatttggagaccaggttccatgccaacaaactatgagctgtactatggcttcacaaggtttgctattgagctcaatgagttagatccagtactaaaagatctccttccaccaacagacgcccggttccggccagatcaaagatttttggaagaaggaaatttagaagctgcagcatcagagaagcaaagagtagaggaactccagagatctcggagacgatatatggaagaaaacaatcttgaacatataccaaaattttttaaaaaagttattgatgccaatcaaagagaagcctgggtttctaacgacacctactgggagcttcgaaaggaccctgggtttagcaaagtagacagccctgttctttggtagactgggaatgtagagctagccaacatatcacattctgaatgaataaataactatgcacaatt

SEQ ID NO: 21347 - DNA, 3454 bp, Homo sapiens
ctggaggcgcagcacggtcgccgccgccgctgtcggtgctggagatcgcggctcggtgcaggcggcgcccatgcctcctctcctccactagcccgcgcgccagtccgcctgccggggccggctctccgcctcctgcctcccgtcgcagccgcgcagccgccgcagagtccgcggcgccaccgctcgccctccaggttctgccacttgctgggaaaacagcaacagaaggatattaaggagccacccctataatttacccagatagccccagcaaggtcaaagacatatcatgtcccaaggagaaaagctgcaggcatctgaggataaatcactgtgaaacagctttgaccataaagctgacttggaagactttgactccaaggtgcaaggtggtttggacaccctcaatattgcctgctcttttctagtcaaacctgattcatgaaatggaatgaagctgaaaaatcatctacttctttgtttgtggatttgagagaagattgggatggtcttaagtgcataaaacgagactctaactgcagcgatgagttcagatgagaagggcatttcccctgctcataaaacatccactccaacccatagaagtgcctcctcttcaacatcctcccaaagggacagtaggcagagtattcacatactggagaggactgcttcctctagcaccgagccctctgtaagtcggcaattgctagaaccggagccagtccccctctccaaggaagctgacagctgggaaattatagaagggctgaaaataggccaaaccaatgtccagaaaccagacaaacatgagggctttatgctgaagaaaagaaaatggcctttaaaaggctggcacaagcgtttttttgtcctggataatggaatgttaaagtattcaaaggcaccactcgatattcagaaaggaaaggtccatgggagcatagatgtgggactctcagtcatgtcaattaaaaagaaagctcgaagaatagaccttgacaccgaagagcacatctatcatttgaaggtgaaatcccaggactggtttgatgcatgggtctccaaactgcgacatcatcggttgtatcgtcagaatgaaattgtgagatcaccaagagatgctagttttcacatatttccttcaacgtccacagctgaatcctcaccagctgctaatgtttctgtaatggatggaaagatgcaaccaaacagctttccgtggcagtcccctttaccatgcagcaatagcctccctgcaacgtgcacaactggccagagtaaagtggcagcctggttacaggactcggaagagatggacaggtgtgcagaagatcttgcacattgccagtcaaaccttgtggaacttagcaaactcctgcaaaatttggaaatacttcagagaactcagtcggcacctaactttactgacatgcaggctaactgtgtagatatttcaaagaaagacaagcgggtcacaagacgatggagaacaaaaagtgtcagcaaagatacaaaaatacaactgcaggttcctttcagtgctaccatgtcaccagttcgcttgcattcctccaaccccaacctttgtgcagatattgaatttcagactccccctagccacctcactgaccctctggaaagttcaacagattatacaaagctgcaagaagaattttgtctaatcgcacagaaagtgcattctcttttgaagtctgcatttaatagcatagctatagagaaggagaagctgaagcagatggtttccgagcaggatcacagtaaaggccacagcacgcagatggcacggctccgacagtcactgtctcaggctggtgagcaaatccatgtcagtctccccttatcacagcaagtagccaatgagagccgcctctccatgtcagagtctgtttctgagttctttgatgcccaagaggtgctcctctctgcaagttcgtcagagaatgaggcttcagatgatgagtcttacatcagtgatgtgagtgataatatatctgaagacaacaccagtgttgcagacaatatttctcggcaaatcctgaatggggagcttacaggaggggccttccgaaatgggcgtcgagcatgcctgccagctccttgtcctgacaccagtaacattaacctgtggaatatcttgaggaacaacattggtaaagacctgtctaaagtctctatgcctgtggagctaaacgagccgctcaacaccctgcagcacctctgtgaggaaatggaatacagcgagctcctggacaaggcttcggaaactgatgatccatatgagcgcatggttctcgttgccgcatttgcagtttcaggatactgctccacctatttcagagcaggaagtaagccattcaacccagtccttggggagacttatgaatgcattagagaagacaagggattccgctttttctcagaacaggttagccatcatccacccatttctgcctgtcactgtgaatcaaagaattttgtgttttggcaagatatcagatggaaaaacaagttctgggggaagtcgatggaaatcctgcctgttggaacactgaatgtcatgcttccaaagtatggagattactatgtgtggaataaagtcaccacttgcatacacaacatcctcagtgggagaagatggatagaacattatggagaagtaaccatcagaaataccaaaagcagtgtttgcatttgcaaactcacatttgtcaaggtgaattattggaattctaacatgaatgaagtccagggggtggtgatagatcaggaggggaaggcggtgtaccggctgtttggaaagtggcatgaaggactctactgtggtgtggccccctctgcaaagtgcatttggagaccaggttccatgccaacaaactatgagctgtactatggcttcacaaggtttgctattgagctcaatgagttagatccagtactaaaagatctccttccaccaacagacgcccggttccggccagatcaaagatttttggaagaaggaaatttagaagctgcagcatcagagaagcaaagagtagaggaactccagagatctcggagacgatatatggaagaaaacaatcttgaacatataccaaaattttttaaaaaagttattgatgccaatcaaagagaagcctgggtttctaacgacacctactgggagcttcgaaaggaccctgggtttagcaaagtagacagccctgttctttggtagactgggaatgtagagctagccaacatatcacattctgaatgaataaataactatgcacaattatgtttcttatagctatgtgtggtttctgggtcaactgaaaacctaccatttgcttttctattcatctttataatggactttcagaagtgcattagacaaggcccctaaccactttgggatcctttctgttttgctgcaaccatattcctt

SEQ ID NO: 21348 - DNA, 1762 bp, Homo sapiens
ctggaggcgcagcacggtcgccgccgccgctgtcggtgctggagatcgcggctcggtgcaggcggcgcccatgcctcctctcctccactagcccgcgcgccagtccgcctgccggggccggctctccgcctcctgcctcccgtcgcagccgcgcagccgccgcagagtccgcggcgccaccgctcgccctccaggttctgccacttgctgggaaaacagcaacagaaggatattaaggagccacccctataatttacccagatagccccagcaaggtcaaagacatatcatgtcccaaggagaaaagctgcaggcatctgaggataaatcactgtgaaacagctttgaccataaagctgacttggaagactttgactccaaggtgcaaggtggtttggacaccctcaatattgcctgctcttttctagtcaaacctgattcatgaaatggaatgaagctgaaaaatcatctacttctttgtttgtggatttgagagaagattgggatggtcttaagtgcataaaacgagactctaactgcagcgatgagttcagatgagaagggcatttcccctgctcataaaacatccactccaacccatagaagtgcctcctcttcaacatcctcccaaagggacagtaggcagagtattcacatactggagaggactgcttcctctagcaccgagccctctgtaagtcggcaattgctagaaccggagccagtccccctctccaaggaagctgacagctgggaaattatagaagggctgaaaataggccaaaccaatgtccagaaaccagacaaacatgagggctttatgctgaagaaaagaaaatggcctttaaaaggctggcacaagcgtttttttgtcctggataatggaatgttaaagtattcaaaggcaccactcgatattcagaaaggaaaggtccatgggagcatagatgtgggactctcagtcatgtcaattaaaaagaaagctcgaagaatagaccttgacaccgaagagcacatctatcatttgaaggtgaaatcccaggactggtttgatgcatgggtctccaaactgcgacatcatcggttgtatcgtcagaatgaaattgtgagatcaccaagagatgctagttttcacatatttccttcaacgtccacagctgaatcctcaccagctgctaatgtttctgtaatggatggaaagatgcaaccaaacagctttccgtggcagtcccctttaccatgcagcaatagcctccctgcaacgtgcacaactggccagagtaaagtggcagcctggttacaggactcggaagagatggacaggtgtgcagaagatcttgcacattgccagtcaaaccttgtggaacttagcaaactcctgcaaaatttggaaatacttcagagaactcagtcggcacctaactttactgacatgcaggctaactgtgtagatatttcaaagaaagacaagcgggtcacaagacgatggagaacaaaaagtgtcagcaaagatacaaaaatacaactgcaggttcctttcagtgctaccatgtcaccagttcgcttgcattcctccaaccccaacctttgtgcagatattgaatttcagactccccctcctaaccactttgggatcctttctgttttgctgcaaccatattccttaaaaaaaaaaaaaaaaaaaaaaaaaaaatccacaccgtccttggaaagcagaataaaaggagcagaatataaaatccaaagtctgaccagtttgtaa

SEQ ID NO: 21349 - DNA, 3637 bp, Homo sapiens
ctggaggcgcagcacggtcgccgccgccgctgtcggtgctggagatcgcggctcggtgcaggcggcgcccatgcctcctctcctccactagcccgcgcgccagtccgcctgccggggccggctctccgcctcctgcctcccgtcgcagccgcgcagccgccgcagagtccgcggcgccaccgctcgccctccaggttctgccacttgctgggaaaacagcaacagaaggatattaaggagccacccctataatttacccagatagccccagcaaggtcaaagacatatcatgtcccaaggagaaaagctgcaggcatctgaggataaatcactgtgaaacagctttgaccataaagctgacttggaagactttgactccaaggtgcaaggtggtttggacaccctcaatattgcctgctcttttctagtcaaacctgattcatgaaatggaatgaagctgaaaaatcatctacttctttgtttgtggatttgagagaagattgggatggtcttaagtgcataaaacgagactctaactgcagcgatgagttcagatgagaagggcatttcccctgctcataaaacatccactccaacccatagaagtgcctcctcttcaacatcctcccaaagggacagtaggcagagtattcacatactggagaggactgcttcctctagcaccgagccctctgtaagtcggcaattgctagaaccggagccagtccccctctccaaggaagctgacagctgggaaattatagaagggctgaaaataggccaaaccaatgtccagaaaccagacaaacatgagggctttatgctgaagaaaagaaaatggcctttaaaaggctggcacaagcgtttttttgtcctggataatggaatgttaaagtattcaaaggcaccactcgatattcagaaaggaaaggtccatgggagcatagatgtgggactctcagtcatgtcaattaaaaagaaagctcgaagaatagaccttgacaccgaagagcacatctatcatttgaaggtgaaatcccaggactggtttgatgcatgggtctccaaactgcgacatcatcggttgtatcgtcagaatgaaattgtgagatcaccaagagatgctagttttcacatatttccttcaacgtccacagctgaatcctcaccagctgctaatgtttctgtaatggatggaaagatgcaaccaaacagctttccgtggcagtcccctttaccatgcagcaatagcctccctgcaacgtgcacaactggccagagtaaagtggcagcctggttacaggactcggaagagatggacaggtgtgcagaagatcttgcacattgccagtcaaaccttgtggaacttagcaaactcctgcaaaatttggaaatacttcagagaactcagtcggcacctaactttactgacatgcaggctaactgtgtagatatttcaaagaaagacaagcgggtcacaagacgatggagaacaaaaagtgtcagcaaagatacaaaaatacaactgcaggaagggccacccgcgaagggccagttcagcacaactcggcgccggcagaggctagcggcagcagtggctacaacagttcctttcagtgctaccatgtcaccagttcgcttgcattcctccaaccccaacctttgtgcagatattgaatttcagactccccctagccacctcactgaccctctggaaagttcaacagattatacaaagctgcaagaagaattttgtctaatcgcacagaaagtgcattctcttttgaagtctgcatttaatagcatagctatagagaaggagaagctgaagcagatggtttccgagcaggatcacagtaaaggccacagcacgcagatggcacggctccgacagtcactgtctcaggcactcaaccagaatgctgaactaaggagtcggttgaacagaatacattcagagtctattatttgtgatcaggttgtcagtgtaaatattattcctagccctgatgaggctggtgagcaaatccatgtcagtctccccttatcacagcaagtagccaatgagagccgcctctccatgtcagagtctgtttctgagttctttgatgcccaagaggtgctcctctctgcaagttcgtcagagaatgaggcttcagatgatgagtcttacatcagtgatgtgagtgataatatatctgaagacaacaccagtgttgcagacaatatttctcggcaaatcctgaatggggagcttacaggaggggccttccgaaatgggcgtcgagcatgcctgccagctccttgtcctgacaccagtaacattaacctgtggaatatcttgaggaacaacattggtaaagacctgtctaaagtctctatgcctgtggagctaaacgagccgctcaacaccctgcagcacctctgtgaggaaatggaatacagcgagctcctggacaaggcttcggaaactgatgatccatatgagcgcatggttctcgttgccgcatttgcagtttcaggatactgctccacctatttcagagcaggaagtaagccattcaacccagtccttggggagacttatgaatgcattagagaagacaagggattccgctttttctcagaacaggttagccatcatccacccatttctgcctgtcactgtgaatcaaagaattttgtgttttggcaagatatcagatggaaaaacaagttctgggggaagtcgatggaaatcctgcctgttggaacactgaatgtcatgcttccaaagtatggagattactatgtgtggaataaagtcaccacttgcatacacaacatcctcagtgggagaagatggatagaacattatggagaagtaaccatcagaaataccaaaagcagtgtttgcatttgcaaactcacatttgtcaaggtgaattattggaattctaacatgaatgaagtccagggggtggtgatagatcaggaggggaaggcggtgtaccggctgtttggaaagtggcatgaaggactctactgtggtgtggccccctctgcaaagtgcatttggagaccaggttccatgccaacaaactatgagctgtactatggcttcacaaggtttgctattgagctcaatgagttagatccagtactaaaagatctccttccaccaacagacgcccggttccggccagatcaaagatttttggaagaaggaaatttagaagctgcagcatcagagaagcaaagagtagaggaactccagagatctcggagacgatatatggaagaaaacaatcttgaacatataccaaaattttttaaaaaagttattgatgccaatcaaagagaagcctgggtttctaacgacacctactgggagcttcgaaaggaccctgggtttagcaaagtagacagccctgttctttggtagactgggaatgtagagctagccaacatatcacattctgaatgaataaataactatgcacaattatgtttcttatagctatgtgtggtttctgggtcaactgaaaacctaccatttgcttttctattcatctttataatggactttcagaagtgcattagacaaggcccctaaccactttgggatcctttctgttttgctgcaaccatattcctt

SEQ ID NO: 21350 - DNA, 3427 bp, Homo sapiens
agatcgcggctcggtgcaggcggcgcccatgcctcctctcctccactagcccgcgcgccagtccgcctgccggggccggctctccgcctcctgcctcccgtcgcagccgcgcagccgccgcagagtccgcggcgccaccgctcgccctccaggttctgccacttgctgggaaaacagcaacagaaggatattaaggagccacccctataatttacccagatagccccagcaaggtcaaagacatatcatgtcccaaggagaaaagctgcaggcatctgaggataaatcactgtgaaacagctttgaccataaagctgacttggaagactttgactccaaggtgcaaggtggtttggacaccctcaatattgcctgctcttttctagtcaaacctgattcatgaaatggaatgaagctgaaaaatcatctacttctttgtttgtggatttgagagaagattgggatggtcttaagtgcataaaacgagactctaactgcagcgatgagttcagatgagaagggcatttcccctgctcataaaacatccactccaacccatagaagtgcctcctcttcaacatcctcccaaagggacagtaggcagagtattcacatactggagaggactgcttcctctagcaccgagccctctgtaagtcggcaattgctagaaccggagccagtccccctctccaaggaagctgacagctgggaaattatagaagggctgaaaataggccaaaccaatgtccagaaaccagacaaacatgagggctttatgctgaagaaaagaaaatggcctttaaaaggctggcacaagcgtttttttgtcctggataatggaatgttaaagtattcaaaggcaccactcgatattcagaaaggaaaggtccatgggagcatagatgtgggactctcagtcatgtcaattaaaaagaaagctcgaagaatagaccttgacaccgaagagcacatctatcatttgaaggtgaaatcccaggactggtttgatgcatgggtctccaaactgcgacatcatcggttgtatcgtcagaatgaaattgtgagatcaccaagagatgctagttttcacatatttccttcaacgtccacagctgaatcctcaccagctgctaatgtttctgtaatggatggaaagatgcaaccaaacagctttccgtggcagtcccctttaccatgcagcaatagcctccctgcaacgtgcacaactggccagagtaaagtggcagcctggttacaggactcggaagagatggacaggtgtgcagaagatcttgcacattgccagtcaaaccttgtggaacttagcaaactcctgcaaaatttggaaatacttcagagaactcagtcggcacctaactttactgacatgcaggttcctttcagtgctaccatgtcaccagttcgcttgcattcctccaaccccaacctttgtgcagatattgaatttcagactccccctagccacctcactgaccctctggaaagttcaacagattatacaaagctgcaagaagaattttgtctaatcgcacagaaagtgcattctcttttgaagtctgcatttaatagcatagctatagagaaggagaagctgaagcagatggtttccgagcaggatcacagtaaaggccacagcacgcagatggcacggctccgacagtcactgtctcaggcactcaaccagaatgctgaactaaggagtcggttgaacagaatacattcagagtctattatttgtgatcaggttgtcagtgtaaatattattcctagccctgatgaggctggtgagcaaatccatgtcagtctccccttatcacagcaagtagccaatgagagccgcctctccatgtcagagtctgtttctgagttctttgatgcccaagaggtgctcctctctgcaagttcgtcagagaatgaggcttcagatgatgagtcttacatcagtgatgtgagtgataatatatctgaagacaacaccagtgttgcagacaatatttctcggcaaatcctgaatggggagcttacaggaggggccttccgaaatgggcgtcgagcatgcctgccagctccttgtcctgacaccagtaacattaacctgtggaatatcttgaggaacaacattggtaaagacctgtctaaagtctctatgcctgtggagctaaacgagccgctcaacaccctgcagcacctctgtgaggaaatggaatacagcgagctcctggacaaggcttcggaaactgatgatccatatgagcgcatggttctcgttgccgcatttgcagtttcaggatactgctccacctatttcagagcaggaagtaagccattcaacccagtccttggggagacttatgaatgcattagagaagacaagggattccgctttttctcagaacaggttagccatcatccacccatttctgcctgtcactgtgaatcaaagaattttgtgttttggcaagatatcagatggaaaaacaagttctgggggaagtcgatggaaatcctgcctgttggaacactgaatgtcatgcttccaaagtatggagattactatgtgtggaataaagtcaccacttgcatacacaacatcctcagtgggagaagatggatagaacattatggagaagtaaccatcagaaataccaaaagcagtgtttgcatttgcaaactcacatttgtcaaggtgaattattggaattctaacatgaatgaagtccagggggtggtgatagatcaggaggggaaggcggtgtaccggctgtttggaaagtggcatgaaggactctactgtggtgtggccccctctgcaaagtgcatttggagaccaggttccatgccaacaaactatgagctgtactatggcttcacaaggtttgctattgagctcaatgagttagatccagtactaaaagatctccttccaccaacagacgcccggttccggccagatcaaagatttttggaagaaggaaatttagaagctgcagcatcagagaagcaaagagtagaggaactccagagatctcggagacgatatatggaagaaaacaatcttgaacatataccaaaattttttaaaaaagttattgatgccaatcaaagagaagcctgggtttctaacgacacctactgggagcttcgaaaggaccctgggtttagcaaagtagacagccctgttctttggtagactgggaatgtagagctagccaacatatcacattctgaatgaataaataactatgcacaattatgtttcttatagctatgtgtggtttctgggtcaactgaaaacctaccatttgcttttctattcatctttataatggactttcagaagtgcattagacaaggcccctaaccactttgggatcctttctgttttgctgcaaccatattcctt

SEQ ID NO: 21351 - DNA, 3656 bp, Homo sapiens
gcagcagctgctgccactgctcagcgcggtgaggagggagccggtgactcggagacggtgactcagaggcagagcggcgcaagggccaaggagtactggcgtccatggaccctggggaccccgtcaggagcaggtgacatccttccccttccaccctgctccctgctctacatccccagcagggagtggcctctcccttctccatggacttccaagagagggacccgcccttcctgcctgagagcgctcagtcctcaaagcccagcagtgctcagcaggcctctgagctgtgggaggtggtggaggagcctcgggtcaggctggggacagagggtgtcatgcctgagaggcaggaaggtcacctgctcaagaagaggaagtggcctctgaagggctggcacaagagatactttgtgctcgaggacgggatccttcattatgcaacaacccggcaagacatcaccaaggggaagctccatggctccatcgatgtccggctgtcggtcatgtccatcaacaaaaaggcccagcgcattgaccttgacactgaagacaacatctaccacctcaagatcaaatcccaggacctattccagagctgggtggcgcagctgcgtgcccaccgcctagcccaccgcctggacatgccccgtggctcactgcccagtactgctcaccggaaggttcctggtgcccagcttccaacagcagctactgcctcagccctacctgggcttggaccgcgggagaaagtgtcttcctggctgagggacagtgatgggctggaccgctgctctcatgagctctctgagtgtcaggggaagctccaggaactacacaggctcctccagagcctggagtccctgcaccgaatcccctcagcccctgttatccccacacaccaggcctcagtgacaaccgaaagacccaagaaggggaaacggacaagccgcatgtggtgcacccagagctttgccaaggatgacaccattggacgggttggtcgtctccatggctctgttcccaacctgtctcgctacctggagtctcgggactcctcgggcacccgtgggctgccacccacagactatgcccacctgcagcgcagcttctgggccctggcccagaaggtgcacagctccctcagcagcgtcctggccgccctcaccatggaacgggaccaactgagggacatgcaccagggctcagagttgtcaagaatgggggtctctgaggcctccactggccagaggcgcctccactcactgtccacctcctccgacaccacggcggactctttcagctccctcaaccctgaggagcaagaagctctgtacatgaaggggcgcgagctcaccccccagctatcgcagaccagcatcctgtcccttgctgattcccacacggagttcttcgatgcctgcgaggttctcctctccgccagctcttctgagaatgagggctcagaggaggaggagtcctgtaccagtgaaatcaccaccagcctgtctgaggagatgctggacctcaggggagctgagcgctgtcagaaaggggggtgtgttccagggagacccatggggccaccccgccgtcgctgcctgccggcggccagcgggcctggggctgacgtgagcctgtggaacattctgcgcaacaacatcggcaaagacctgtccaaggtgtcaatgcctgtgcagctcaacgagccgctcaacactctgcagcggctctgcgaggagctggagtacagcagcctcctggaccaggccagccgcatcgccgacccctgcgagcgcatggtgtacatcgcagcctttgctgtctcggcctactcctccacataccaccgagccggctgcaagcccttcaaccctgtcctgggggagacctacgagtgtgagcggcctgaccgaggcttccgcttcatcagtgagcaggtctcccaccacccccctatctcggcctgccatgcagagtctgagaacttcgccttctggcaagatatgaagtggaagaacaagttctggggcaaatccctggagattgtgcctgtgggaacagtcaacgtcagcctgcccaggtttggggaccactttgagtggaacaaggtgacatcctgcattcacaatgtcctgagtggtcagcgctggatcgagcactatggggaggtgctcatccgaaacacacaggacagctcctgccactgcaagatcaccttctgcaaggccaagtactggagttccaatgtccacgaggtgcagggcgctgtgctcagtcggagtggccgtgtcctccaccgactctttgggaagtggcacgaggggctgtaccggggacccacgccaggtggccagtgcatctggaaacccaactcaatgccccccgaccatgagcgaaacttcggcttcacccagtttgccttggagctgaatgagctgacagcagagctgaaacggtcgctgccttccaccgacacgagactccggccagaccagaggtacctggaggaggggaacatacaggccgctgaggcccagaagagaaggatcgagcagctgcagcgagacaggcgcaaagtcatggaggaaaacaacatcgtacaccaggctcgcttcttcaggcggcagacggatagcagcgggaaagagtggtgggtgaccaacaatacctactggaggctgcgggccgagccaggctatgggaacatggatggggccgtgctctggtagccctggccccgggggcaggaggctctggttcctcactcctcctgcctccaccccctaccatggacacatgggtgaggccgggctccccgcctcactgcccttgagaccaaaggggcagccctggccctccctcccctctgctggccagagggtctgcatctcagcccacccccaaccccaccgtttggggtgagaagcagaatctgtgcttccccagtctccttgccccagacaaccagcatgtaagacccttcccgcttcaccattccgattcctgtcccctttggggtacttgggggagactctggctcccaggatctgttccctatttcagtgccttcctaggacacaggggactccttgacgctccccaggctttctgtgcccaggcctctgtccccagcggtgaggttgcagtgagtgaaggagaggaggtgatctgttctccctccccttctgcccatctccagcatcttcttccccttccctggccctgcagggccttctccagctccctttggttagtccctggccatccctcctgtcctggatcccttctccctaactgcaaaatgcctgcagcttccagctccttcgtccctgatcctcaagcggttccctcccgtctcagctcagcggatcccccagagtggaggaggcctctccatgaggaggggagcagcccaaggcacctgtcctctgacccaccggcagcgagtgcgcaggtgtgagtgtaagttcatgtaggagagtgtatgcgtgtgcgcctgtgccctgcttgcaggcaagcagggctccctcatgtagccccgccttccccctgctgggggtccaccacatcgctgctctttctcacagtctgcctctgatgagggcgaattgctatgacattccaagctccaataaagactgtcccagactttg

SEQ ID NO: 21352 - DNA, 3349 bp, Homo sapiens
ggggagatccggctagaggggaggctctgacatctccttccttcctggttcctgcagcagctgctgccactgctcagcgcggtgaggagggagccggtgactcggagacggtgactcagaggcagagcggcgcaagggccaaggagtactggcgtccatggaccctggggaccccgtcaggagcaggtgacatccttccccttccaccctgctccctgctctacatccccagcagggagtggcctctcccttctccatggacttccaagagagggacccgcccttcctgcctgagagcgctcagtcctcaaagcccagcagtgctcagcaggcctctgagctgtgggaggtggtggaggagcctcgggtcaggctggggacagagggtgtcatgcctgagaggcaggaaggtcacctgctcaagaagaggaagtggcctctgaagggctggcacaagagatactttgtgctcgaggacgggatccttcattatgcaacaacccggcaagacatcaccaaggggaagctccatggctccatcgatgtccggctgtcggtcatgtccatcaacaaaaaggcccagcgcattgaccttgacactgaagacaacatctaccacctcaagatcaaatcccaggacctattccagagctgggtggcgcagctgcgtgcccaccgcctagcccaccgcctggacatgccccgtggctcactgcccagtactgctcaccggaaggttcctggtgcccagcttccaacagcagctactgcctcagccctacctgggcttggaccgcgggagaaagtgtcttcctggctgagggacagtgatgggctggaccgctgctctcatgagctctctgagtgtcaggggaagctccaggaactacacaggctcctccagagcctggagtccctgcaccgaatcccctcagcccctgttatccccacacaccaggcctcagtgacaaccgaaagacccaagaaggggaaacggacaagccgcatgtggtgcacccagagctttgccaaggatgacaccattggacgggttggtcgtctccatggctctgttcccaacctgtctcgctacctggagtctcgggactcctcgggcacccgtgggctgccacccacagactatgcccacctgcagcgcagcttctgggccctggcccagaaggtgcacagctccctcagcagcgtcctggccgccctcaccatggaacgggaccaactgagggacatgcaccagggctcagagttgtcaagaatgggggtctctgaggcctccactggccagaggcgcctccactcactgtccacctcctccgacaccacggcggactctttcagctccctcaaccctgaggagcaagaagctctgtacatgaaggggcgcgagctcaccccccagctatcgcagaccagcatcctgtcccttgctgattcccacacggagttcttcgatgcctgcgaggttctcctctccgccagctcttctgagaatgagggctcagaggaggaggagtcctgtaccagtgaaatcaccaccagcctgtctgaggagatgctggacctcaggggagctgagcgctgtcagaaaggggggtgtgttccagggagacccatggggccaccccgccgtcgctgcctgccggcggccagcgggcctggggctgacgtgagcctgtggaacattctgcgcaacaacatcggcaaagacctgtccaaggtgtcaatgcctgtgcagctcaacgagccgctcaacactctgcagcggctctgcgaggagctggagtacagcagcctcctggaccaggccagccgcatcgccgacccctgcgagcgcatggtgtacatcgcagcctttgctgtctcggcctactcctccacataccaccgagccggctgcaagcccttcaaccctgtcctgggggagacctacgagtgtgagcggcctgaccgaggcttccgcttcatcagtgagcaggtctcccaccacccccctatctcggcctgccatgcagagtctgagaacttcgccttctggcaagatatgaagtggaagaacaagttctggggcaaatccctggagattgtgcctgtgggaacagtcaacgtcagcctgcccaggtttggggaccactttgagtggaacaaggtgacatcctgcattcacaatgtcctgagtggtcagcgctggatcgagcactatggggaggtgctcatccgaaacacacaggacagctcctgccactgcaagatcaccttctgcaaggccaagtactggagttccaatgtccacgaggtgcagggcgctgtgctcagtcggagtggccgtgtcctccaccgactctttgggaagtggcacgaggggctgtaccggggacccacgccaggtggccagtgcatctggaaacccaactcaatgccccccgaccatgagcgaaacttcggcttcacccagtttgccttggagctgaatgagctgacagcagagctgaaacggtcgctgccttccaccgacacgagactccggccagaccagaggtacctggaggaggggaacatacaggccgctgaggcccagaagagaaggatcgagcagctgcagcgagacaggcgcaaagtcatggaggaaaacaacatcgtacaccaggctcgcttcttcaggcggcagacggatagcagcgggaaagagtggtgggtgaccaacaatacctactggaggctgcgggccgagccaggctatgggaacatggatggggccgtgctctggtagccctggccccgggggcaggaggctctggttcctcactcctcctgcctccaccccctaccatggacacatgggtgaggccgggctccccgcctcactgcccttctgcccatctccagcatcttcttccccttccctggccctgcagggccttctccagctccctttggttagtccctggccatccctcctgtcctggatcccttctccctaactgcaaaatgcctgcagcttccagctccttcgtccctgatcctcaagcggttccctcccgtctcagctcagcggatcccccagagtggaggaggcctctccatgaggaggggagcagcccaaggcacctgtcctctgacccaccggcagcgagtgcgcaggtgtgagtgtaagttcatgtaggagagtgtatgcgtgtgcgcctgtgccctgcttgcaggcaagcagggctccctcatgtagccccgccttccccctgctgggggtccaccacatcgctgctctttctcacagtctgcctctgatgagggcgaattgctatgacattccaagctccaataaagactgtcccag

SEQ ID NO: 21353 - DNA, 7239 bp, Homo sapiens
cactagaatgtgaaggatcttcgcggttctgggtgcccagaaaggcggcgacgcggcggatgacaacattaggccgcgacgcgctcctggccaggcggcggctgtagtgttagctttggacgccgcagtagccgctgccggtagcaagccgactgagggaaggtgggggtccgcccgggctggtggacctcggggccgaaagttcccgccccgctcgggggctgagccggcagtgcctccgcggccgctgggcagcgcccttcgtccaggctcgcgccccagctgccgccgacgacagcggccgagagaagttggggtctgactagacgcttacggggcctcggaccccggcgccgcggcgacctcggaggaaccggctccttgcgtcccgcctccctgggagctccgcacgggatttgcagatttacagaatggctgcacattaatggaaagagaagcataaacctatcttctttcattatggagggaggtttggcagatggagaacctgatcgaacttcgcttcttggtgatagcaaagatgtccttgggccatcaactgttgtagcaaacagtgacgaatctcagcttctgacaccaggaaagatgagtcagcgccaaggaaaagaagcttatccaacgccaaccaaagatttgcatcagccatctcttagtccagcaagtcctcatagccagggttttgaaagagggaaggaagatatttctcaaaataaagatgaatcttcactttctatgtcaaagagcaagtctgaatctaaactttataatggctcagagaaggacagttcaacttcaagcaaactcacaaaaaaagaatctcttaaggtacaaaagaaaaattaccgagaagaaaagaaaagagccacaaaggagctgctcagtacaatcacagatccttctgttattgttatggctgattggttaaagattcgtggtactctaaagagctggaccaagttatggtgtgtgttgaaacctggggtgctactgatctataaaacccaaaaaaatggtcagtgggtaggaacagttcttctgaatgcctgtgaaatcattgaacgtccatcaaaaaaggatggcttttgtttcaaacttttccatcctttggagcaatctatttgggcagtgaagggtccaaaaggtgaagcggttggatccattactcaacccttacctagcagttatttgatcatccgagctacttcagagtcagatggaaggtgctggatggatgctttggagttggctttgaaatgttctagtcttcttaaacgtacaatgatcagagaaggaaaggaacatgacctgagcgtttcatcagatagcacacatgtgactttctatggcttactacgtgctaacaatctccacagtggtgataacttccagttaaatgatagtgaaattgaacgacaacattttaaggaccaagatatgtattctgataaatctgataaagaaaatgatcaagaacatgatgagtctgataatgaggtgatggggaaaagtgaagaaagtgacacagatacatcagaaagacaagatgactcatatatcgaacctgagcctgttgagcctttaaaggagactacctacactgaacagagccatgaagaacttggagaggcaggtgaggcttctcaaacagaaactgtatctgaagaaaacaaaagccttatctggacactattgaaacaagtccgtcctggcatggacctatccaaggtggttctgcctacatttattttggaaccccgttctttcctggataaactttcagattactactatcatgcagatttcctatctgaggcagctcttgaagaaaatccttatttccgtttgaagaaagtagtgaaatggtatttgtcaggattctataaaaagccaaagggactgaagaaaccttataatcctatacttggcgagactttccgttgtttatggattcatcccagaacaaacagcaaaactttttatattgctgaacaggtgtcccatcatccaccaatatctgccttttatgttagtaatcgaaaagatggattttgccttagcggtagtatcctggctaagtctaagttttatggaaactcattatctgcaatattagagggagaagcacggttaactttcttgaatagaggtgaagattatgtaatgacaatgccatacgctcattgtaaaggaattctttatggtacaatgacactggagcttggtggaacagtcaatattacatgtcaaaaaactggatacagtgcaatacttgaatttaaactaaagccattcctagggagtagtgactgtgttaatcaaatatcagggaaacttaaactgggaaaagaagtcctagctactttggaaggtcattgggatagtgaagtttttattactgataaaaagactgataattcagaggttttctggaatccaacacctgacattaagcaatggagattaataaggcacactgtaaaatttgaagaacagggagattttgaatcagagaaactctggcaacgggtaactcgagccataaatgccaaagaccaaactgaagctacccaagagaagtatgttttggaagaagctcaaagacaagctgccagggatcggaaaacaaaaaatgaagagtggtcttgcaaattatttgaacttgatccactcacaggagaatggcattacaagtttgcagatacccgaccatgggacccacttaatgatatgatacagtttgaaaaagatggtgttattcagaccaaagtgaaacatcgtactccaatggttagcgtccccaaaatgaaacataagccaaccaggcaacagaagaaagtagcaaaaggctattcctccccagaacctgacattcaagactcctctggaagtgaagctcaatcagtaaaaccaagtacaagaagaaagaaaggaatagaactgggagacattcagagttccatcgaatctataaaacaaacacaggaagaaattaaaagaaatattatggctcttcgaaatcatttagtttcaagcacaccggccacggattattttctgcaacaaaaagactacttcatcattttcctcctgattttgcttcaagtcataataaacttcatgttcaagtagaagttctctaccattgaatcagtgaactagaaagatctgatttggcctgggaccagtgttcaagttggtttggtctttattaaaaatcacaatattccgaaaacaaaaaaacctaggagataaatgtagaggtattgacttttcgtatcttttatcttcacactgaaacaagagctatcctatttgattattaaagtgagctatgtgttaagtgccaggacatttctagcttttgtgagaatgtgtctacatatgagtataataaacccacatgtatacacaattgtctcttatgtactcctacctgacagtagtctttgtattctatagtatgttctgagatataatgttaacattgttcataacaaaaaatgctatcaatcttataaatatatgtaatctattttcttcataaaacaggcacaaaagttttatcagtaaggaattacagattgagaaatgatggaataatagacataattaattcaatacactactgttaaaatcatttgcaaagcactcagctcaattatcttcttagaaagaaagaaaaagtatgaatggtcaaaatgaatacatcgagagagataaatggcaaattgcttttttaaaagtttacataagttttttttaacccctagaatttaatatttgtagatgcaggtaaatatatatacttacgtgtatatcagtataaaaacactggtgtgcaattaattggattgattataataccaccttaagcacttgctgaaaaaagtgtggtcaaaattgattgctgtccttttgtcttatttttgtttttcttaagtcagctggttcataacataggccaaattctagagatgtttatagagcatttgaagtgctgataatttatgttttttcattatgaaaacttattttagctttagactccagtgtgttcagtgaataagtagaatataaaaaaatataaccagtattttacttcaaaagccaaaaagaggcaataagaaaagacactttgtggtggcctttatgtgtgcattaaaattggtttctgtaaaacgtgtaataagttgagtatctacgaagagtatcaagttctgaagtttaatttttttattatcctcctctcttcttagtaacttctttctgtggcaaaaccacaattctttaagattcctattgttcaggctaaggcaaatttttttgtttgtttcttcagtttaatattttgattttgtgtttttacgtaaatatttatattccttgaaagcaatttttgccaaggtagttcagtttaggaatatgttgttctaaaatatgtcttagaatcctgaaagcatagattttgaaatgtttttttaatgaaaatgaaggtcagagagaataattgccctgaccacatttgcctttcagtaggaggaggctgtgaaatagtaaaattataatcgtttatgccatgataaatacaagattggtaaataaatacattgattggtaaattatgagaatcaaaatgataaaaagagcctgcttttttccctaaccaatatagctatcttaagtatccttaggtttctgtgaagaaccatttcccatgttttcttggcaaaataatgctgtattccatatgtacatgtgaaatgatgttttaaattgataaaagcttaaataagatctacctatacccagtattttcatgatattagaacaaatgggtttttggttatattttatatttgtcaatataatttttgtattcacattctgttacactctgcctattcattgatatatgatattctgtaaatattgtacaatttgatcttttttatggtttaaattagttaattacatacaaattgattggcttatcacaaaaatcatttcatcagtaaaccttgttaacattttgtactggtgacccacctcttaggactttggtcttatccacgtgtatgttgttttcatttggtccaaataatattttatttgtatgggtatcttctaagactaaataggtagttgtgttctttatttttaaaatttctttttagagcaaatgttatgggttcttacccaaagagtcaaaaactatttcttaagaaagagcagagttattcatgactgttctttatacactaaaagcatgcatctaatctaatagtcctcttattatgcttttagttgtatgagtctctttctatgaactgaacacaaaactcaggaattggtggcttaattttagatcagtgcttgtactaggcttagttatatgaatctttataacacataattactaactttgtagccatatatgtaattgactttgaatgttatttacctgaaattaatcttccttcacacatggaccgtaaacggttcccagttgtctgagagcctcatgagggtttctaggatttatgaccttatgaccagtttttttcatttaccaagattttattttcctacatgaaaatttaattgagtaataattattcacatgtgcattttctttttagctgttaaatgtactatgccatcatccaccatttagtaaaatgtagctggcccaggacatgtaaaaaaaaaaaaaaaacaacaacaataaatagggcatgtgaaatgttaagttacagcaatagatattttatttgtatttcatgttagtacttttttgttttatatcacttataaaggtacagtgtactctttgtcacagctcagttggtaaccgcattccattgaaaagttggccttgtaaaatacaactctcatttaatattcatgcttttgtgcctttaagaaaatattttttgtcattttttgtgttacagaactataatgtgattcaaggtgtttataggcttgtcataaaagggtcatttctgtgtgttactttctttttatatagctatagtatatttaaacaataatactatcttttataggggtttgtctatttacctattctttactcagacattgatgtagacttgtcagattattctgagtattgttaacagtgccttttcgatggaatcacactttttggctgtcaccttgtgccatatacacacaaaattttgtggaaggcagttttaactttctgaagaatatctgtcaaaatttaagaaaacaaatgtataaaattccattttttccagtgtttagcatttctagtaagcagtgaggttgtttgacatacagtgatgatggcattattgataagccatacatgagactgcagattatattgaatcatattaaatgtacagaaataaaatattagatttatatcaaattttccaatttgaaccagtggggaaaatcccacagaaatcagtaagtttacatttcaatttctatcttatttgactaagtggaaagagattctttaaaatgtataacctgccattatgtaatttggtttcattttattctacctgttgtgtgagtttagtatatttaatttactttttgttactctttacatactgtttatttttgttagtttttaattgaagatggactgttgaaattgtataggaccagtgtcttattaatatgattaatatatttagaagagccacgtgaaacccatgacaaaatgaatgtgaatattctttctaaaaatttagaaaatgttatctttttgcatttattatgtaaaactgttttacagtatcaaaatttttcacttaaagaaaaaaaatgccatgaaacatttgaactgatgagccacagaacttcagttgaaatttttttcactttttagcatgctaaatatacatctgagtttaaatgttctgtttaatggccattcataaattcaagcactaccactggtcagttttgtgtgatagaataaaaatatgttacctgcagtgtaagtacagcacactgtcaaattcttttccttaaggtgcacagtaaatgtacagatagttataggccactgttttgtaatgtagtacatttctaatctattattcctaacctattataactgtttgcagaaagaaaagaatttttctaataatctgtaaaattatgctaacttctacaagtaggcttctaaataaaatttttaaaaagagc

SEQ ID NO: 21354 - DNA, 7047 bp, Homo sapiens
cgccccagctgccgccgacgacagcggccgagagaagttggggtctgactagacgcttacggggcctcggaccccggcgccgcggcgacctcggaggaaccggctccttgcgtcccgcctccctgggagctccgcacggcaatctccattggtgctactgcgtttaaagaactgtggctaacctccaagagactgaagctggtaattaaacattcctatccttgcctgaagcagtcttttgcaggaacatttgaggatttgcagatttacagaatggctgcacattaatggaaagagaagcataaacctatcttctttcattatggagggaggtttggcagatggagaacctgatcgaacttcgctgttgtagcaaacagtgacgaatctcagcttctgacaccaggaaagatgagtcagcgccaaggaaaagaagcttatccaacgccaaccaaagatttgcatcagccatctcttagtccagcaagtcctcatagccagggttttgaaagagggaaggaagatatttctcaaaataaagatgaatcttcactttctatgtcaaagagcaagtctgaatctaaactttataatggctcagagaaggacagttcaacttcaagcaaactcacaaaaaaagaatctcttaaggtacaaaagaaaaattaccgagaagaaaagaaaagagccacaaaggagctgctcagtacaatcacagatccttctgttattgttatggctgattggttaaagattcgtggtactctaaagagctggaccaagttatggtgtgtgttgaaacctggggtgctactgatctataaaacccaaaaaaatggtcagtgggtaggaacagttcttctgaatgcctgtgaaatcattgaacgtccatcaaaaaaggatggcttttgtttcaaacttttccatcctttggagcaatctatttgggcagtgaagggtccaaaaggtgaagcggttggatccattactcaacccttacctagcagttatttgatcatccgagctacttcagagtcagatggaaggtgctggatggatgctttggagttggctttgaaatgttctagtcttcttaaacgtacaatgatcagagaaggaaaggaacatgacctgagcgtttcatcagatagcacacatgtgactttctatggcttactacgtgctaacaatctccacagtggtgataacttccagttaaatgatagtgaaattgaacgacaacattttaaggaccaagatatgtattctgataaatctgataaagaaaatgatcaagaacatgatgagtctgataatgaggtgatggggaaaagtgaagaaagtgacacagatacatcagaaagacaagatgactcatatatcgaacctgagcctgttgagcctttaaaggagactacctacactgaacagagccatgaagaacttggagaggcaggtgaggcttctcaaacagaaactgtatctgaagaaaacaaaagccttatctggacactattgaaacaagtccgtcctggcatggacctatccaaggtggttctgcctacatttattttggaaccccgttctttcctggataaactttcagattactactatcatgcagatttcctatctgaggcagctcttgaagaaaatccttatttccgtttgaagaaagtagtgaaatggtatttgtcaggattctataaaaagccaaagggactgaagaaaccttataatcctatacttggcgagactttccgttgtttatggattcatcccagaacaaacagcaaaactttttatattgctgaacaggtgtcccatcatccaccaatatctgccttttatgttagtaatcgaaaagatggattttgccttagcggtagtatcctggctaagtctaagttttatggaaactcattatctgcaatattagagggagaagcacggttaactttcttgaatagaggtgaagattatgtaatgacaatgccatacgctcattgtaaaggaattctttatggtacaatgacactggagcttggtggaacagtcaatattacatgtcaaaaaactggatacagtgcaatacttgaatttaaactaaagccattcctagggagtagtgactgtgttaatcaaatatcagggaaacttaaactgggaaaagaagtcctagctactttggaaggtcattgggatagtgaagtttttattactgataaaaagactgataattcagaggttttctggaatccaacacctgacattaagcaatggagattaataaggcacactgtaaaatttgaagaacagggagattttgaatcagagaaactctggcaacgggtaactcgagccataaatgccaaagaccaaactgaagctacccaagagaagtatgttttggaagaagctcaaagacaagctgccagggatcggaaaacaaaaaatgaagagtggtcttgcaaattatttgaacttgatccactcacaggagaatggcattacaagtttgcagatacccgaccatgggacccacttaatgatatgatacagtttgaaaaagatggtgttattcagaccaaagtgaaacatcgtactccaatggttagcgtccccaaaatgaaacataagccaaccaggcaacagaagaaagtagcaaaaggctattcctccccagaacctgacattcaagactcctctggaagtgaagctcaatcagtaaaaccaagtacaagaagaaagaaaggaatagaactgggagacattcagagttccatcgaatctataaaacaaacacaggaagaaattaaaagaaatattatggctcttcgaaatcatttagtttcaagcacaccggccacggattattttctgcaacaaaaagactacttcatcattttcctcctgattttgcttcaagtcataataaacttcatgttcaagtagaagttctctaccattgaatcagtgaactagaaagatctgatttggcctgggaccagtgttcaagttggtttggtctttattaaaaatcacaatattccgaaaacaaaaaaacctaggagataaatgtagaggtattgacttttcgtatcttttatcttcacactgaaacaagagctatcctatttgattattaaagtgagctatgtgttaagtgccaggacatttctagcttttgtgagaatgtgtctacatatgagtataataaacccacatgtatacacaattgtctcttatgtactcctacctgacagtagtctttgtattctatagtatgttctgagatataatgttaacattgttcataacaaaaaatgctatcaatcttataaatatatgtaatctattttcttcataaaacaggcacaaaagttttatcagtaaggaattacagattgagaaatgatggaataatagacataattaattcaatacactactgttaaaatcatttgcaaagcactcagctcaattatcttcttagaaagaaagaaaaagtatgaatggtcaaaatgaatacatcgagagagataaatggcaaattgcttttttaaaagtttacataagttttttttaacccctagaatttaatatttgtagatgcaggtaaatatatatacttacgtgtatatcagtataaaaacactggtgtgcaattaattggattgattataataccaccttaagcacttgctgaaaaaagtgtggtcaaaattgattgctgtccttttgtcttatttttgtttttcttaagtcagctggttcataacataggccaaattctagagatgtttatagagcatttgaagtgctgataatttatgttttttcattatgaaaacttattttagctttagactccagtgtgttcagtgaataagtagaatataaaaaaatataaccagtattttacttcaaaagccaaaaagaggcaataagaaaagacactttgtggtggcctttatgtgtgcattaaaattggtttctgtaaaacgtgtaataagttgagtatctacgaagagtatcaagttctgaagtttaatttttttattatcctcctctcttcttagtaacttctttctgtggcaaaaccacaattctttaagattcctattgttcaggctaaggcaaatttttttgtttgtttcttcagtttaatattttgattttgtgtttttacgtaaatatttatattccttgaaagcaatttttgccaaggtagttcagtttaggaatatgttgttctaaaatatgtcttagaatcctgaaagcatagattttgaaatgtttttttaatgaaaatgaaggtcagagagaataattgccctgaccacatttgcctttcagtaggaggaggctgtgaaatagtaaaattataatcgtttatgccatgataaatacaagattggtaaataaatacattgattggtaaattatgagaatcaaaatgataaaaagagcctgcttttttccctaaccaatatagctatcttaagtatccttaggtttctgtgaagaaccatttcccatgttttcttggcaaaataatgctgtattccatatgtacatgtgaaatgatgttttaaattgataaaagcttaaataagatctacctatacccagtattttcatgatattagaacaaatgggtttttggttatattttatatttgtcaatataatttttgtattcacattctgttacactctgcctattcattgatatatgatattctgtaaatattgtacaatttgatcttttttatggtttaaattagttaattacatacaaattgattggcttatcacaaaaatcatttcatcagtaaaccttgttaacattttgtactggtgacccacctcttaggactttggtcttatccacgtgtatgttgttttcatttggtccaaataatattttatttgtatgggtatcttctaagactaaataggtagttgtgttctttatttttaaaatttctttttagagcaaatgttatgggttcttacccaaagagtcaaaaactatttcttaagaaagagcagagttattcatgactgttctttatacactaaaagcatgcatctaatctaatagtcctcttattatgcttttagttgtatgagtctctttctatgaactgaacacaaaactcaggaattggtggcttaattttagatcagtgcttgtactaggcttagttatatgaatctttataacacataattactaactttgtagccatatatgtaattgactttgaatgttatttacctgaaattaatcttccttcacacatggaccgtaaacggttcccagttgtctgagagcctcatgagggtttctaggatttatgaccttatgaccagtttttttcatttaccaagattttattttcctacatgaaaatttaattgagtaataattattcacatgtgcattttctttttagctgttaaatgtactatgccatcatccaccatttagtaaaatgtagctggcccaggacatgtaaaaaaaaaaaaaaaacaacaacaataaatagggcatgtgaaatgttaagttacagcaatagatattttatttgtatttcatgttagtacttttttgttttatatcacttataaaggtacagtgtactctttgtcacagctcagttggtaaccgcattccattgaaaagttggccttgtaaaatacaactctcatttaatattcatgcttttgtgcctttaagaaaatattttttgtcattttttgtgttacagaactataatgtgattcaaggtgtttataggcttgtcataaaagggtcatttctgtgtgttactttctttttatatagctatagtatatttaaacaataatactatcttttataggggtttgtctatttacctattctttactcagacattgatgtagacttgtcagattattctgagtattgttaacagtgccttttcgatggaatcacactttttggctgtcaccttgtgccatatacacacaaaattttgtggaaggcagttttaactttctgaagaatatctgtcaaaatttaagaaaacaaatgtataaaattccattttttccagtgtttagcatttctagtaagcagtgaggttgtttgacatacagtgatgatggcattattgataagccatacatgagactgcagattatattgaatcatattaaatgtacagaaataaaatattagatttatatcaaattttccaatttgaaccagtggggaaaatcccacagaaatcagtaagtttacatttcaatttctatcttatttgactaagtggaaagagattctttaaaatgtataacctgccattatgtaatttggtttcattttattctacctgttgtgtgagtttagtatatttaatttactttttgttactctttacatactgtttatttttgttagtttttaattgaagatggactgttgaaattgtataggaccagtgtcttattaatatgattaatatatttagaagagccacgtgaaacccatgacaaaatgaatgtgaatattctttctaaaaatttagaaaatgttatctttttgcatttattatgtaaaactgttttacagtatcaaaatttttcacttaaagaaaaaaaatgccatgaaacatttgaactgatgagccacagaacttcagttgaaatttttttcactttttagcatgctaaatatacatctgagtttaaatgttctgtttaatggccattcataaattcaagcactaccactggtcagttttgtgtgatagaataaaaatatgttacctgcagtgtaagtacagcacactgtcaaattcttttccttaaggtgcacagtaaatgtacagatagttataggccactgttttgtaatgtagtacatttctaatctattattcctaacctattataactgtttgcagaaagaaaagaatttttctaataatctgtaaaattatgctaacttctacaagtaggcttctaaataaaatttttaaaaagagcaaa

SEQ ID NO: 21355 - DNA, 3157 bp, Homo sapiens
cactagaatgtgaaggatcttcgcggttctgggtgcccagaaaggcggcgacgcggcggatgacaacattaggccgcgacgcgctcctggccaggcggcggctgtagtgttagctttggacgccgcagtagccgctgccggtagcaagccgactgagggaaggtgggggtccgcccgggctggtggacctcggggccgaaagttcccgccccgctcgggggctgagccggcagtgcctccgcggccgctgggcagcgcccttcgtccaggctcgcgccccagctgccgccgacgacagcggccgagagaagttggggtctgactagacgcttacggggcctcggaccccggcgccgcggcgacctcggaggaaccggctccttgcgtcccgcctccctgggagctccgcacgggatttgcagatttacagaatggctgcacattaatggaaagagaagcataaacctatcttctttcattatggagggaggtttggcagatggagaacctgatcgaacttcgcaaacagtgacgaatctcagcttctgacaccaggaaagatgagtcagcgccaaggaaaagaagcttatccaacgccaaccaaagatttgcatcagccatctcttagtccagcaagtcctcatagccagggttttgaaagagggaaggaagatatttctcaaaataaagatgaatcttcactttctatgtcaaagagcaagtctgaatctaaactttataatggctcagagaaggacagttcaacttcaagcaaactcacaaaaaaagaatctcttaaggtacaaaagaaaaattaccgagaagaaaagaaaagagccacaaaggagctgctcagtacaatcacagatccttctgttattgttatggctgattggttaaagattcgtggtactctaaagagctggaccaagttatggtgtgtgttgaaacctggggtgctactgatctataaaacccaaaaaaatggtcagtgggtaggaacagttcttctgaatgcctgtgaaatcattgaacgtccatcaaaaaaggatggcttttgtttcaaacttttccatcctttggagcaatctatttgggcagtgaagggtccaaaaggtgaagcggttggatccattactcaacccttacctagcagttatttgatcatccgagctacttcagagtcagatggaaggtgctggatggatgctttggagttggctttgaaatgttctagtcttcttaaacgtacaatgatcagagaaggaaaggaacatgacctgagcgtttcatcagatagcacacatgtgactttctatggcttactacgtgctaacaatctccacagtggtgataacttccagttaaatgatagtgaaattgaacgacaacattttaaggaccaagatatgtattctgataaatctgataaagaaaatgatcaagaacatgatgagtctgataatgaggtgatggggaaaagtgaagaaagtgacacagatacatcagaaagacaagatgactcatatatcgaacctgagcctgttgagcctttaaaggagactacctacactgaacagagccatgaagaacttggagaggcaggtgaggcttctcaaacagaaactgtatctgaagaaaacaaaagccttatctggacactattgaaacaagtccgtcctggcatggacctatccaaggtggttctgcctacatttattttggaaccccgttctttcctggataaactttcagattactactatcatgcagatttcctatctgaggcagctcttgaagaaaatccttatttccgtttgaagaaagtagtgaaatggtatttgtcaggattctataaaaagccaaagggactgaagaaaccttataatcctatacttggcgagactttccgttgtttatggattcatcccagaacaaacagcaaaactttttatattgctgaacaggtgtcccatcatccaccaatatctgccttttatgttagtaatcgaaaagatggattttgccttagcggtagtatcctggctaagtctaagttttatggaaactcattatctgcaatattagagggagaagcacggttaactttcttgaatagaggtgaagattatgtaatgacaatgccatacgctcattgtaaaggaattctttatggtacaatgacactggagcttggtggaacagtcaatattacatgtcaaaaaactggatacagtgcaatacttgaatttaaactaaagccattcctagggagtagtgactgtgttaatcaaatatcagggaaacttaaactgggaaaagaagtcctagctactttggaaggtcattgggatagtgaagtttttattactgataaaaagactgataattcagaggttttctggaatccaacacctgacattaagcaatggagattaataaggcacactgtaaaatttgaagaacagggagattttgaatcagagaaactctggcaacgggtaactcgagccataaatgccaaagaccaaactgaagctacccaagagaagtatgttttggaagaagctcaaagacaagctgccagggatcggaaaacaaaaaatgaagagtggtcttgcaaattatttgaacttgatccactcacaggagaatggcattacaagtttgcagatacccgaccatgggacccacttaatgatatgatacagtttgaaaaagatggtgttattcagaccaaagtgaaacatcgtactccaatggttagcgtccccaaaatgaaacataagccaaccaggcaacagaagaaagtagcaaaaggctattcctccccagaacctgacattcaagactcctctggaagtgaagctcaatcagtaaaaccaagtacaagaagaaagaaaggaatagaactgggagacattcagagttccatcgaatctataaaacaaacacaggaagaaattaaaagaaatattatggctcttcgaaatcatttagtttcaagcacaccggccacggattattttctgcaacaaaaagactacttcatcattttcctcctgattttgcttcaagtcataataaacttcatgttcaagtagaagttctctaccattgaatcagtgaactagaaagatctgatttggcctgggac

SEQ ID NO: 21356 - DNA, 2664 bp, Homo sapiens
cactagaatgtgaaggatcttcgcggttctgggtgcccagaaaggcggcgacgcggcggatgacaacattaggccgcgacgcgctcctggccaggcggcggctgtagtgttagctttggacgccgcagtagccgctgccggtagcaagccgactgagggaaggtgggggtccgcccgggctggtggacctcggggccgaaagttcccgccccgctcgggggctgagccggcagtgcctccgcggccgctgggcagcgcccttcgtccaggctcgcgccccagctgccgccgacgacagcggccgagagaagttggggtctgactagacgcttacggggcctcggaccccggcgccgcggcgacctcggaggaaccggctccttgcgtcccgcctccctgggagctccgcacgggatttgcagatttacagaatggctgcacattaatggaaagagaagcataaacctatcttctttcattatggagggaggtttggcagatggagaacctgatcgaacttcgcttcttggtgatagcaaagatgtccttgggccatcaactgttgtagcaaacagtgacgaatctcagcttctgacaccaggaaagatgagtcagcgccaaggaaaagaagcttatccaacgccaaccaaagatttgcatcagccatctcttagtccagcaagtcctcatagccagggttttgaaagagggaaggaagatatttctcaaaataaagatgaatcttcactttctatgtcaaagagcaagtctgaatctaaactttataatggctcagagaaggacagttcaacttcaagcaaactcacaaaaaaagaatctcttaaggtacaaaagaaaaattaccgagaagaaaagaaaagagccacaaaggagctgctcagtacaatcacagatccttctgttattgttatggctgattggttaaagattcgtggtactctaaagagctggaccaagttatggtgtgtgttgaaacctggggtgctactgatctataaaacccaaaaaaatggtcagtgggtaggaacagttcttctgaatgcctgtgaaatcattgaacgtccatcaaaaaaggatggcttttgtttcaaacttttccatcctttggagcaatctatttgggcagtgaagggtccaaaaggtgaagcggttggatccattactcaacccttacctagcagttatttgatcatccgagctacttcagagtcagatggaaggtgctggatggatgctttggagttggctttgaaatgttctagtcttcttaaacgtacaatgatcagagaaggaaaggaacatgacctgagcgtttcatcagatagcacacatgtgactttctatggcttactacgtgctaacaatctccacagtggtgataacttccagttaaatgatagtgaaattgaacgacaacattttaaggaccaagatatgtattctgataaatctgataaagaaaatgatcaagaacatgatgagtctgataatgaggtgatggggaaaagtgaagaaagtgacacagatacatcagaaagacaagatgactcatatatcgaacctgagcctgttgagcctttaaaggagactacctacactgaacagagccatgaagaacttggagaggcaggtgaggcttctcaaacagaaactgtatctgaagaaaacaaaagccttatctggacactattgaaacaagtccgtcctggcatggacctatccaaggtggttctgcctacatttattttggaaccccgttctttcctggataaactttcagattactactatcatgcagatttcctatctgaggcagctcttgaagaaaatccttatttccgtttgaagaaagtagtgaaatggtatttgtcaggattctataaaaagccaaagggactgaagaaaccttataatcctatacttggcgagactttccgttgtttatggattcatcccagaacaaacagcaaaactttttatattgctgaacaggtgtcccatcatccaccaatatctgccttttatgttagtaatcgaaaagatggattttgccttagcggtagtatcctggctaagtctaagttttatggaaactcattatctgcaatattagagggagaagcacggttaactttcttgaatagaggtgaagattatgtaatgacaatgccatacgctcattgtaaaggaattctttatggtacaatgacactggagcttggtggaacagtcaatattacatgtcaaaaaactggatacagtgcaatacttgaatttaaactaaagccattcctagggagtagtgactgtgttaatcaaatatcagggaaacttaaactgggaaaagaagtcctagctactttggaaggtcattgggatagtgaagtttttattactgataaaaagactgataattcagaggttttctggaatccaacacctgacattaagcaatggagattaataaggcacactgtaaaatttgaagaacagggagattttgaatcagagaaactctggcaacgggtaactcgagccataaatgccaaagaccaaactgaagctacccaagagaagtatgttttggaagaagctcaaagacaagctgccagggatcggaaaacaaaaaatgaaaagaagaaa

SEQ ID NO: 21357 - DNA, 7185 bp, Homo sapiens
cactagaatgtgaaggatcttcgcggttctgggtgcccagaaaggcggcgacgcggcggatgacaacattaggccgcgacgcgctcctggccaggcggcggctgtagtgttagctttggacgccgcagtagccgctgccggtagcaagccgactgagggaaggtgggggtccgcccgggctggtggacctcggggccgaaagttcccgccccgctcgggggctgagccggcagtgcctccgcggccgctgggcagcgcccttcgtccaggctcgcgccccagctgccgccgacgacagcggccgagagaagttggggtctgactagacgcttacggggcctcggaccccggcgccgcggcgacctcggaggaaccggctccttgcgtcccgcctccctgggagctccgcacgggatttgcagatttacagaatggctgcacattaatggaaagagaagcataaacctatcttctttcattatggagggaggtttggcagatggagaacctgatcgaacttcggcaaacagtgacgaatctcagcttctgacaccaggaaagatgagtcagcgccaaggaaaagaagcttatccaacgccaaccaaagatttgcatcagccatctcttagtccagcaagtcctcatagccagggttttgaaagagggaaggaagatatttctcaaaataaagatgaatcttcactttctatgtcaaagagcaagtctgaatctaaactttataatggctcagagaaggacagttcaacttcaagcaaactcacaaaaaaagaatctcttaaggtacaaaagaaaaattaccgagaagaaaagaaaagagccacaaaggagctgctcagtacaatcacagatccttctgttattgttatggctgattggttaaagattcgtggtactctaaagagctggaccaagttatggtgtgtgttgaaacctggggtgctactgatctataaaacccaaaaaaatggtcagtgggtaggaacagttcttctgaatgcctgtgaaatcattgaacgtccatcaaaaaaggatggcttttgtttcaaacttttccatcctttggagcaatctatttgggcagtgaagggtccaaaaggtgaagcggttggatccattactcaacccttacctagcagttatttgatcatccgagctacttcagagtcagatggaaggtgctggatggatgctttggagttggctttgaaatgttctagtcttcttaaacgtacaatgatcagagaaggaaaggaacatgacctgagcgtttcatcagatagcacacatgtgactttctatggcttactacgtgctaacaatctccacagtggtgataacttccagttaaatgatagtgaaattgaacgacaacattttaaggaccaagatatgtattctgataaatctgataaagaaaatgatcaagaacatgatgagtctgataatgaggtgatggggaaaagtgaagaaagtgacacagatacatcagaaagacaagatgactcatatatcgaacctgagcctgttgagcctttaaaggagactacctacactgaacagagccatgaagaacttggagaggcaggtgaggcttctcaaacagaaactgtatctgaagaaaacaaaagccttatctggacactattgaaacaagtccgtcctggcatggacctatccaaggtggttctgcctacatttattttggaaccccgttctttcctggataaactttcagattactactatcatgcagatttcctatctgaggcagctcttgaagaaaatccttatttccgtttgaagaaagtagtgaaatggtatttgtcaggattctataaaaagccaaagggactgaagaaaccttataatcctatacttggcgagactttccgttgtttatggattcatcccagaacaaacagcaaaactttttatattgctgaacaggtgtcccatcatccaccaatatctgccttttatgttagtaatcgaaaagatggattttgccttagcggtagtatcctggctaagtctaagttttatggaaactcattatctgcaatattagagggagaagcacggttaactttcttgaatagaggtgaagattatgtaatgacaatgccatacgctcattgtaaaggaattctttatggtacaatgacactggagcttggtggaacagtcaatattacatgtcaaaaaactggatacagtgcaatacttgaatttaaactaaagccattcctagggagtagtgactgtgttaatcaaatatcagggaaacttaaactgggaaaagaagtcctagctactttggaaggtcattgggatagtgaagtttttattactgataaaaagactgataattcagaggttttctggaatccaacacctgacattaagcaatggagattaataaggcacactgtaaaatttgaagaacagggagattttgaatcagagaaactctggcaacgggtaactcgagccataaatgccaaagaccaaactgaagctacccaagagaagtatgttttggaagaagctcaaagacaagctgccagggatcggaaaacaaaaaatgaagagtggtcttgcaaattatttgaacttgatccactcacaggagaatggcattacaagtttgcagatacccgaccatgggacccacttaatgatatgatacagtttgaaaaagatggtgttattcagaccaaagtgaaacatcgtactccaatggttagcgtccccaaaatgaaacataagccaaccaggcaacagaagaaagtagcaaaaggctattcctccccagaacctgacattcaagactcctctggaagtgaagctcaatcagtaaaaccaagtacaagaagaaagaaaggaatagaactgggagacattcagagttccatcgaatctataaaacaaacacaggaagaaattaaaagaaatattatggctcttcgaaatcatttagtttcaagcacaccggccacggattattttctgcaacaaaaagactacttcatcattttcctcctgattttgcttcaagtcataataaacttcatgttcaagtagaagttctctaccattgaatcagtgaactagaaagatctgatttggcctgggaccagtgttcaagttggtttggtctttattaaaaatcacaatattccgaaaacaaaaaaacctaggagataaatgtagaggtattgacttttcgtatcttttatcttcacactgaaacaagagctatcctatttgattattaaagtgagctatgtgttaagtgccaggacatttctagcttttgtgagaatgtgtctacatatgagtataataaacccacatgtatacacaattgtctcttatgtactcctacctgacagtagtctttgtattctatagtatgttctgagatataatgttaacattgttcataacaaaaaatgctatcaatcttataaatatatgtaatctattttcttcataaaacaggcacaaaagttttatcagtaaggaattacagattgagaaatgatggaataatagacataattaattcaatacactactgttaaaatcatttgcaaagcactcagctcaattatcttcttagaaagaaagaaaaagtatgaatggtcaaaatgaatacatcgagagagataaatggcaaattgcttttttaaaagtttacataagttttttttaacccctagaatttaatatttgtagatgcaggtaaatatatatacttacgtgtatatcagtataaaaacactggtgtgcaattaattggattgattataataccaccttaagcacttgctgaaaaaagtgtggtcaaaattgattgctgtccttttgtcttatttttgtttttcttaagtcagctggttcataacataggccaaattctagagatgtttatagagcatttgaagtgctgataatttatgttttttcattatgaaaacttattttagctttagactccagtgtgttcagtgaataagtagaatataaaaaaatataaccagtattttacttcaaaagccaaaaagaggcaataagaaaagacactttgtggtggcctttatgtgtgcattaaaattggtttctgtaaaacgtgtaataagttgagtatctacgaagagtatcaagttctgaagtttaatttttttattatcctcctctcttcttagtaacttctttctgtggcaaaaccacaattctttaagattcctattgttcaggctaaggcaaatttttttgtttgtttcttcagtttaatattttgattttgtgtttttacgtaaatatttatattccttgaaagcaatttttgccaaggtagttcagtttaggaatatgttgttctaaaatatgtcttagaatcctgaaagcatagattttgaaatgtttttttaatgaaaatgaaggtcagagagaataattgccctgaccacatttgcctttcagtaggaggaggctgtgaaatagtaaaattataatcgtttatgccatgataaatacaagattggtaaataaatacattgattggtaaattatgagaatcaaaatgataaaaagagcctgcttttttccctaaccaatatagctatcttaagtatccttaggtttctgtgaagaaccatttcccatgttttcttggcaaaataatgctgtattccatatgtacatgtgaaatgatgttttaaattgataaaagcttaaataagatctacctatacccagtattttcatgatattagaacaaatgggtttttggttatattttatatttgtcaatataatttttgtattcacattctgttacactctgcctattcattgatatatgatattctgtaaatattgtacaatttgatcttttttatggtttaaattagttaattacatacaaattgattggcttatcacaaaaatcatttcatcagtaaaccttgttaacattttgtactggtgacccacctcttaggactttggtcttatccacgtgtatgttgttttcatttggtccaaataatattttatttgtatgggtatcttctaagactaaataggtagttgtgttctttatttttaaaatttctttttagagcaaatgttatgggttcttacccaaagagtcaaaaactatttcttaagaaagagcagagttattcatgactgttctttatacactaaaagcatgcatctaatctaatagtcctcttattatgcttttagttgtatgagtctctttctatgaactgaacacaaaactcaggaattggtggcttaattttagatcagtgcttgtactaggcttagttatatgaatctttataacacataattactaactttgtagccatatatgtaattgactttgaatgttatttacctgaaattaatcttccttcacacatggaccgtaaacggttcccagttgtctgagagcctcatgagggtttctaggatttatgaccttatgaccagtttttttcatttaccaagattttattttcctacatgaaaatttaattgagtaataattattcacatgtgcattttctttttagctgttaaatgtactatgccatcatccaccatttagtaaaatgtagctggcccaggacatgtaaaaaaaaaaaaaaaacaacaacaataaatagggcatgtgaaatgttaagttacagcaatagatattttatttgtatttcatgttagtacttttttgttttatatcacttataaaggtacagtgtactctttgtcacagctcagttggtaaccgcattccattgaaaagttggccttgtaaaatacaactctcatttaatattcatgcttttgtgcctttaagaaaatattttttgtcattttttgtgttacagaactataatgtgattcaaggtgtttataggcttgtcataaaagggtcatttctgtgtgttactttctttttatatagctatagtatatttaaacaataatactatcttttataggggtttgtctatttacctattctttactcagacattgatgtagacttgtcagattattctgagtattgttaacagtgccttttcgatggaatcacactttttggctgtcaccttgtgccatatacacacaaaattttgtggaaggcagttttaactttctgaagaatatctgtcaaaatttaagaaaacaaatgtataaaattccattttttccagtgtttagcatttctagtaagcagtgaggttgtttgacatacagtgatgatggcattattgataagccatacatgagactgcagattatattgaatcatattaaatgtacagaaataaaatattagatttatatcaaattttccaatttgaaccagtggggaaaatcccacagaaatcagtaagtttacatttcaatttctatcttatttgactaagtggaaagagattctttaaaatgtataacctgccattatgtaatttggtttcattttattctacctgttgtgtgagtttagtatatttaatttactttttgttactctttacatactgtttatttttgttagtttttaattgaagatggactgttgaaattgtataggaccagtgtcttattaatatgattaatatatttagaagagccacgtgaaacccatgacaaaatgaatgtgaatattctttctaaaaatttagaaaatgttatctttttgcatttattatgtaaaactgttttacagtatcaaaatttttcacttaaagaaaaaaaatgccatgaaacatttgaactgatgagccacagaacttcagttgaaatttttttcactttttagcatgctaaatatacatctgagtttaaatgttctgtttaatggccattcataaattcaagcactaccactggtcagttttgtgtgatagaataaaaatatgttacctgcagtgtaagtacagcacactgtcaaattcttttccttaaggtgcacagtaaatgtacagatagttataggccactgttttgtaatgtagtacatttctaatctattattcctaacctattataactgtttgcagaaagaaaagaatttttctaataatctgtaaaattatgctaacttctacaagtaggcttctaaataaaattttt

SEQ ID NO: 21358 - DNA, 363 bp, Homo sapiens
gagaagttggggtctgactagacgcttacggggcctcggaccccggcgccgcggcgacctcggaggaaccggctccttgcgtcccgcctccctgggagctccgcacggcaatctccattggtgctactgcgtttaaaggatttgcagatttacagaatggctgcacattaatggaaagagaagcataaacctatcttctttcattatggagggaggtttggcagatggagaacctgatcgaacttcgcttcttggtgatagcaaagatgtccttgggccatcaacaaacagtgacgaatctcagcttctgacaccaggaaagatgagtcagcgccaaggaaaagaagcttatccaacgccaac

SEQ ID NO: 21359 - DNA, 732 bp, Homo sapiens
gcggctgtagtgttagctttggacgccgcagtagccgctgccggtagcaagccgactgagggaaggtgggggtccgcccgggctggtggacctcggggccgaaagttcccgccccgctcgggggctgagccggcagtgcctccgcggccgctgggcagcgcccttcgtccaggctcgcgccccagctgccgccgacgacagcggccgagagaagttggggtctgactagacgcttacggggcctcggaccccggcgccgcggcgacctcggaggaaccggctccttgcgtcccgcctccctgggagctccgcacggcaatctccattggtgctactgcgtttaaaggatttgcagatttacagaatggctgcacattaatggaaagagaagcataaacctatcttctttcattatggagggaggtttggcagatggagaacctgatcgaacttcgctgttgtagcaaacagtgacgaatctcagcttctgacaccaggaaagatgagtcagcgccaaggaaaagaagcttatccaacgccaaccaaagatttgcatcagccatctcttagtccagcaagtcctcatagccagggttttgaaagagggaaggaagatatttctcaaaataaagatgaatcttcactttctatgtcaaagagcaagtctgaatctaaactttataatggctcagagaaggacagttcaacttcaagcaaactcacaaaaaaaga

SEQ ID NO: 21360 - DNA, 531 bp, Homo sapiens
gcggccgctgggcagcgcccttcgtccaggctcgcgccccagctgccgccgacgacagcggccgagagaagttggggtctgactagacgcttacggggcctcggaccccggcgccgcggcgacctcggaggaaccggctccttgcgtcccgcctccctgggagctccgcacggcaatctccattggtgctactgcgtttaaagaactgtggctaacctccaagagactgaagctggtaattaaacattcctatccttgcctgaagcagtcttttgcaggaacatttgaggatttgcagatttacagaatggctgcacattaatggaaagagaagcataaacctatcttctttcattatggagggaggtttggcagatggagaacctgatcgaacttcgcttcttggtgatagcaaagatgtccttgggccatcaactgttgtagcaaacagtgacgaatctcagcttctgacaccaggaaagatgagtcagcgccaaggaaaagaagcttatccaacgccaaccaaagatt

SEQ ID NO: 21361 - DNA, 902 bp, Homo sapiens
actagaatgtgaaggatcttcgcggttctgggtgcccagaaaggcggcgacgcggcggatgacaacattaggccgcgacgcgctcctggccaggcggcggctgtagtgttagctttggacgccgcagtagccgctgccggtagcaagccgactgagggaaggtgggggtccgcccgggctggtggacctcggggccgaaagttcccgccccgctcgggggctgagccggcagtgcctccgcggccgctgggcagcgcccttcgtccaggctcgcgccccagctgccgccgacgacagcggccgagagaagttggggtctgactagacgcttacggggcctcggaccccggcgccgcggcgacctcggaggaaccggctccttgcgtcccgcctccctgggagctccgcacgggatttgcagatttacagaatggctgcacattaatggaaagagaagcataaacctatcttctttcattatggagggaggtttggcagatggagaacctgatcgaacttcgctgttgtagcaaacagtgacgaatctcagcttctgacaccaggaaagatgagtcagcgccaaggaaaagaagcttatccaacgccaaccaaagatttgcatcagccatctcttagtccagcaagtcctcatagccagggttttgaaagagggaaggaagatatttctcaaaataaagatgaatcttcactttctatgtcaaagagcaagtctgaatctaaactttataatggctcagagaaggacagttcaacttcaagcaaactcacaaaaaaagaatctcttaaggtacaaaagaaaaattaccgagaagaaaagaaaagagccacaaaggagctgctcagtacaatcacagatccttctgttattgttatggctgatt

SEQ ID NO: 21362 - DNA, 3836 bp, Homo sapiens
ttataaataatcttaatagcagtattcacgtttgcattctcgcatccgtggcatggagtcctacacacaataggcgccctaagaaagcgtgtttgacttgatcgctggagcatctgccggcaccgcccaggacccgcccaggacccgccccgccccctgcggccccgccccccgcatgctgaatgccatataggcgagtgacgtcaggccgtttgttgtcattggcggctcccaagatggcgtccatcatggaagggccgctgagcaaatggactaacgtgatgaagggctggcagtaccgttggttcgtgctggactacaatgcaggactgctctcctactacacgtccaaggacaaaatgatgagaggctctcgcagaggatgtgttagactcagaggagctgtgattggtatagacgatgaggacgacagcaccttcacaataactgttgatcagaaaaccttccatttccaggcccgtgatgctgatgagcgagagaagtggatccatgccttagaagaaacaattcttcgacatactctccagcttcaaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggattacagtttaattaattattcttagtgcttaaggcttcataaagtaatttttccaaccttttttttaaaaatgtgcatcttttattatcttttatggttaaacttggaagccaattatttggcaaccttgaatacaagagctagcttttcaaagaaagacacttgaaataatggaggatccattcttttcctctgtcagattgtatgttctgtctttagcccctgccaggcaattccccagaatcttcacttaactcatattgcacatgtagggctgcctaccaacattttatccaaaaatgttttattgccttagagggtttgggaagagtgtgtatttatagatccccaccccacagtgaacaaaaatagatagatagatagaataaaatgaatgccacagcagcagatggctcattctgaagggaaatacagaactatatctatctatctatctatcatcttttttatttaaaaatacattaaaaaaacaggtattagtacctagcatttagttagttattcaatatactggttacgtaaggcctttcaagaagtagattctcagtctgagaggacacaggccagggcttctcaaagtgctgctgcaggctttctggtctcgcttggcccattctgctaattttcctttgccagctcctacagtaaccctgggtttattagtctcaacaaaggataaaaagtaaatcaaatgctatgatgccagtgcaaaacttcaatggaagccctaaggcagtagtataactaactccataaaatacaaacaaacacattttaaaatacacattgcttcaggcc

SEQ ID NO: 21363 - DNA, 2721 bp, Homo sapiens
gaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggattacagtttaattaattattcttagtgcttaaggcttcataaagtaatttttccaaccttttttttaaaaa

SEQ ID NO: 21364 - DNA, 3875 bp, Homo sapiens
ttataaataatcttaatagcagtattcacgtttgcattctcgcatccgtggcatggagtcctacacacaataggcgccctaagaaagcgtgtttgacttgatcgctggagcatctgccggcaccgcccaggacccgcccaggacccgccccgccccctgcggccccgccccccgcatgctgaatgccatataggcgagtgacgtcaggccgtttgttgtcattggcggctcccaagatggcgtccatcatggaagggccgctgagcaaatggactaacgtgatgaagggctggcagtaccgttggttcgtgctggactacaatgcaggactgctctcctactacacgtccaaggacaaaatgatgagaggctctcgcagaggatgtgttagactcagaggagctgtgattggtatagacgatgaggacgacagcaccttcacaataactgttgatcagaaaaccttccatttccaggcccgtgatgctgatgagcgagagaagtggatccatgccttagaagaaacaattcttcgacatactctccagcttcaaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggattacagtttaattaattattcttagtgcttaaggcttcataaagtaatttttccaaccttttttttaaaaatgtgcatcttttattatcttttatggttaaacttggaagccaattatttggcaaccttgaatacaagagctagcttttcaaagaaagacacttgaaataatggaggatccattcttttcctctgtcagattgtatgttctgtctttagcccctgccaggcaattccccagaatcttcacttaactcatattgcacatgtagggctgcctaccaacattttatccaaaaatgttttattgccttagagggtttgggaagagtgtgtatttatagatccccaccccacagtgaacaaaaatagatagatagatagaataaaatgaatgccacagcagcagatggctcattctgaagggaaatacagaactatatctatctatctatctatcatcttttttatttaaaaatacattaaaaaaacaggtattagtacctagcatttagttagttattcaatatactggttacgtaaggcctttcaagaagtagattctcagtctgagaggacacaggccagggcttctcaaagtgctgctgcaggctttctggtctcgcttggcccattctgctaattttcctttgccagctcctacagtaaccctgggtttattagtctcaacaaaggataaaaagtaaatcaaatgctatgatgccagtgcaaaacttcaatggaagccctaaggcagtagtataactaactccataaaatacaaacaaacacattttaaaatacacattgcttcaggcc

SEQ ID NO: 21365 - DNA, 3352 bp, Homo sapiens
atgattataagcttcctgaggcctccctagaagctgagcagatggcagaaccatgcttcctgtaaatcctgcagaatcaagaaggaactgagtctctaagatggaggatatacaactgacaagtagtaaagtcaagatacacagccagacagtgtctcagtctggcatccaactcaggctggagtgcagtgacatgatcttggctcactgcagtcttgacctcctgggctcaagcaatcctcctgcctcagcttcctgagtagattataaataatcttaatagcagtattcacgtttgcattctcgcatccgtggcatggagtcctacacacaataggcgccctaagaaagcgtgtttgacttgatcgctggagcatctgccggcaccgcccaggacccgcccaggacccgccccgccccctgcggccccgccccccgcatgctgaatgccatataggcgagtgacgtcaggccgtttgttgtcattggcggctcccaagatggcgtccatcatggaagggccgctgagcaaatggactaacgtgatgaagggctggcagtaccgttggttcgtgctggactacaatgcaggactgctctcctactacacgtccaaggacaaaatgatgagaggctctcgcagaggatgtgttagactcagaggagctgtgattggtatagacgatgaggacgacagcaccttcacaataactgttgatcagaaaaccttccatttccaggcccgtgatgctgatgagcgagagaagtggatccatgccttagaagaaacaattcttcgacatactctccagcttcaaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggattacagtttaattaattattcttagtgcttaaggcttcataaagtaatttttccaaccttttttttaaaaa

SEQ ID NO: 21366 - DNA, 2893 bp, Homo sapiens
agatggcgtccatcatggaagggccgctgagcaaatggactaacgtgatgaagggctggcagtaccgttggttcgtgctggactacaatgcaggactgctctcctactacacgtccaaggacaaaatgatgagaggctctcgcagaggatgtgttagactcagaggagctgtgattggtatagacgatgaggacgacagcaccttcacaataactgttgatcagaaaaccttccatttccaggcccgtgatgctgatgagcgagagaagtggatccatgccttagaagaaacaattcttcgacatactctccagcttcaaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggattacagtttaattaattattcttagtgcttaaggcttcataaagtaatttttccaaccttttttttaaaaa

SEQ ID NO: 21367 - DNA, 2826 bp, Homo sapiens
gtcattggcggctcccaagatggcgtccatcatggaagggccgctgagcaaatggactaacgtgatgaagggctggcagtaccgttggttcgtgctggactacaatgcaggactgctctcctactacacgtccaaggacaaaatgatgagaggctctcgcagaggatgtgttagactcagacccgtgatgctgatgagcgagagaagtggatccatgccttagaagaaacaattcttcgacatactctccagcttcaaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggattacagtttaattaattattcttagtgcttaaggcttcataaagtaatttttccaacctttttttt

SEQ ID NO: 21368 - DNA, 2940 bp, Homo sapiens
gtcattggcggctcccaagatggcgtccatcatggaagggccgctgagcaaatggactaacgtgatgaagggctggcagtaccgttggttcgtgctggactacaatgcaggactgctctcctactacacgtccaaggacaaaatgatgagaggctctcgcagaggatgtgttagactcagaggagctgtgattggtatagacgatgaggacgacagcaccttcacaataactgttgatcagaaaaccttccatttccaggcccgtgatgctgatgagcgagagaagtggatccatgccttagaagaaacaattcttcgacatactctccagcttcaaatcagtaccacacttgcttttttccagtcttctggtatctctccagttcttgaattttcaaaaataattggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggattacagtttaattaattattcttagtgcttaaggcttcataaagtaatttttccaaccttttttttaaaaa

SEQ ID NO: 21369 - DNA, 2842 bp, Homo sapiens
agatggcgtccatcatggaagggccgctgagcaaatggactaacgtgatgaagggctggcagtaccgttggttcgtgctggactacaatgcaggactgctctcctactacacgggagctgtgattggtatagacgatgaggacgacagcaccttcacaataactgttgatcagaaaaccttccatttccaggcccgtgatgctgatgagcgagagaagtggatccatgccttagaagaaacaattcttcgacatactctccagcttcaaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggattacagtttaattaattattcttagtgcttaaggcttcataaagtaatttttccaaccttttttttaaaaa

SEQ ID NO: 21370 - DNA, 2755 bp, Homo sapiens
agaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggattacagtttaattaattattcttagtgcttaaggcttcataaagtaatttttccaaccttttttttaaaaa

SEQ ID NO: 21371 - DNA, 630 bp, Homo sapiens
agtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagatgggattctgctatgttgcctaggctggtctcctagcctcaagcgatcctccttccttggcctaccaaagcagtgggattacagagcatggtagaatcaattaaacactgcattgtgttgctgcagattgccaaagaccagagtaatgcggagaagcacgcagatggaatgatagtaagtttaat

SEQ ID NO: 21372 - DNA, 2529 bp, Homo sapiens
cggcccctacccctgagtccccggggtcccggccgccaggccggagcgcgaatgtcgtgctcaccctgcctccttcccgccgccccctgggctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggattacagtttaattaattattcttagtgcttaaggcttcataaagtaatttttccaaccttttttttaaaaa

SEQ ID NO: 21373 - DNA, 2372 bp, Homo sapiens
atctgcttcttttcttctcttttgggttgtttgctggatgacttgaatggttttgcaactgatcctgcatgaacgagtgcataggaacattctggatgaagtggtactgcaggttaggcagggatttgtatctgcaatggatgtagatcgatttgaaacgactgtggatctggctgcagttggagatgaaaattttaaaggataaaaatcagtgaagggagagagtaatgggctgctgctgctgctggcttgtgtttacagaagcccgtgatgctgatgagcgagagaagtggatccatgccttagaagaaacaattcttcgacatactctccagcttcaaggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttccctttt

SEQ ID NO: 21374 - DNA, 581 bp, Homo sapiens
atcaaggtgaaactccggggaccaggctccacagctgccataaactggatggcacgttagaagccggtgggtgtagggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctctt

SEQ ID NO: 21375 - DNA, 4364 bp, Homo sapiens
atttgttaaggctctgggaccaacgctgggcgaaccagctccgctccggaggggtctgcgcggctggcctcgcccgccccctagcggacccgtgcgatagtgcagcctcagccccagcgcacagcgccgcatccagacgctgtccgcgcgcgcagcctgggaggcgctcctcgctcgcctcctgtacccatccagcgaccagccaggctgcggcgaggggattccaaccgaggctccagtgagagacctcagcttagcatcacattaggtgcagccggcaggccatcccaactcgggccgggagcgcacgcgtcactggggccgtcagtcgccgtgcaacttccccggggggagtcaactttaggttcgcctgcggactcggtgcagtggaagccgctgaacatcccgaggaactggcacgctgggggctctgggcttgtggccggtagaggattcccgctcatttgcagtggctcagaggagggtggacccagcagatccgtccgtggagtctccaggagtggagccccgggcgcccctacaccctccgacacgccggatccggcccagccgcgccaagccgtaaagggctcgaaggccggggcgcaccgctgccgccagggtcatggagggcgcgctcgcagccaactggagcgccgaggcagccaacgccagcgccgcgccgccgggggccgagggcaaccgcaccgccggacccccgcggcgcaacgaggccctggcgcgcgtggaggtggcggtgctgtgtctcatcctgctcctggcgctgagcgggaacgcgtgtgtgctgctggcgctgcgcaccacacgccagaagcactcgcgcctcttcttcttcatgaagcacctaagcatcgccgacctggtggtggcagtgtttcaggtgctgccgcagttgctgtgggacatcaccttccgcttctacgggcccgacctgctgtgccgcctggtcaagtacttgcaggtggtgggcatgttcgcctccacctacctgctgctgctcatgtccctggaccgctgcctggccatctgccagccgctgcgctcgctgcgccgccgcaccgaccgcctggcagtgctcgccacgtggctcggctgcctggtggccagcgcgccgcaggtgcacatcttctctctgcgcgaggtggctgacggcgtcttcgactgctgggccgtcttcatccagccctggggacccaaggcctacatcacatggatcacgctagctgtctacatcgtgccggtcatcgtgctcgctgcctgctacggccttatcagcttcaagatctggcagaacttgcggctcaagaccgctgcagcggcggcggccgaggcgccagagggcgcggcggctggcgatggggggcgcgtggccctggcgcgtgtcagcagcgtcaagctcatctccaaggccaagatccgcacggtcaagatgactttcatcatcgtgctggccttcatcgtgtgctggacgcctttcttcttcgtgcagatgtggagcgtctgggatgccaacgcgcccaaggaagcctcggccttcatcatcgtcatgctcctggccagcctcaacagctgctgcaacccctggatctacatgctgttcacgggccacctcttccacgaactcgtgcagcgcttcctgtgctgctccgccagctacctgaagggcagacgcctgggagagacgagtgccagcaaaaagagcaactcgtcctcctttgtcctgagccatcgcagctccagccagaggagctgctcccagccatccacggcgtgacccaccagccagggccagggctgcagcctgaggctcaggctgtgctggcataagtgctctgctcctaggtgatggcgtatgtttgtgtataaggtacctatcagtttgtatccctcccctccttggggtggcttcagtggggtggagagtggcctccatgatggaagatgataggggactcagccatcagacaacaccctggcctcctacacgtacttctaccaccctgaacccactgctgccctgggcagtgagtggcttgttttttctcctggacttgtaatttcactccagtatatttttacttcttcattctgggatattgtgaaaagcggtaaatataggattggtgaccaattgggtcaggaagtccagtgttctggacttggggtaagcagtggggttgggacctcagatgggaagggtggtgctaagatcctcctgacctcaaagtgtatttgcctttaagcgaacaaatgctggggtccttggggaccagcttgtcagagggtagccctaagagaaggggattaccttgtaagaccatctggcgcagtggacctattagaacttgggttaaaaatgtttaagaagctaatgtttaagaagcatttgggaaagaaaaagaaataaatgtatccagataggaaaagaagaagtaaaactatttgcagatgacacagttttgtatatagaaaatcctaaggaactcacacacacacacacacacacacacgcacacagctattagaactaataagcaagttccgcaaggtttcaagatacaagatcaatatacaaaaatgaattgtatttctttatactagcaacaaacaatatgaaaacgaagttaaataattccatttataataccatcagaaagaataaaataggaatcaacttaacaaaacaagtgcaagactgaaaactacaaaattggaaagaaattaaagaaggcttaaataaatggaaagacatcctgtgttcatggatcagacttagtattgttaagatggcaatactatcctaactgacatgcagattcagtgcaatccttatgaaaatcatagctggcttctttacagaaattgataagctagtcccaaaattcataaagaaatgcaagggacccagaatatccaaataagccttgaaaaagaacaaagttggtggattcacacttcctgatttcataatttacgataaaggtaatcagctcagtgtgttactggtttaaggatagacatacggagcagaataaagagtacagatatgaacacttatacttacggtcaattgatttttgacaaggttcccaagacaattcaatagagaaaggagagtcttttcaacaaatggcaccgagacaatgatatgcaagtgcaaaagaatgaggttggacctttactcacactatgtgcaaaaatcaactcaaaacgcatccaagatctaaatataagagctgaaactataaaatcttagaaagaaacataggcatagatctttgtaaccttgaattaggcagtggtttcttagatatgataccaaagacacaagcaaccaatggaaaaataggtaaattggacttaatcaagatttgaagcttttgtgattgaaaagaccctatcaagaaggtgaaaagataacctgcagaatgggagaaaatatttgcgagtcatatatatgataaggggcttgtatctggaatatataaataactcttataacacaacaataaggagaaaaataaatcaatttaaaaaatgggctaacggtttgaatagacatttctccaaagaagatatgcaaatggctactaagcacatgaaaaaatactcaacattattattcattagggaaatgcaagtcaaaatcacaatgagattccagtttacaatcactaggatggctacaataaaaagatggacaagaacgagtgtcggtgaggatgtagagaaactggtagaaatttaaattgttggtgggaatgtaaatggtgcacctgctttgaaaaacagtttggcagtacctcaaaaagttaaacgtagagtgaccatatgacccaggaatgccactcctaggtatttacccaagagaaatgaaaacgtacatacacacaaaaacttgtacaccaatgttcatagcaacattatttgtaatagccaaaaagtggaaacaacccaaatgtctaccaactgatgaatgggaaataaaatgtggtctgtccacgcaatggaacattattagactctaaaaagaaatgaagtactcacacatgccacaacatggatgagccttgaaaacttgctaagtgaaagaagccaggtgcaaaagcccacatattgtctgactgcattgaaatgcaatgtctaaaatggacgaatctatatagagtgaatatagattagcgtttgccagggcctggaggctgtgagagatgaggcatgactactaagggtttggggtttctttttcgggtgatgaaaatgttctgaaattagtggtgattgtgcacgattttgagaatgtactaaaaaccaatgaactttaaaaaataaaaataaacaaa

SEQ ID NO: 21376 - DNA, 743 bp, Homo sapiens
aaaataaacccatttgttaaggctctgggaccaacgctgggcgaaccagctccgctccggaggggtctgcgcggctggcctcgcccgccccctagcggacccgtgcgatagtgcagcctcagccccagcgcacagcgccgcatccagacgctgtccgcgcgcgcagcctgggaggcgctcctcgctcgcctcctgtacccatccagcgaccagccaggctgcggcgaggggattccaaccgaggctccagtgagagacctcagcttagcatcacattaggtgcagccggcaggccatcccaactcgggccgggagcgcacgcgtcactggggccgtcagtcgccgtgcaacttccccggggggagtcaactttagtggaagccgctgaacatcccgaggaactggcacgctgggggctctgggcttgtggccggtagaggattcccgctcatttgcagtggctcagaggagggtggacccagcagatccgtccgtggagtctccaggagtggagccccgggcgcccctacaccctccgacacgccggatccggcccagccgcgccaagccgtaaagggctcgaaggccggggcgcaccgctgccgccagggtcatggagggcgcgctcgcagccaactggagcgccgaggcagccaacgccagcgccgcgccgccgggggccgagggcaaccgcaccgccggacccccgcggcgcaacgaggccctggcgcgcgtggaggtgg

SEQ ID NO: 21377 - DNA, 600 bp, Homo sapiens
tggagattccctcggggaggtgatttggttttagattcccactcccggaggaacgttgctgattttgaccctcccttctcccccagtggaagccgctgaacatcccgaggaactggcacgctgggggctctgggcttgtggccggtagaggattcccgctcatttgcagtggctcagaggagggtggacccagcagatccgtccgtggagtctccaggagtggagccccgggcgcccctacaccctccgacacgccggatccggcccagccgcgccaagccgtaaagggctcgaaggccggggcgcaccgctgccgccagggtcatggagggcgcgctcgcagccaactggagcgccgaggcagccaacgccagcgccgcgccgccgggggccgagggcaaccgcaccgccggacccccgcggcgcaacgaggccctggcgcgcgtggaggtggcggtgctgtgtctcatcctgctcctggcgctgagcgggaacgcgtgtgtgctgctggcgctgcgcaccacacgccagaagcactcgcgcctcttcttcttcatgaagcacctaagcatcgccgacctggtggtggcagtgtttcag

SEQ ID NO: 21378 - DNA, 513 bp, Homo sapiens
accagtcacggaccctggacccagcgcacccgcaccatggccggccccagcctcgcttgctgtctgctcggcctcctggcgctgacctccgcctgctacatccagaactgccccctgggaggcaagagggccgcgccggacctcgacgtgcgcaagtgcctcccctgcggccccgggggcaaaggccgctgcttcgggcccaatatctgctgcgcggaagagctgggctgcttcgtgggcaccgccgaagcgctgcgctgccaggaggagaactacctgccgtcgccctgccagtccggccagaaggcgtgcgggagcgggggccgctgcgcggtcttgggcctctgctgcagcccggacggctgccacgccgaccctgcctgcgacgcggaagccaccttctcccagcgctgaaacttgatggctccgaacaccctcgaagcgcgccactcgcttcccccatagccaccccagaaatggtgaaaataaaataaagcaggtttttctcctcta

SEQ ID NO: 21379 - DNA, 665 bp, Homo sapiens
gcccacgtggagaacgccagggagctgtgagagtgtgcagtcgcgttcctgctgtccggacacttttttcctctactgagactcatctggtagatccgcaggccagtcctcccaggggctgaagttgtgaaatatgggttttctaagaagattaatctatcggcgtagaccaatgatctatgtagaatcttctgaggagtccagtgatgagcaacctgacgaagtggaatcaccaactcaaagtcaggattctacacctgctgaagagagagaggatgagggagcatctgcagctcaagggcaggagcctgaagctgatagccaggaactggttcagccaaagactgggtgtgagcttggagatggtcctgataccaagagggtgtgcctgcgaaatgaagagcagatgaaactgcccgcagaagggccagagcctgaagcggatagccaggaacaggttcacccgaagactgggtgtgagcgcggagatggtcctgatgtccaggagttgggcctgccaaatccagaggaggtgaaaacacctgaggaagatgaagggcaatcacagccttaaaagaagacacgctgaaatggttcaggctgctcctgtgttggaaatttgaccattaaaattctcccaataaagctttacagccttctgcaaa

SEQ ID NO: 21380 - DNA, 551 bp, Homo sapiens
tgcccgtcttgtgtccgcacagaggtctgcaaggagagagagtgtcttcattctttccgccatcttgattctttctcactgaccaagactcagccgtgggaaatatgagtgagcttctaagagcaagatcccaatcctcagaaagaggaaatgaccaagagtcttcccagccggttggatctgtgattgtccaggagcccactgaggaaaaacgtcaagaagaggaaccaccaactgataatcagggtattgcacctagtggggagattgaaaatcaagcagtgcctgcttttcaagggcctgacatggaagcttttcaacaggaactggctctgcttaagatagaggatgagcctggagatggtcctgatgtcagggagggtattatgcccacttttgatctcactaaagtgctggaagcaggtgatgcgcaaccataggtttcaagcaagacaaatgaagactgaaaccaagaacgttattcttaatctggaaatttgactgataatattctcttaataaagttttaagttttctgcaaagaatcctta

SEQ ID NO: 21381 - DNA, 311 bp, Homo sapiens
agttgtgagagaatgtgtggaggagccagctggctttggacaggtcctgcggcacagtctgtggcttctgagggaaaagggcctcggggccgtcatccagctcctcccagtgggaaatatgagtgagcttctaagagcaagatcccaatcctcagaaagaggaaatgaccaagagtcttcccagccggttggatctgtgattgtccaggagcccactgaggaaaaacgtcaagaagaggaaccaccaactgataatcagggtattgcacctagtggggagattgaaaatcaagcagtgcctgcttttcaag

SEQ ID NO: 21382 - DNA, 742 bp, Homo sapiens
cttcattctttctcactgactgggactcagctggtaggtccgcagatcagtcctcctgggaatttagttgtgagtgaatgtgaaggggagccagcgggctttggacaggtcctgcggcacagaaaccacagtccgtggcttctgagagaaaagggcctcgccgtcgacgtccggctcctcccaggtcgcgacgccccatgggcctttgtcgtcgtttctgggccaggacgacggaggaaggtggaccgtagaggggaggaatcacgtgaagatggggcgagtgctgggcgtgctgttggagagtgaaacatgagtggacatcaaagaacaagatccagatctagagaaagaagagatgatcaagactctaatcatccagtaggggctgtggttgcccaggagctgcccagtaatgaccagcttcaacaagaggaaccaccaattgaaagtcaggattatacacctggtcaagagagagacgagggagcactggacttccaagtgctaggcctggcagcctatctctgggaactgactcggtcaaagactgggggtgaacgtggagatggtcctaatgtcaagggagaatttctgccaaatctggagcctgttaaaataccagaagcaggtgaagggcaaccatcggtttaaatgaagacaagctgaaaccatacatgcagtctttatgttggaaacttcaccagtaaaattctctcaataaagtttcacaattgtctgcaaa

SEQ ID NO: 21383 - DNA, 577 bp, Homo sapiens
gcacagaaaccacagtccgtggcttctgagagaaaagggcctcgccgtcgacgtccggctcctcccaggtcgcgacgccccatgggcctttgtcgtcgtttctgggccaggacgacggaggaaggtggaccgtagaggggaggaatcacgtgaagatggggcgagtgctgggcgtgctgttggagtatgccactttcagagtgaaacatgagtggacatcaaagaacaagatccagatctagagaaagaagagatgatcaagactctaatcatccagtaggggctgtggttgcccaggagctgcccagtaatgaccagcttcaacaagaggaaccaccaattgaaagtcaggattatacacctggtcaagagagagacgagggagcactggacttccaagtgctaggcctggcagcctatctctgggaactgactcggtcaaagactgggggtgaacgtggagatggtcctaatgtcaagggagaatttctgccaaatctggagcctgttaaaataccagaagcaggtgaagggcaaccatcggtttaaatgaagacaagctgaaaccatacatgca

SEQ ID NO: 21384 - DNA, 499 bp, Homo sapiens
gccacttctcttcccttcattcttcgccaggctctctgctgactcaagttcttcagttcacgatcttctagttgcagcgatgagtgcacgagtgagatcaagatccagaggaagaggagatggtcaggaggctcccgatgtggttgcattcgtggctcccggtgaatctcagcaagaggaaccaccaactgacaatcaggatattgaacctggacaagagagagaaggaacacctccgatcgaagaacgtaaagtagaaggtgattgccaggaaatggatctggaaaagactcggagtgagcgtggagatggctctgatgtaaaagagaagactccacctaatcctaagcatgctaagactaaagaagcaggagatgggcagccataagttaaaaagaagacaagctgaagctacacacatggctgatgtcacattgaaaatgtgactgaaaatttgaaaattctctcaataaagtttgagttttctctgaagaagtca

SEQ ID NO: 21385 - DNA, 487 bp, Homo sapiens
tgacactgctgaggtctaaacaaggaggcagaagtagtcttcagttcacgatcttctagttgcagcgatgagtgcacgagtgagatcaagatccagaggaagaggagatggtcaggaggctcccgatgtggttgcattcgtggctcccggtgaatctcagcaagaggaaccaccaactgacaatcaggatattgaacctggacaagagagagaaggaacacctccgatcgaagaacgtaaagtagaaggtgattgccaggaaatggatctggaaaagactcggagtgagcgtggagatggctctgatgtaaaagagaagactccacctaatcctaagcatgctaagactaaagaagcaggagatgggcagccataagttaaaaagaagacaagctgaagctacacacatggctgatgtcacattgaaaatgtgactgaaaatttgaaaattctctcaataaagtttgagttttctctgaagaagtca

SEQ ID NO: 21386 - DNA, 6139 bp, Homo sapiens
gtcttcctcccccagggttgtggccacgcgcagcggcggcggttgttccgcttcccctccggcccgggccgtcgccattgccgaaggctccctcccctcccctccctggcgtgcgcaggactccgccgccgctgggcctagcggtagcagcggctgctccagcgcggcgtctcttcccgccccgcttccccttccctcccctcccctccccgcaccgcgcgctagcccggggcggctccgcagcccgccgggagctctgaccgaggcgcctcgctggggcggggaccttgccttgcccggggccatttcataattctgaatcatgtctgataacggagaactggaagataagcctccagcacctcctgtgcgaatgagcagcaccatctttagcactggaggcaaagaccctttgtcagccaatcacagtttgaaacctttgccctctgttccagaagagaaaaagcccaggcataaaatcatctccatattctcaggcacagagaaaggaagtaaaaagaaagaaaaggaacggccagaaatttctcctccatctgattttgagcacaccatccatgttggctttgatgctgttactggagaattcactggcatgccagaacagtgggctcgattactacagacctccaatatcaccaaactagagcaaaagaagaatcctcaggctgtgctggatgtcctaaagttctacgactccaacacagtgaagcagaaatatctgagctttactcctcctgagaaagatggctttccttctggaacaccagcactgaatgccaagggaacagaagcacccgcagtagtgacagaggaggaggatgatgatgaagagactgctcctcccgttattgccccgcgaccggatcatacgaaatcaatttacacacggtctgtaattgaccctgttcctgcaccagttggtgattcacatgttgatggtgctgccaagtctttagacaaacagaaaaagaagactaagatgacagatgaagagattatggagaaattaagaactatcgtgagcataggtgaccctaagaaaaaatatacaagatatgaaaaaattggacaaggggcttctggtacagttttcactgctactgacgttgcactgggacaggaggttgctatcaaacaaattaatttacagaaacagccaaagaaggaactgatcattaacgagattctggtgatgaaagaattgaaaaatcccaacatcgttaactttttggacagttacctggtaggagatgaattgtttgtggtcatggaataccttgctggggggtcactcactgatgtggtaacagaaacgtgcatggatgaagcacagattgctgctgtatgcagagagtgtttacaggcattggagtttttacatgctaatcaagtgatccacagagacatcaaaagtgacaatgtacttttgggaatggaaggatctgttaagctcactgactttggtttctgtgcccagatcacccctgagcagagcaaacgcagtaccatggtcggaacgccatactggatggcaccagaggtggttacacggaaagcttatggccctaaagtcgacatatggtctctgggtatcatggctattgagatggtagaaggagagcctccatacctcaatgaaaatcccttgagggccttgtacctaatagcaactaatggaaccccagaacttcagaatccagagaaactttccccaatatttcgggatttcttaaatcgatgtttggaaatggatgtggaaaaaaggggttcagccaaagaattattacagcatcctttcctgaaactggccaaaccgttatctagcttgacaccactgatcatggcagctaaagaagcaatgaagagtaaccgttaacatcactgctgtggcctcatactcttttttccattttctacaagaagccttttagtatatgaaaattattactctttttggggtttaaagaaatggtctgcataacctgaatgaaagaagcaaatgactattctctgaagacaaccaagagaaaattgcaaaaagacaagtatgacttttatatgaaccccttctttagggtccagaaggaattgtggactgaatcactagccttaggtctttcagcaaacagcctatcagggccatttatcatgtgtgagatttgcattttactttgctgactttgttgtaatagatcccattcattgtcccctttggggtatttccaatacttgaatggcagattggagtttttcagagtatgtgtttcatctgctagtctttctctccttcatagcttttcttttcctggacttgctccttttgagttgcttttgcgtttctcatgcctaggcaagtgtaatagaaattatgtagctccttatgttggcaaaggagctctatatagtttcactttgtataaaagttaggaccagctgttgttacatgtaatattttagttcagaacttgacctgaaggaagggaagaaaagtatgtgatttttaccttttttaacaaatgtgaaaaagtcagttttagaaatttcgtggtagtaagttcggcatttgttacatgtatagagagaagactaataatctctatttataactaaatcattgagatagaaaaagattcccattgactgtagacttcttcccattttgtcttcccttctgcctgtttccccttcaggcttggctctaggaaccaaagtgatttgttgttgttccaacctgggctttgtgactttggttagtgccactaccttcttccctcctttcccccttcaatttggaaataaatttctgtatatgttgcaattttaggtttaggtttgttctttttctttttcattaatcctctctcacctcacagataccccctcccatggcaaataatataataaccagtgaattttcaggaatttaaaaattagcttttttccacttaaaggagaaaaatatttgggactagcagcagaggcagtaagagatgtgaaccttggtgagctctgatacagtgagaagagattatactcatgaaagagaatgttagtgttacagagaagcagccgatagcaaatcgactgtagagacttggcggcggtggcattgccccaggtcgtcagcagtgtggtattatctatgagaacttgagcgacagagtatttcttgatgaatttatagatcatttgagatgttgagttactttagtttagttttgttttgttttttcaaataagtagagactattgtaaaaaacgagaaaggaaaatgaaatgtgcgtgttgatagcaataatttgtttcttttaaagattctaaaaggtctgagacctgtagcattaattatttgagtgccctcccttctcccctcccctcccttttctcttctcttttttcctctcctcttcttctcctttattcattgttttgcttttggagtgggtgttgttcaagtatctgtggtttggttctggcattttgttcccaccatccccttcccccattaacttcccccctgcttgccatcctgcagtagtataaatcatgaataaaaaataattttgctgttgtagtatacattggagaaactggcaggttttatttccattattttatttccactatatctatgataagatgcaattataaggagagaagtgactgttttttattgataaggcaagattttcagaaaaatgagtaaaataattaatgaaacatatttagagcacttaatggtctctgttttcaatataattcttgatttcatttttctctggaatatattggccttctacagctattactgaattatagaaactggtttatttctggcagaaagctgcagtgccacctgagttccaaattttaccattctttgtaaacagttggatggattatgataaagaagatgctaccaatgaaatagaaaaccaacgagatgagaagactgtgatcctcatgtactcagaggcacttccctcctaagtcaaagaccatcctcactgactatgtgccaacgcctcgtttcaggcttgtgactcaacaaagggcttttccattgatagaagcagtttgggatttgtagttgcgacttcttcgatagttacctgcacgtccattgctggcaactgacttgtcattaaaacctggctctttggttaagggagctacgctgtggtttattcttaagttacgtggataaactaacctctaacagaaatatactttggttaattttgaaatgtgtcatttttaaacaatcttaaaagtaatacagaattgtgatttattaattttaaaacattcagaacttgttgaaagaaaaattatatctgaatcaagattcatgttttttatttttattttttttgatacagagtctcactctgtcactcaggctggagtgcagtgacatgatctcagctcactgcaacctccgcttcctgggttcaagcaattctcatgcctcagcctcctgagtagctgagaccacaggcacccgccaccacacccagctatttttttgtatttttagtagagacagagtctcaccacattgcccaggctggtctccaactcctgagctcaggcagtctgcccaccttggcctcccaaagtgctgcagttacaggcgtgagccactgcacctggcctcatgttttttaaataattgccttttatatttaccctttttgtcatcactttagaatgaaaattcccatttaaatctgaaagttaccttaatagtcctcttgtgttattaggacagtattattatagtacttatttattttattttagatttaaagttatcttctctttttcttttttcttctgctgcttttagggacaattaaaactgggaaactatgaaacatggaacattttatcctacctgaaagtaaacgagtaattgtgaagcataagacactgaggctaatacaactctgtcttcatgtgttgactgcctggcacatagtattcattctcttccctttaacatagaagtgtccagctgcgtacagtctagtaaccagcaactgtaaacgaacctgtgcctctaacaagcgattctaaaccacctatgagtatttcttttagggctcacttaaatacatgtttgtatatactgtattctagccagaataattttagatctgatcaggtagtagctaaaattagaaaaaaacaaaatagatgcttaaagaatttgcatccatttttgagtctaaatcttttaaaatatactgagatccacatctagtgaaatgtcagtgtcaaaatattatagattatagctaaaatccagattaatactcatttggggttttttatagtggaacttcatagtaatacaaaaagcagattgtcttcctgtctccgctgctcccacagtaggtattgaaactggtaaaatcagttttttgatagtgtgtgtatataagaaaaaatagatacacacattcttttttctcagtcaacacattgattgaacactctggcaaagatgctgtggtggatgaggttggagttcgaaagaagaagcaagcgctggcctggccttgaaagaaccgaagtctttcccattcacttctctagaaagctgccaagacagaggcagaaagaaatggatgatagttctgtcaagcacacttctgttctcttagaacttagaagtgtttctaagagaacagaagtaataagagaaacagttacgtgtggaattcaacatctttggttggaacgcattggctttttttttcttgttttgatagaaatggaattaagcaaaagtagtttttgtcttttctgttgtcttcaaattttatgccttttatttttaatttaatcccgttcaattatttaattgttatacattgacattaactgctgtattttgactttgttcaataattttgttctttcagggctagaaataaactttttaaaaaaagtgtgcatttttccctttcctaaacttttattctttcttttgatcagcgtaaaagaatattttaatgtcttttgatagcataaaagaatatttaaatgtcttaataggttttcaaagaacatttagtatttttagtgataaatgttttaaaccttttaa

SEQ ID NO: 21387 - DNA, 2178 bp, Homo sapiens
gagctgtgaaattagttgtaactgaaaatgtctgacggtctggataatgaagagaaacccccggctcctccactgaggatgaatagtaacaaccgggattcttcagcactcaaccacagctccaaaccacttcccatggcccctgaagagaagaataagaaagccaggcttcgctctatcttcccaggaggaggggataaaaccaataagaagaaggagaaagagcgcccagagatctctcttccttcagactttgagcatacgattcatgtggggtttgatgcagtcaccggggaattcactccagatctctatggctcacagatgtgcccagggaagctcccagagggaattccagagcaatgggcacgattactccaaacttccaacataacaaaattggaacagaagaagaacccacaagctgttctagatgttctcaaattctatgattccaaagaaacagtcaacaaccagaaatacatgagctttacatcaggagataaaagtgcacatggatacatagcagcccatccttcgagtacaaaaacagcatctgagcctccattggcccctcctgtgtctgaagaagaagatgaagaggaagaagaagaagaagatgaaaatgagccaccaccagttatcgcaccaagaccagagcatacaaaatcaatctatactcgttctgtggttgaatccattgcttcaccagcagtaccaaataaagaggtcacaccaccctctgctgaaaatgccaattccagtactttgtacaggaacacagatcggcaaagaaaaaaatccaagatgacagatgaggagatcttagagaagctaagaagcattgtgagtgttggggacccaaagaaaaaatacacaagatttgaaaaaattggtcaaggggcatcaggtactgtttatacagcactagacattgcaacaggacaagaggtggccataaagcagatgaaccttcaacagcaacccaagaaggaattaattattaatgaaattctggtcatgagggaaaataagaaccctaatattgttaattatttagatagctacttggtgggtgatgaactatgggtagtcatggaatacttggctggtggctctctgactgatgtggtcacagagacctgtatggatgaaggacagatagcagctgtctgcagagagtgcctgcaagctttggatttcctgcactcaaaccaggtgatccatagagatataaagagtgacaatattcttctcgggatggatggctctgttaaattgactgactttgggttctgtgcccagatcactcctgagcaaagtaaacgaagcactatggtgggaaccccatattggatggcacctgaggtggtgactcgaaaagcttatggtccgaaagttgatatctggtctcttggaattatggcaattgaaatggtggaaggtgaacccccttaccttaatgaaaatccactcagggcattgtatctgatagccactaatggaactccagagctccagaatcctgagagactgtcagctgtattccgtgactttttaaatcgctgtcttgagatggatgtggataggcgaggatctgccaaggagcttttgcagcatccatttttaaaattagccaagcctctctccagcctgactcctctgattatcgctgcaaaggaagcaattaagaacagcagccgctaagactgcaagccttacacctcaccatctccctcatgagtaagactgaaataaaactctgctgcaggaaagatggaagaaaagacagtcaaatggggtgggggttctttacctttcaaatgaatagaaacttcttataagcctttttcctactccctcagattatgtaatttatttgtaagcctgaatcgcagcccaaacagggcagcaatgttgaagtgaccataaagtggtcacttccaccgtgaagcgaaagagccagtagtgaatcccctcattttgtgcattcactttgaagaaaaaggtttctcaaagatgcacactccctcttcatagtgttgtgtttgtttttaagttagagagtagtccctcttgcattcaaacctccttcaaaactccttacccaatgtgatgtttttcacttgcattgtcattagatgtccagaaaaaaaaaagatgtcaaaatgtttttct

SEQ ID NO: 21388 - DNA, 2241 bp, Homo sapiens
gagctgtgaaattagttgtaactgaaaatgtctgacggtctggataatgaagagaaacccccggctcctccactgaggatgaatagtaacaaccgggattcttcagcactcaaccacagctccaaaccacttcccatggcccctgaagagaagaataagaaagccaggcttcgctctatcttcccaggaggaggggataaaaccaataagaagaaggagaaagagcgcccagagatctctcttccttcagactttgagcatacgattcatgtggggtttgatgcagtcaccggggaattcactaactcccctttccagacctctagacctgtgacggtcgcttcaagtcaatcagagggaaaaatgccagatctctatggctcacagatgtgcccagggaagctcccagagggaattccagagcaatgggcacgattactccaaacttccaacataacaaaattggaacagaagaagaacccacaagctgttctagatgttctcaaattctatgattccaaagaaacagtcaacaaccagaaatacatgagctttacatcaggagataaaagtgcacatggatacatagcagcccatccttcgagtacaaaaacagcatctgagcctccattggcccctcctgtgtctgaagaagaagatgaagaggaagaagaagaagaagatgaaaatgagccaccaccagttatcgcaccaagaccagagcatacaaaatcaatctatactcgttctgtggttgaatccattgcttcaccagcagtaccaaataaagaggtcacaccaccctctgctgaaaatgccaattccagtactttgtacaggaacacagatcggcaaagaaaaaaatccaagatgacagatgaggagatcttagagaagctaagaagcattgtgagtgttggggacccaaagaaaaaatacacaagatttgaaaaaattggtcaaggggcatcaggtactgtttatacagcactagacattgcaacaggacaagaggtggccataaagcagatgaaccttcaacagcaacccaagaaggaattaattattaatgaaattctggtcatgagggaaaataagaaccctaatattgttaattatttagatagctacttggtgggtgatgaactatgggtagtcatggaatacttggctggtggctctctgactgatgtggtcacagagacctgtatggatgaaggacagatagcagctgtctgcagagagtgcctgcaagctttggatttcctgcactcaaaccaggtgatccatagagatataaagagtgacaatattcttctcgggatggatggctctgttaaattgactgactttgggttctgtgcccagatcactcctgagcaaagtaaacgaagcactatggtgggaaccccatattggatggcacctgaggtggtgactcgaaaagcttatggtccgaaagttgatatctggtctcttggaattatggcaattgaaatggtggaaggtgaacccccttaccttaatgaaaatccactcagggcattgtatctgatagccactaatggaactccagagctccagaatcctgagagactgtcagctgtattccgtgactttttaaatcgctgtcttgagatggatgtggataggcgaggatctgccaaggagcttttgcagcatccatttttaaaattagccaagcctctctccagcctgactcctctgattatcgctgcaaaggaagcaattaagaacagcagccgctaagactgcaagccttacacctcaccatctccctcatgagtaagactgaaataaaactctgctgcaggaaagatggaagaaaagacagtcaaatggggtgggggttctttacctttcaaatgaatagaaacttcttataagcctttttcctactccctcagattatgtaatttatttgtaagcctgaatcgcagcccaaacagggcagcaatgttgaagtgaccataaagtggtcacttccaccgtgaagcgaaagagccagtagtgaatcccctcattttgtgcattcactttgaagaaaaaggtttctcaaagatgcacactccctcttcatagtgttgtgtttgtttttaagttagagagtagtccctcttgcattcaaacctccttcaaaactccttacccaatgtgatgtttttcacttgcattgtcattagatgtccagaaaaaaaaaagatgtcaaaatgtttttct

SEQ ID NO: 21389 - DNA, 2510 bp, Homo sapiens
agaggaaaggtcttgacggggtggctggatccgtggcagaatccagttccagattctagacttgagggttctgggctgttggtctgtagaagcgaaggagagaaggactcaaatccaggccaagtgtatggctgtctgaggtattggaacagaaggaggtccattcctgttggtgacaacaccgtggccctgttctgggatgagcaaggtgtaaaggtttcccccaagaaagagcagctgagtccttgcatcttgtggcagctggtgtgcccagcactgagtctgtaggagctgaagccagcccggacccttctcatgggcagtgcccacctgtgctgaagtcctgcagcggtggcggtgtgaggagctgtgaaattagttgtaactgaaaatgtctgacggtctggataatgaagagaaacccccggctcctccactgaggatgaatagtaacaaccgggattcttcagcactcaaccacagctccaaaccacttcccatggcccctgaagagaagaataagaaagccaggcttcgctctatcttcccaggaggaggggataaaaccaataagaagaaggagaaagagcgcccagagatctctcttccttcagactttgagcatacgattcatgtggggtttgatgcagtcaccggggaattcactggaattccagagcaatgggcacgattactccaaacttccaacataacaaaattggaacagaagaagaacccacaagctgttctagatgttctcaaattctatgattccaaagaaacagtcaacaaccagaaatacatgagctttacatcaggagataaaagtgcacatggatacatagcagcccatccttcgagtacaaaaacagcatctgagcctccattggcccctcctgtgtctgaagaagaagatgaagaggaagaagaagaagaagatgaaaatgagccaccaccagttatcgcaccaagaccagagcatacaaaatcaatctatactcgttctgtggttgaatccattgcttcaccagcagtaccaaataaagaggtcacaccaccctctgctgaaaatgccaattccagtactttgtacaggaacacagatcggcaaagaaaaaaatccaagatgacagatgaggagatcttagagaagctaagaagcattgtgagtgttggggacccaaagaaaaaatacacaagatttgaaaaaattggtcaaggggcatcaggtactgtttatacagcactagacattgcaacaggacaagaggtggccataaagcagatgaaccttcaacagcaacccaagaaggaattaattattaatgaaattctggtcatgagggaaaataagaaccctaatattgttaattatttagatagctacttggtgggtgatgaactatgggtagtcatggaatacttggctggtggctctctgactgatgtggtcacagagacctgtatggatgaaggacagatagcagctgtctgcagagagtgcctgcaagctttggatttcctgcactcaaaccaggtgatccatagagatataaagagtgacaatattcttctcgggatggatggctctgttaaattgactgactttgggttctgtgcccagatcactcctgagcaaagtaaacgaagcactatggtgggaaccccatattggatggcacctgaggtggtgactcgaaaagcttatggtccgaaagttgatatctggtctcttggaattatggcaattgaaatggtggaaggtgaacccccttaccttaatgaaaatccactcagggcattgtatctgatagccactaatggaactccagagctccagaatcctgagagactgtcagctgtattccgtgactttttaaatcgctgtcttgagatggatgtggataggcgaggatctgccaaggagcttttgcagcatccatttttaaaattagccaagcctctctccagcctgactcctctgattatcgctgcaaaggaagcaattaagaacagcagccgctaagactgcaagccttacacctcaccatctccctcatgagtaagactgaaataaaactctgctgcaggaaagatggaagaaaagacagtcaaatggggtgggggttctttacctttcaaatgaatagaaacttcttataagcctttttcctactccctcagattatgtaatttatttgtaagcctgaatcgcagcccaaacagggcagcaatgttgaagtgaccataaagtggtcacttccaccgtgaagcgaaagagccagtagtgaatcccctcattttgtgcattcactttgaagaaaaaggtttctcaaagatgcacactccctcttcatagtgttgtgtttgtttttaagttagagagtagtccctcttgcattcaaacctccttcaaaactccttacccaatgtgatgtttttcacttgcattgtcattagatgtccagaaaaaaaaaagatgtcaaaatgtttttctaaaaaaagaaagc

SEQ ID NO: 21390 - DNA, 2606 bp, Homo sapiens
ctggagcgctcggaggtagaggaaaggtcttgacggggtggctggatccgtggcagaatccagttccagattctagacttgagggttctgggctgttggtctgtagaagcgaaggagagaaggccatgttagtcttgctcccctcatggttttgcagactcaaatccaggccaagtgtatggctgtctgaggtattggaacagaaggaggtccattcctgttggtgacaacaccgtggccctgttctgggatgagcaaggtgtaaaggtttcccccaagaaagagcagctgagtccttgcatcttgtggcagctggtgtgcccagcactgagtctgtaggagctgaagccagcccggacccttctcatgggcagtgcccacctgtgctgaagtcctgcagcggtggcggtgtgaggagctgtgaaattagttgtaactgaaaatgtctgacggtctggataatgaagagaaacccccggctcctccactgaggatgaatagtaacaaccgggattcttcagcactcaaccacagctccaaaccacttcccatggcccctgaagagaagaataagaaagccaggcttcgctctatcttcccaggaggaggggataaaaccaataagaagaaggagaaagagcgcccagagatctctcttccttcagactttgagcatacgattcatgtggggtttgatgcagtcaccggggaattcactccagatctctatggctcacagatgtgcccagggaagctcccagagggaattccagagcaatgggcacgattactccaaacttccaacataacaaaattggaacagaagaagaacccacaagctgttctagatgttctcaaattctatgattccaaagaaacagtcaacaaccagaaatacatgagctttacatcaggagataaaagtgcacatggatacatagcagcccatccttcgagtacaaaaacagcatctgagcctccattggcccctcctgtgtctgaagaagaagatgaagaggaagaagaagaagaagatgaaaatgagccaccaccagttatcgcaccaagaccagagcatacaaaatcaatctatactcgttctgtggttgaatccattgcttcaccagcagtaccaaataaagaggtcacaccaccctctgctgaaaatgccaattccagtactttgtacaggaacacagatcggcaaagaaaaaaatccaagatgacagatgaggagatcttagagaagctaagaagcattgtgagtgttggggacccaaagaaaaaatacacaagatttgaaaaaattggtcaaggggcatcaggtactgtttatacagcactagacattgcaacaggacaagaggtggccataaagcagatgaaccttcaacagcaacccaagaaggaattaattattaatgaaattctggtcatgagggaaaataagaaccctaatattgttaattatttagatagctacttggtgggtgatgaactatgggtagtcatggaatacttggctggtggctctctgactgatgtggtcacagagacctgtatggatgaaggacagatagcagctgtctgcagagagtgcctgcaagctttggatttcctgcactcaaaccaggtgatccatagagatataaagagtgacaatattcttctcgggatggatggctctgttaaattgactgactttgggttctgtgcccagatcactcctgagcaaagtaaacgaagcactatggtgggaaccccatattggatggcacctgaggtggtgactcgaaaagcttatggtccgaaagttgatatctggtctcttggaattatggcaattgaaatggtggaaggtgaacccccttaccttaatgaaaatccactcagggcattgtatctgatagccactaatggaactccagagctccagaatcctgagagactgtcagctgtattccgtgactttttaaatcgctgtcttgagatggatgtggataggcgaggatctgccaaggagcttttgcagcatccatttttaaaattagccaagcctctctccagcctgactcctctgattatcgctgcaaaggaagcaattaagaacagcagccgctaagactgcaagccttacacctcaccatctccctcatgagtaagactgaaataaaactctgctgcaggaaagatggaagaaaagacagtcaaatggggtgggggttctttacctttcaaatgaatagaaacttcttataagcctttttcctactccctcagattatgtaatttatttgtaagcctgaatcgcagcccaaacagggcagcaatgttgaagtgaccataaagtggtcacttccaccgtgaagcgaaagagccagtagtgaatcccctcattttgtgcattcactttgaagaaaaaggtttctcaaagatgcacactccctcttcatagtgttgtgtttgtttttaagttagagagtagtccctcttgcattcaaacctccttcaaaactccttacccaatgtgatgtttttcacttgcattgtcattagatgtccagaaaaaaaaaagatgtcaaaatgtttttctaaaaaaagaaagc

SEQ ID NO: 21391 - DNA, 2196 bp, Homo sapiens
gagctgtgaaattagttgtaactgaaaatgtctgacggtctggataatgaagagaaacccccggctcctccactgaggatgaatagtaacaaccgggattcttcagcactcaaccacagctccaaaccacttcccatggcccctgaagagaagaataagaaagccaggcttcgctctatcttcccaggaggaggggataaaaccaataagaagaaggagaaagagcgcccagagatctctcttccttcagactttgagcatacgattcatgtggggtttgatgcagtcaccggggaattcactaactcccctttccagacctctagacctgtgacggtcgcttcaagtcaatcagagggaaaaatgggaattccagagcaatgggcacgattactccaaacttccaacataacaaaattggaacagaagaagaacccacaagctgttctagatgttctcaaattctatgattccaaagaaacagtcaacaaccagaaatacatgagctttacatcaggagataaaagtgcacatggatacatagcagcccatccttcgagtacaaaaacagcatctgagcctccattggcccctcctgtgtctgaagaagaagatgaagaggaagaagaagaagaagatgaaaatgagccaccaccagttatcgcaccaagaccagagcatacaaaatcaatctatactcgttctgtggttgaatccattgcttcaccagcagtaccaaataaagaggtcacaccaccctctgctgaaaatgccaattccagtactttgtacaggaacacagatcggcaaagaaaaaaatccaagatgacagatgaggagatcttagagaagctaagaagcattgtgagtgttggggacccaaagaaaaaatacacaagatttgaaaaaattggtcaaggggcatcaggtactgtttatacagcactagacattgcaacaggacaagaggtggccataaagcagatgaaccttcaacagcaacccaagaaggaattaattattaatgaaattctggtcatgagggaaaataagaaccctaatattgttaattatttagatagctacttggtgggtgatgaactatgggtagtcatggaatacttggctggtggctctctgactgatgtggtcacagagacctgtatggatgaaggacagatagcagctgtctgcagagagtgcctgcaagctttggatttcctgcactcaaaccaggtgatccatagagatataaagagtgacaatattcttctcgggatggatggctctgttaaattgactgactttgggttctgtgcccagatcactcctgagcaaagtaaacgaagcactatggtgggaaccccatattggatggcacctgaggtggtgactcgaaaagcttatggtccgaaagttgatatctggtctcttggaattatggcaattgaaatggtggaaggtgaacccccttaccttaatgaaaatccactcagggcattgtatctgatagccactaatggaactccagagctccagaatcctgagagactgtcagctgtattccgtgactttttaaatcgctgtcttgagatggatgtggataggcgaggatctgccaaggagcttttgcagcatccatttttaaaattagccaagcctctctccagcctgactcctctgattatcgctgcaaaggaagcaattaagaacagcagccgctaagactgcaagccttacacctcaccatctccctcatgagtaagactgaaataaaactctgctgcaggaaagatggaagaaaagacagtcaaatggggtgggggttctttacctttcaaatgaatagaaacttcttataagcctttttcctactccctcagattatgtaatttatttgtaagcctgaatcgcagcccaaacagggcagcaatgttgaagtgaccataaagtggtcacttccaccgtgaagcgaaagagccagtagtgaatcccctcattttgtgcattcactttgaagaaaaaggtttctcaaagatgcacactccctcttcatagtgttgtgtttgtttttaagttagagagtagtccctcttgcattcaaacctccttcaaaactccttacccaatgtgatgtttttcacttgcattgtcattagatgtccagaaaaaaaaaagatgtcaaaatgtttttct

SEQ ID NO: 21392 - DNA, 2477 bp, Homo sapiens
aatcacagtcaaaatacacccagatgctctcacacacccagacgcgcgcgcatccccgggccatggggcgcacgtgagcccgcaccccgcgcacccagccctgcctctcgccagagcatcctcagcagctgccaccgaagcagcctcctccttctctcttcctcctcctcctaccacggccgccgccaccaccgctgcggctgtgatctcctatcccctctggtcctccttcctcccccagttcctgctcctcctcccatcccctgctcctcctgcccagcagcgaagggcagaaccctcggctgccgccctccttcgctctgaccaagaagaggctggaacaggagctgtgaaattagttgtaactgaaaatgtctgacggtctggataatgaagagaaacccccggctcctccactgaggatgaatagtaacaaccgggattcttcagcactcaaccacagctccaaaccacttcccatggcccctgaagagaagaataagaaagccaggcttcgctctatcttcccaggaggaggggataaaaccaataagaagaaggagaaagagcgcccagagatctctcttccttcagactttgagcatacgattcatgtggggtttgatgcagtcaccggggaattcactggaattccagagcaatgggcacgattactccaaacttccaacataacaaaattggaacagaagaagaacccacaagctgttctagatgttctcaaattctatgattccaaagaaacagtcaacaaccagaaatacatgagctttacatcaggagataaaagtgcacatggatacatagcagcccatccttcgagtacaaaaacagcatctgagcctccattggcccctcctgtgtctgaagaagaagatgaagaggaagaagaagaagaagatgaaaatgagccaccaccagttatcgcaccaagaccagagcatacaaaatcaatctatactcgttctgtggttgaatccattgcttcaccagcagtaccaaataaagaggtcacaccaccctctgctgaaaatgccaattccagtactttgtacaggaacacagatcggcaaagaaaaaaatccaagatgacagatgaggagatcttagagaagctaagaagcattgtgagtgttggggacccaaagaaaaaatacacaagatttgaaaaaattggtcaaggggcatcaggtactgtttatacagcactagacattgcaacaggacaagaggtggccataaagcagatgaaccttcaacagcaacccaagaaggaattaattattaatgaaattctggtcatgagggaaaataagaaccctaatattgttaattatttagatagctacttggtgggtgatgaactatgggtagtcatggaatacttggctggtggctctctgactgatgtggtcacagagacctgtatggatgaaggacagatagcagctgtctgcagagagtgcctgcaagctttggatttcctgcactcaaaccaggtgatccatagagatataaagagtgacaatattcttctcgggatggatggctctgttaaattgactgactttgggttctgtgcccagatcactcctgagcaaagtaaacgaagcactatggtgggaaccccatattggatggcacctgaggtggtgactcgaaaagcttatggtccgaaagttgatatctggtctcttggaattatggcaattgaaatggtggaaggtgaacccccttaccttaatgaaaatccactcagggcattgtatctgatagccactaatggaactccagagctccagaatcctgagagactgtcagctgtattccgtgactttttaaatcgctgtcttgagatggatgtggataggcgaggatctgccaaggagcttttgcagcatccatttttaaaattagccaagcctctctccagcctgactcctctgattatcgctgcaaaggaagcaattaagaacagcagccgctaagactgcaagccttacacctcaccatctccctcatgagtaagactgaaataaaactctgctgcaggaaagatggaagaaaagacagtcaaatggggtgggggttctttacctttcaaatgaatagaaacttcttataagcctttttcctactccctcagattatgtaatttatttgtaagcctgaatcgcagcccaaacagggcagcaatgttgaagtgaccataaagtggtcacttccaccgtgaagcgaaagagccagtagtgaatcccctcattttgtgcattcactttgaagaaaaaggtttctcaaagatgcacactccctcttcatagtgttgtgtttgtttttaagttagagagtagtccctcttgcattcaaacctccttcaaaactccttacccaatgtgatgtttttcacttgcattgtcattagatgtccagaaaaaaaaaagatgtcaaaatgtttttct

SEQ ID NO: 21393 - DNA, 573 bp, Homo sapiens
ggagctgtgaaattagttgtaactgaaaatgtctgacggtctggataatgaagagaaacccccggctcctccactgaggatgaatagtaacaaccgggattcttcagcactcaaccacagctccaaaccacttcccatggcccctgaagagaagaataagaaagccaggcttcgctctatcttcccaggaggaggggataaaaccaataagaagaaggagaaagagcgcccagagatctctcttccttcagactttgagcatacgattcatgtggggtttgatgcagtcaccggggaattcactaactcccctttccagacctctagacctgtgacggtcgcttcaagtcaatcagagggaaaaatgccagatctctatggctcacagatgtgcccagggaagctcccagagggaattccagagcaatgggcacgattactccaaacttccaacataacaaaattggaacagaagaagaacccacaagctgttctagatgttctcaaattctatgattccaaagaaacagtcaacaaccagaaatacatgagctttacatcaggagataaaag

SEQ ID NO: 21394 - DNA, 2550 bp, Homo sapiens
aatcacagtcaaaatacacccagatgctctcacacacccagacgcgcgcgcatccccgggccatggggcgcacgtgagcccgcaccccgcgcacccagccctgcctctcgccagagcatcctcagcagctgccaccgaagcagcctcctccttctctcttcctcctcctcctaccacggccgccgccaccaccgctgcggctgtgatctcctatcccctctggtcctccttcctcccccagttcctgctcctcctcccatcccctgctcctcctgcccagcagcgaagggcagaaccctcggctgccgccctccttcgctctgaccaagaagaggctggaacagaataacatacagaggacagctttctcttctgaggagtcagaagttcagttcgcccaacatggaatgacttgaggagctgtgaaattagttgtaactgaaaatgtctgacggtctggataatgaagagaaacccccggctcctccactgaggatgaatagtaacaaccgggattcttcagcactcaaccacagctccaaaccacttcccatggcccctgaagagaagaataagaaagccaggcttcgctctatcttcccaggaggaggggataaaaccaataagaagaaggagaaagagcgcccagagatctctcttccttcagactttgagcatacgattcatgtggggtttgatgcagtcaccggggaattcactggaattccagagcaatgggcacgattactccaaacttccaacataacaaaattggaacagaagaagaacccacaagctgttctagatgttctcaaattctatgattccaaagaaacagtcaacaaccagaaatacatgagctttacatcaggagataaaagtgcacatggatacatagcagcccatccttcgagtacaaaaacagcatctgagcctccattggcccctcctgtgtctgaagaagaagatgaagaggaagaagaagaagaagatgaaaatgagccaccaccagttatcgcaccaagaccagagcatacaaaatcaatctatactcgttctgtggttgaatccattgcttcaccagcagtaccaaataaagaggtcacaccaccctctgctgaaaatgccaattccagtactttgtacaggaacacagatcggcaaagaaaaaaatccaagatgacagatgaggagatcttagagaagctaagaagcattgtgagtgttggggacccaaagaaaaaatacacaagatttgaaaaaattggtcaaggggcatcaggtactgtttatacagcactagacattgcaacaggacaagaggtggccataaagcagatgaaccttcaacagcaacccaagaaggaattaattattaatgaaattctggtcatgagggaaaataagaaccctaatattgttaattatttagatagctacttggtgggtgatgaactatgggtagtcatggaatacttggctggtggctctctgactgatgtggtcacagagacctgtatggatgaaggacagatagcagctgtctgcagagagtgcctgcaagctttggatttcctgcactcaaaccaggtgatccatagagatataaagagtgacaatattcttctcgggatggatggctctgttaaattgactgactttgggttctgtgcccagatcactcctgagcaaagtaaacgaagcactatggtgggaaccccatattggatggcacctgaggtggtgactcgaaaagcttatggtccgaaagttgatatctggtctcttggaattatggcaattgaaatggtggaaggtgaacccccttaccttaatgaaaatccactcagggcattgtatctgatagccactaatggaactccagagctccagaatcctgagagactgtcagctgtattccgtgactttttaaatcgctgtcttgagatggatgtggataggcgaggatctgccaaggagcttttgcagcatccatttttaaaattagccaagcctctctccagcctgactcctctgattatcgctgcaaaggaagcaattaagaacagcagccgctaagactgcaagccttacacctcaccatctccctcatgagtaagactgaaataaaactctgctgcaggaaagatggaagaaaagacagtcaaatggggtgggggttctttacctttcaaatgaatagaaacttcttataagcctttttcctactccctcagattatgtaatttatttgtaagcctgaatcgcagcccaaacagggcagcaatgttgaagtgaccataaagtggtcacttccaccgtgaagcgaaagagccagtagtgaatcccctcattttgtgcattcactttgaagaaaaaggtttctcaaagatgcacactccctcttcatagtgttgtgtttgtttttaagttagagagtagtccctcttgcattcaaacctccttcaaaactccttacccaatgtgatgtttttcacttgcattgtcattagatgtccagaaaaaaaaaagatgtcaaaatgtttttct

SEQ ID NO: 21395 - DNA, 2098 bp, Homo sapiens
cagaatccagttccagattctagacttgagggttctgggctgttggtctgtagaagcgaaggagagaaggactcaaatccaggccaagtgtatggctgtctgaggtattggaacagaaggaggtccattcctgttggtgacaacaccgtggccctgttctgggatgagcaaggtgtaaaggtttcccccaagaaagagcagctgagtccttgcatcttgtggcagctggtgtgcccagcactgagtctgtaggagctgaagccagcccggacccttctcatgggcagtgcccacctgtgctgaagtcctgcagcggtggcggtgtgaggagctgtgaaattagttgtaactgaaaatgtctgacggtctggataatgaagagaaacccccggctcctccactgaggatgaatagtaacaaccgggattcttcagcactcaaccacagctccaaaccacttcccatggcccctgaagagaagaataagaaagccaggcttcgctctatcttcccaggaggaggggataaaaccaataagaagaaggagaaagagcgcccagagatctctcttccttcagactttgagcatacgattcatgtggggtttgatgcagtcaccggggaattcactaactcccctttccagacctctagacctgtgacggtcgcttcaagtcaatcagagggaaaaatgccagatctctatggctcacagatgtgcccagggaagctcccagagggaattccagagcaatgggcacgattactccaaacttccaacataacaaaattggaacagaagaagaacccacaagctgttctagatgttctcaaattctatgattccaaagaaacagtcaacaaccagaaatacatgagctttacatcaggagataaaagtgcacatggatacatagcagcccatccttcgagtacaaaaacagcatctgagcctccattggcccctcctgtgtctgaagaagaagatgaagaggaagaagaagaagaagatgaaaatgagccaccaccagttatcgcaccaagaccagagcatacaaaatcaatctatactcgttctgtggttgaatccattgcttcaccagcagtaccaaataaagaggtcacaccaccctctgctgaaaatgccaattccagtactttgtacaggaacacagatcggcaaagaaaaaaatccaagatgacagatgaggagatcttagagaagctaagaagcattgtgagtgttggggacccaaagaaaaaatacacaagatttgaaaaaattggtcaaggggcatcaggtactgtttatacagcactagacattgcaacaggacaagaggtggccataaagcagatgaaccttcaacagcaacccaagaaggaattaattattaatgaaattctggtcatgagggaaaataagaaccctaatattgttaattatttagatagctacttggtgggtgatgaactatgggtagtcatggaatacttggctggtggctctctgactgatgtggtcacagagacctgtatggatgaaggacagatagcagctgtctgcagagagtgcctgcaagctttggatttcctgcactcaaaccaggtgatccatagagatataaagagtgacaatattcttctcgggatggatggctctgttaaattgactgactttgggttctgtgcccagatcactcctgagcaaagtaaacgaagcactatggtgggaaccccatattggatggcacctgaggtggtgactcgaaaagcttatggtccgaaagttgatatctggtctcttggaattatggcaattgaaatggtggaaggtgaacccccttaccttaatgaaaatccactcagggcattgtatctgatagccactaatggaactccagagctccagaatcctgagagactgtcagctgtattccgtgactttttaaatcgctgtcttgagatggatgtggataggcgaggatctgccaaggagcttttgcagcatccatttttaaaattagccaagcctctctccagcctgactcctctgattatcgctgcaaaggaagcaattaagaacagcagccgctaa

SEQ ID NO: 21396 - DNA, 2638 bp, Homo sapiens
ctggagcgctcggaggtagaggaaaggtcttgacggggtggctggatccgtggcagaatccagttccagattctagacttgagggttctgggctgttggtctgtagaagcgaaggagagaaggccatgttagtcttgctcccctcatggttttgcagactcaaatccaggccaagtgtatggctgtctgaggtattggaacagaaggaggtccattcctgttggtgacaacaccgtggccctgttctgggatgagcaaggtgtaaaggtttcccccaagaaagagcagctgagtccttgcatcttgtggcagctggtgtgcccagcactgagtctgtaggagctgaagccagcccggacccttctcatgggcagtgcccacctgtgctgaagtcctgcagcggtggcggtgtgaggagctgtgaaattagttgtaactgaaaatgtctgacggtctggataatgaagagaaacccccggctcctccactgaggatgaatagtaacaaccgggattcttcagcactcaaccacagctccaaaccacttcccatggcccctgaagagaagaataagaaagccaggcttcgctctatcttcccaggaggaggggataaaaccaataagaagaaggagaaagagcgcccagagatctctcttccttcagactttgagcatacgattcatgtggggtttgatgcagtcaccggggaattcactaactcccctttccagacctctagacctgtgacggtcgcttcaagtcaatcagagggaaaaatgggaattccagagcaatgggcacgattactccaaacttccaacataacaaaattggaacagaagaagaacccacaagctgttctagatgttctcaaattctatgattccaaagaaacagtcaacaaccagaaatacatgagctttacatcaggagataaaagtgcacatggatacatagcagcccatccttcgagtacaaaaacagcatctgagcctccattggcccctcctgtgtctgaagaagaagatgaagaggaagaagaagaagaagatgaaaatgagccaccaccagttatcgcaccaagaccagagcatacaaaatcaatctatactcgttctgtggttgaatccattgcttcaccagcagtaccaaataaagaggtcacaccaccctctgctgaaaatgccaattccagtactttgtacaggaacacagatcggcaaagaaaaaaatccaagatgacagatgaggagatcttagagaagctaagaagcattgtgagtgttggggacccaaagaaaaaatacacaagatttgaaaaaattggtcaaggggcatcaggtactgtttatacagcactagacattgcaacaggacaagaggtggccataaagcagatgaaccttcaacagcaacccaagaaggaattaattattaatgaaattctggtcatgagggaaaataagaaccctaatattgttaattatttagatagctacttggtgggtgatgaactatgggtagtcatggaatacttggctggtggctctctgactgatgtggtcacagagacctgtatggatgaaggacagatagcagctgtctgcagagagtgcctgcaagctttggatttcctgcactcaaaccaggtgatccatagagatataaagagtgacaatattcttctcgggatggatggctctgttaaattgactgactttgggttctgtgcccagatcactcctgagcaaagtaaacgaagcactatggtgggaaccccatattggatggcacctgaggtggtgactcgaaaagcttatggtccgaaagttgatatctggtctcttggaattatggcaattgaaatggtggaaggtgaacccccttaccttaatgaaaatccactcagggcattgtatctgatagccactaatggaactccagagctccagaatcctgagagactgtcagctgtattccgtgactttttaaatcgctgtcttgagatggatgtggataggcgaggatctgccaaggagcttttgcagcatccatttttaaaattagccaagcctctctccagcctgactcctctgattatcgctgcaaaggaagcaattaagaacagcagccgctaagactgcaagccttacacctcaccatctccctcatgagtaagactgaaataaaactctgctgcaggaaagatggaagaaaagacagtcaaatggggtgggggttctttacctttcaaatgaatagaaacttcttataagcctttttcctactccctcagattatgtaatttatttgtaagcctgaatcgcagcccaaacagggcagcaatgttgaagtgaccataaagtggtcacttccaccgtgaagcgaaagagccagtagtgaatcccctcattttgtgcattcactttgaagaaaaaggtttctcaaagatgcacactccctcttcatagtgttgtgtttgtttttaagttagagagtagtccctcttgcattcaaacctccttcaaaactccttacccaatgtgatgtttttcacttgcattgtcattagatgtccagaaaaaaaaaagatgtcaaaatgtttttctaaaaaaagaaagcaaaaaaagcaaggc

SEQ ID NO: 21397 - DNA, 3865 bp, Homo sapiens
gtgccgtccccctgctggggacagcagctgggtccagcagagagctggctgggggcttgacaggagtttatcctaactgatgctgggtgggcgcaggccctgagatgggcgtcagggagaggggacgccagacacacggcctgagcagggtgaggagcagctgccagccccggcaggcccaggccctgtctgggtgcacaggacagagacacagcaagatgcccagggagtgccgcttcctgggctagagacaagcaccagcctgcagtggagaacgcaggaccccgctgcccagaaggagcagccacggcctgcggaggactggcccagcaaggtcccaggtcttccctctcctcagcgcctaagagagaggcccagtgcgggtgaggagtcgcgaggaagaggcggaaggcgccggaaggcaccatgttccgcaagaaaaagaagaaacgccctgagatctcagcgccacagaacttccagcaccgtgtccacacctccttcgaccccaaagaaggcaagtttgtgggcctccccccacaatggcagaacatcctggacacactgcggcgccccaagcccgtggtggacccttcgcgaatcacacgggtgcagctccagcccatgaagacagtggtgcggggcagcgcgatgcctgtggatggctacatctcggggctgctcaacgacatccagaagttgtcagtcatcagctccaacaccctgcgtggccgcagccccaccagccggcggcgggcacagtccctggggctgctgggggatgagcactgggccaccgacccagacatgtacctccagagcccccagtctgagcgcactgacccccacggcctctacctcagctgcaacgggggcacaccagcaggccacaagcagatgccgtggcccgagccacagagcccacgggtcctgcccaatgggctggctgcaaaggcacagtccctgggccccgccgagtttcagggtgcctcgcagcgctgtctgcagctgggtgcctgcctgcagagctccccaccaggagcctcgccccccacgggcaccaataggcatggaatgaaggctgccaagcatggctctgaggaggcccggccacagtcctgcctggtgggctcagccacaggcaggccaggtggggaaggcagccctagccctaagacccgggagagcagcctgaagcgcaggctattccgaagcatgttcctgtccactgctgccacagcccctccaagcagcagcaagccaggccctccaccacagagcaagcccaactcctctttccgaccgccgcagaaagacaaccccccaagcctggtggccaaggcccagtccttgccctcggaccagccggtggggaccttcagccctctgaccacttcggataccagcagcccccagaagtccctccgcacagccccggccacaggccagcttccaggccggtcttccccagcgggatccccccgcacctggcacgcccagatcagcaccagcaacctgtacctgccccaggaccccacggttgccaagggtgccctggctggtgaggacacaggtgttgtgacacatgagcagttcaaggctgcgctcaggatggtggtggaccagggtgacccccggctgctgctggacagctacgtgaagattggcgagggctccaccggcatcgtctgcttggcccgggagaagcactcgggccgccaggtggccgtcaagatgatggacctcaggaagcagcagcgcagggagctgctcttcaacgaggtggtgatcatgcgggactaccagcacttcaacgtggtggagatgtacaagagctacctggtgggcgaggagctgtgggtgctcatggagttcctgcagggaggagccctcacagacatcgtctcccaagtcaggctgaatgaggagcagattgccactgtgtgtgaggctgtgctgcaggccctggcctacctgcatgctcagggtgtcatccaccgggacatcaagagtgactccatcctgctgaccctcgatggcagggtgaagctctcggacttcggattctgtgctcagatcagcaaagacgtccctaagaggaagtccctggtgggaaccccctactggatggctcctgaagtgatctccaggtctttgtatgccactgaggtggatatctggtctctgggcatcatggtgattgagatggtagatggggagccaccgtacttcagtgactccccagtgcaagccatgaagaggctccgggacagccccccacccaagctgaaaaactctcacaaggtctccccagtgctgcgagacttcctggagcggatgctggtgcgggacccccaagagagagccacagcccaggagctcctagaccaccccttcctgctgcagacagggctacctgagtgcctggtgcccctgatccagctctaccgaaagcagacctccacctgctgagcccaccccaagtatgcctgccacctacgcccacaggcagggcacactgggcagccagcctgccggcaggacttgcctgcctcctcctctcagtattctctccaaagattgaaatgtgaagccccagccccaccctctgcccttcagcctactgggccaggccggacctgccccctcagtgtctctccctcccgagtccccagatggagacccctttctacaggatgaccccttgatatttgcacagggatatttctaagaaacgcagaggccagcgttcctggcctctgcagccaacacagtagaaaaggctgctgtggttttttaaaggcagttgtccactagtgtcctaggccactgcagagggcagactgctggtctccacagatacctgctgttctcagctccagcttcaaacctcgagtctcgagagggccacggggtggtttttatgaccggaatcccgcttcctccctcacgtctgatgtcctgaaggtgcagtcccacctgtacagcccctccccgcccagaactgtgaatggcctgctccaggccatggctgggggcagggagtgaggggacaatttctgagtgaaagagaaagaatggggtcggtggtgaaggtgctctcactttacagaatggagagaacatcgtgtgtgtgtgtgtgtgtgtgtgtgtgtgtgtgtgtgtgtaaggggaggaaagccaccttgacagcccaggtccctccaggtcacccacagccagtttcaggaaggctgcccctctctcccactaagttctggcctgaagggacctgctttcttggcctggcttccacctctccactcctgtgtctacctggccagtggagtggtccatgctaagtctaacactcctgggagctcaggaggcttctgagcttctcctgtactgtgcatcgtgagggccagagacaggaatgtaaggattggcaactgtgttacctttcaagtttatctcaataaccaggtcatcagggacccattgttctcttcagaaccctatctgggagagaaggcgaaccacctccgggtttccatcatgtcaaggtcacaggcatccatgtgtgcaaaccatctgccccagctgcctccacagactgctgtctccttgtcctcctcggccctgccccacttcagggctgctgtgagatggaattccaggaaagaacttcaggtgtctggaccctttctatctagataatatttttagattcttctgctccctagtgacctacctgggggcaaagaaattgcaaggacttttttttaagggtcagagttttcaaaacaaaagcatcttccctagaaatttttgtgaattgtttgcacttgtgcctgttttaaattaaattgagtgttcaaagcca

SEQ ID NO: 21398 - DNA, 3878 bp, Homo sapiens
aaagaccagctatgcagcttctttcatggcctatttttattatctccttctcttaaatctgggctcagaatccacgatccctatgattgtaacaagaacaatcaagctttgaagatagtggacttttcctacagtgttgaccttagggtgcagctggatgtttttaccctcagcggctttcggactgtacagatcctggaaggacaaaagatcctggctaactgttcttctccctaccagggagtgccgcttcctgggctagagacaagcaccagcctgcagtggagaacgcaggaccccgctgcccagaaggagcagccacggcctgcggaggactggcccagcaaggtcccaggtcttccctctcctcagcgcctaagagagaggcccagtgcgggtgaggagtcgcgaggaagaggcggaaggcgccggaaggcaccatgttccgcaagaaaaagaagaaacgccctgagatctcagcgccacagaacttccagcaccgtgtccacacctccttcgaccccaaagaaggcaagtttgtgggcctccccccacaatggcagaacatcctggacacactgcggcgccccaagcccgtggtggacccttcgcgaatcacacgggtgcagctccagcccatgaagacagtggtgcggggcagcgcgatgcctgtggatggctacatctcggggctgctcaacgacatccagaagttgtcagtcatcagctccaacaccctgcgtggccgcagccccaccagccggcggcgggcacagtccctggggctgctgggggatgagcactgggccaccgacccagacatgtacctccagagcccccagtctgagcgcactgacccccacggcctctacctcagctgcaacgggggcacaccagcaggccacaagcagatgccgtggcccgagccacagagcccacgggtcctgcccaatgggctggctgcaaaggcacagtccctgggccccgccgagtttcagggtgcctcgcagcgctgtctgcagctgggtgcctgcctgcagagctccccaccaggagcctcgccccccacgggcaccaataggcatggaatgaaggctgccaagcatggctctgaggaggcccggccacagtcctgcctggtgggctcagccacaggcaggccaggtggggaaggcagccctagccctaagacccgggagagcagcctgaagcgcaggctattccgaagcatgttcctgtccactgctgccacagcccctccaagcagcagcaagccaggccctccaccacagagcaagcccaactcctctttccgaccgccgcagaaagacaaccccccaagcctggtggccaaggcccagtccttgccctcggaccagccggtggggaccttcagccctctgaccacttcggataccagcagcccccagaagtccctccgcacagccccggccacaggccagcttccaggccggtcttccccagcgggatccccccgcacctggcacgcccagatcagcaccagcaacctgtacctgccccaggaccccacggttgccaagggtgccctggctggtgaggacacaggtgttgtgacacatgagcagttcaaggctgcgctcaggatggtggtggaccagggtgacccccggctgctgctggacagctacgtgaagattggcgagggctccaccggcatcgtctgcttggcccgggagaagcactcgggccgccaggtggccgtcaagatgatggacctcaggaagcagcagcgcagggagctgctcttcaacgaggtggtgatcatgcgggactaccagcacttcaacgtggtggagatgtacaagagctacctggtgggcgaggagctgtgggtgctcatggagttcctgcagggaggagccctcacagacatcgtctcccaagtcaggctgaatgaggagcagattgccactgtgtgtgaggctgtgctgcaggccctggcctacctgcatgctcagggtgtcatccaccgggacatcaagagtgactccatcctgctgaccctcgatggcagggtgaagctctcggacttcggattctgtgctcagatcagcaaagacgtccctaagaggaagtccctggtgggaaccccctactggatggctcctgaagtgatctccaggtctttgtatgccactgaggtggatatctggtctctgggcatcatggtgattgagatggtagatggggagccaccgtacttcagtgactccccagtgcaagccatgaagaggctccgggacagccccccacccaagctgaaaaactctcacaaggtctccccagtgctgcgagacttcctggagcggatgctggtgcgggacccccaagagagagccacagcccaggagctcctagaccaccccttcctgctgcagacagggctacctgagtgcctggtgcccctgatccagctctaccgaaagcagacctccacctgctgagcccaccccaagtatgcctgccacctacgcccacaggcagggcacactgggcagccagcctgccggcaggacttgcctgcctcctcctctcagtattctctccaaagattgaaatgtgaagccccagccccaccctctgcccttcagcctactgggccaggccggacctgccccctcagtgtctctccctcccgagtccccagatggagacccctttctacaggatgaccccttgatatttgcacagggatatttctaagaaacgcagaggccagcgttcctggcctctgcagccaacacagtagaaaaggctgctgtggttttttaaaggcagttgtccactagtgtcctaggccactgcagagggcagactgctggtctccacagatacctgctgttctcagctccagcttcaaacctcgagtctcgagagggccacggggtggtttttatgaccggaatcccgcttcctccctcacgtctgatgtcctgaaggtgcagtcccacctgtacagcccctccccgcccagaactgtgaatggcctgctccaggccatggctgggggcagggagtgaggggacaatttctgagtgaaagagaaagaatggggtcggtggtgaaggtgctctcactttacagaatggagagaacatcgtgtgtgtgtgtgtgtgtgtgtgtgtgtgtgtgtgtgtgtaaggggaggaaagccaccttgacagcccaggtccctccaggtcacccacagccagtttcaggaaggctgcccctctctcccactaagttctggcctgaagggacctgctttcttggcctggcttccacctctccactcctgtgtctacctggccagtggagtggtccatgctaagtctaacactcctgggagctcaggaggcttctgagcttctcctgtactgtgcatcgtgagggccagagacaggaatgtaaggattggcaactgtgttacctttcaagtttatctcaataaccaggtcatcagggacccattgttctcttcagaaccctatctgggagagaaggcgaaccacctccgggtttccatcatgtcaaggtcacaggcatccatgtgtgcaaaccatctgccccagctgcctccacagactgctgtctccttgtcctcctcggccctgccccacttcagggctgctgtgagatggaattccaggaaagaacttcaggtgtctggaccctttctatctagataatatttttagattcttctgctccctagtgacctacctgggggcaaagaaattgcaaggacttttttttaagggtcagagttttcaaaacaaaagcatcttccctagaaatttttgtgaattgtttgcacttgtgcctgttttaaattaaattgagtgttcaaagcc

SEQ ID NO: 21399 - DNA, 3795 bp, Homo sapiens
aaagaccagctatgcagcttctttcatggcctatttttattatctccttctcttaaatctgggctcagaatccacgatccctatgattgtaacaagaacaatcaagctttgaagatagtggacttttcctacagtgttgaccttagggtgcagctggatgtttttaccctcagcggctttcggactgtacagatcctggaaggacaaaagatcctggctaactgttcttctccctaccaggcctgcggaggactggcccagcaaggtcccaggtcttccctctcctcagcgcctaagagagaggcccagtgcgggtgaggagtcgcgaggaagaggcggaaggcgccggaaggcaccatgttccgcaagaaaaagaagaaacgccctgagatctcagcgccacagaacttccagcaccgtgtccacacctccttcgaccccaaagaaggcaagtttgtgggcctccccccacaatggcagaacatcctggacacactgcggcgccccaagcccgtggtggacccttcgcgaatcacacgggtgcagctccagcccatgaagacagtggtgcggggcagcgcgatgcctgtggatggctacatctcggggctgctcaacgacatccagaagttgtcagtcatcagctccaacaccctgcgtggccgcagccccaccagccggcggcgggcacagtccctggggctgctgggggatgagcactgggccaccgacccagacatgtacctccagagcccccagtctgagcgcactgacccccacggcctctacctcagctgcaacgggggcacaccagcaggccacaagcagatgccgtggcccgagccacagagcccacgggtcctgcccaatgggctggctgcaaaggcacagtccctgggccccgccgagtttcagggtgcctcgcagcgctgtctgcagctgggtgcctgcctgcagagctccccaccaggagcctcgccccccacgggcaccaataggcatggaatgaaggctgccaagcatggctctgaggaggcccggccacagtcctgcctggtgggctcagccacaggcaggccaggtggggaaggcagccctagccctaagacccgggagagcagcctgaagcgcaggctattccgaagcatgttcctgtccactgctgccacagcccctccaagcagcagcaagccaggccctccaccacagagcaagcccaactcctctttccgaccgccgcagaaagacaaccccccaagcctggtggccaaggcccagtccttgccctcggaccagccggtggggaccttcagccctctgaccacttcggataccagcagcccccagaagtccctccgcacagccccggccacaggccagcttccaggccggtcttccccagcgggatccccccgcacctggcacgcccagatcagcaccagcaacctgtacctgccccaggaccccacggttgccaagggtgccctggctggtgaggacacaggtgttgtgacacatgagcagttcaaggctgcgctcaggatggtggtggaccagggtgacccccggctgctgctggacagctacgtgaagattggcgagggctccaccggcatcgtctgcttggcccgggagaagcactcgggccgccaggtggccgtcaagatgatggacctcaggaagcagcagcgcagggagctgctcttcaacgaggtggtgatcatgcgggactaccagcacttcaacgtggtggagatgtacaagagctacctggtgggcgaggagctgtgggtgctcatggagttcctgcagggaggagccctcacagacatcgtctcccaagtcaggctgaatgaggagcagattgccactgtgtgtgaggctgtgctgcaggccctggcctacctgcatgctcagggtgtcatccaccgggacatcaagagtgactccatcctgctgaccctcgatggcagggtgaagctctcggacttcggattctgtgctcagatcagcaaagacgtccctaagaggaagtccctggtgggaaccccctactggatggctcctgaagtgatctccaggtctttgtatgccactgaggtggatatctggtctctgggcatcatggtgattgagatggtagatggggagccaccgtacttcagtgactccccagtgcaagccatgaagaggctccgggacagccccccacccaagctgaaaaactctcacaaggtctccccagtgctgcgagacttcctggagcggatgctggtgcgggacccccaagagagagccacagcccaggagctcctagaccaccccttcctgctgcagacagggctacctgagtgcctggtgcccctgatccagctctaccgaaagcagacctccacctgctgagcccaccccaagtatgcctgccacctacgcccacaggcagggcacactgggcagccagcctgccggcaggacttgcctgcctcctcctctcagtattctctccaaagattgaaatgtgaagccccagccccaccctctgcccttcagcctactgggccaggccggacctgccccctcagtgtctctccctcccgagtccccagatggagacccctttctacaggatgaccccttgatatttgcacagggatatttctaagaaacgcagaggccagcgttcctggcctctgcagccaacacagtagaaaaggctgctgtggttttttaaaggcagttgtccactagtgtcctaggccactgcagagggcagactgctggtctccacagatacctgctgttctcagctccagcttcaaacctcgagtctcgagagggccacggggtggtttttatgaccggaatcccgcttcctccctcacgtctgatgtcctgaaggtgcagtcccacctgtacagcccctccccgcccagaactgtgaatggcctgctccaggccatggctgggggcagggagtgaggggacaatttctgagtgaaagagaaagaatggggtcggtggtgaaggtgctctcactttacagaatggagagaacatcgtgtgtgtgtgtgtgtgtgtgtgtgtgtgtgtgtgtgtgtaaggggaggaaagccaccttgacagcccaggtccctccaggtcacccacagccagtttcaggaaggctgcccctctctcccactaagttctggcctgaagggacctgctttcttggcctggcttccacctctccactcctgtgtctacctggccagtggagtggtccatgctaagtctaacactcctgggagctcaggaggcttctgagcttctcctgtactgtgcatcgtgagggccagagacaggaatgtaaggattggcaactgtgttacctttcaagtttatctcaataaccaggtcatcagggacccattgttctcttcagaaccctatctgggagagaaggcgaaccacctccgggtttccatcatgtcaaggtcacaggcatccatgtgtgcaaaccatctgccccagctgcctccacagactgctgtctccttgtcctcctcggccctgccccacttcagggctgctgtgagatggaattccaggaaagaacttcaggtgtctggaccctttctatctagataatatttttagattcttctgctccctagtgacctacctgggggcaaagaaattgcaaggacttttttttaagggtcagagttttcaaaacaaaagcatcttccctagaaatttttgtgaattgtttgcacttgtgcctgttttaaattaaattgagtgttcaaagcc

SEQ ID NO: 21400 - DNA, 565 bp, Homo sapiens
aaaattgccaagcaacgttggagcagctcggcgccccaaacgagcaggtcgatgcctgaggatttaatggagaaatcccaaagcctgcggaggactggcccagcaaggtcccaggtcttccctctcctcagcgcctaagagagaggcccagtgcgggtgaggagtcgcgaggaagaggcggaaggcgccggaaggcaccatgttccgcaagaaaaagaagaaacgccctgagatctcagcgccacagaacttccagcaccgtgtccacacctccttcgaccccaaagaaggcaagtttgtgggcctccccccacaatggcagaacatcctggacacactgcggcgccccaagcccgtggtggacccttcgcgaatcacacgggtgcagctccagcccatgaagacagtggtgcggggcagcgcgatgcctgtggatggctacatctcggggctgctcaacgacatccagaagttgtcagtcatcagctccaacaccctgcgtggccgcagccccaccagccggcggcgggcacagtccctggggctgctgggggatgagcactgg

SEQ ID NO: 21401 - DNA, 560 bp, Homo sapiens
acacgcggcccgctcaggtccgggagagtcggcccgcggctctggagcgtgcatctgcgatgccagtgaacgaggcctgcggaggactggcccagcaaggtcccaggtcttccctctcctcagcgcctaagagagaggcccagtgcgggtgaggagtcgcgaggaagaggcggaaggcgccggaaggcaccatgttccgcaagaaaaagaagaaacgccctgagatctcagcgccacagaacttccagcaccgtgtccacacctccttcgaccccaaagaaggcaagtttgtgggcctccccccacaatggcagaacatcctggacacactgcggcgccccaagcccgtggtggacccttcgcgaatcacacgggtgcagctccagcccatgaagacagtggtgcggggcagcgcgatgcctgtggatggctacatctcggggctgctcaacgacatccagaagttgtcagtcatcagctccaacaccctgcgtggccgcagccccaccagccggcggcgggcacagtccctggggctgctgggggatgagcactgggcc

SEQ ID NO: 21402 - DNA, 571 bp, Homo sapiens
ttcgcgtccccgagagggcgcagcagtggggcctgcgagctggggccgggtggccgcgccgggtcggagtgtggctggagaggggccgccccggaagcggtgctgcgcccaacgtccccttctccccgcctgcggaggactggcccagcaaggtcccaggtcttccctctcctcagcgcctaagagagaggcccagtgcgggtgaggagtcgcgaggaagaggcggaaggcgccggaaggcaccatgttccgcaagaaaaagaagaaacgccctgagatctcagcgccacagaacttccagcaccgtgtccacacctccttcgaccccaaagaaggcaagtttgtgggcctccccccacaatggcagaacatcctggacacactgcggcgccccaagcccgtggtggacccttcgcgaatcacacgggtgcagctccagcccatgaagacagtggtgcggggcagcgcgatgcctgtggatggctacatctcggggctgctcaacgacatccagaagttgtcagtcatcagctccaacaccctgcgtggccgcagccccaccagccggcgg

SEQ ID NO: 21403 - DNA, 598 bp, Homo sapiens
aaaatcgcggtcaggtgaagccggcgctgcaccaacgtgtaagcgcggcccctcctcggcgttcccgcgccgaggtccctcccgcggagggcgggcccggctcccacgacctcttcgagcgttcctgggcttcccgctccgcaggcctgcggaggactggcccagcaaggtcccaggtcttccctctcctcagcgcctaagagagaggcccagtgcgggtgaggagtcgcgaggaagaggcggaaggcgccggaaggcaccatgttccgcaagaaaaagaagaaacgccctgagatctcagcgccacagaacttccagcaccgtgtccacacctccttcgaccccaaagaaggcaagtttgtgggcctccccccacaatggcagaacatcctggacacactgcggcgccccaagcccgtggtggacccttcgcgaatcacacgggtgcagctccagcccatgaagacagtggtgcggggcagcgcgatgcctgtggatggctacatctcggggctgctcaacgacatccagaagttgtcagtcatcagctccaacaccctgcgtggccgcagccccaccagccggcggcgggcacagt

SEQ ID NO: 21404 - DNA, 4020 bp, Homo sapiens
attttgggagctggaaacttggagctgcacctgagtcccgccccttctagctctcccctccctaccttgggctccaggaagatgggacttgctgtgagtctgctgccaccccctaaagatatggaagacgctgtgggggccagaagtgcccggggggctgtggcagcaggcagagtgcaatagcagatatggtggtcaggctgcctgtgtgtgtcctctggaggtgttgggacagaagggcagtcttgtccgagctgactggagtcctcccgggctggctctgaactcatctcccacggggatgtttcggtaaaggagtggcttctggggtcggagtggcatttggagagcgaggctggattggcttaggctggcctgggcagggagtgccgcttcctgggctagagacaagcaccagcctgcagtggagaacgcaggaccccgctgcccagaaggagcagccacggcctgcggaggactggcccagcaaggtcccaggtcttccctctcctcagcgcctaagagagaggcccagtgcgggtgaggagtcgcgaggaagaggcggaaggcgccggaaggcaccatgttccgcaagaaaaagaagaaacgccctgagatctcagcgccacagaacttccagcaccgtgtccacacctccttcgaccccaaagaaggcaagtttgtgggcctccccccacaatggcagaacatcctggacacactgcggcgccccaagcccgtggtggacccttcgcgaatcacacgggtgcagctccagcccatgaagacagtggtgcggggcagcgcgatgcctgtggatggctacatctcggggctgctcaacgacatccagaagttgtcagtcatcagctccaacaccctgcgtggccgcagccccaccagccggcggcgggcacagtccctggggctgctgggggatgagcactgggccaccgacccagacatgtacctccagagcccccagtctgagcgcactgacccccacggcctctacctcagctgcaacgggggcacaccagcaggccacaagcagatgccgtggcccgagccacagagcccacgggtcctgcccaatgggctggctgcaaaggcacagtccctgggccccgccgagtttcagggtgcctcgcagcgctgtctgcagctgggtgcctgcctgcagagctccccaccaggagcctcgccccccacgggcaccaataggcatggaatgaaggctgccaagcatggctctgaggaggcccggccacagtcctgcctggtgggctcagccacaggcaggccaggtggggaaggcagccctagccctaagacccgggagagcagcctgaagcgcaggctattccgaagcatgttcctgtccactgctgccacagcccctccaagcagcagcaagccaggccctccaccacagagcaagcccaactcctctttccgaccgccgcagaaagacaaccccccaagcctggtggccaaggcccagtccttgccctcggaccagccggtggggaccttcagccctctgaccacttcggataccagcagcccccagaagtccctccgcacagccccggccacaggccagcttccaggccggtcttccccagcgggatccccccgcacctggcacgcccagatcagcaccagcaacctgtacctgccccaggaccccacggttgccaagggtgccctggctggtgaggacacaggtgttgtgacacatgagcagttcaaggctgcgctcaggatggtggtggaccagggtgacccccggctgctgctggacagctacgtgaagattggcgagggctccaccggcatcgtctgcttggcccgggagaagcactcgggccgccaggtggccgtcaagatgatggacctcaggaagcagcagcgcagggagctgctcttcaacgaggtggtgatcatgcgggactaccagcacttcaacgtggtggagatgtacaagagctacctggtgggcgaggagctgtgggtgctcatggagttcctgcagggaggagccctcacagacatcgtctcccaagtcaggctgaatgaggagcagattgccactgtgtgtgaggctgtgctgcaggccctggcctacctgcatgctcagggtgtcatccaccgggacatcaagagtgactccatcctgctgaccctcgatggcagggtgaagctctcggacttcggattctgtgctcagatcagcaaagacgtccctaagaggaagtccctggtgggaaccccctactggatggctcctgaagtgatctccaggtctttgtatgccactgaggtggatatctggtctctgggcatcatggtgattgagatggtagatggggagccaccgtacttcagtgactccccagtgcaagccatgaagaggctccgggacagccccccacccaagctgaaaaactctcacaaggtctccccagtgctgcgagacttcctggagcggatgctggtgcgggacccccaagagagagccacagcccaggagctcctagaccaccccttcctgctgcagacagggctacctgagtgcctggtgcccctgatccagctctaccgaaagcagacctccacctgctgagcccaccccaagtatgcctgccacctacgcccacaggcagggcacactgggcagccagcctgccggcaggacttgcctgcctcctcctctcagtattctctccaaagattgaaatgtgaagccccagccccaccctctgcccttcagcctactgggccaggccggacctgccccctcagtgtctctccctcccgagtccccagatggagacccctttctacaggatgaccccttgatatttgcacagggatatttctaagaaacgcagaggccagcgttcctggcctctgcagccaacacagtagaaaaggctgctgtggttttttaaaggcagttgtccactagtgtcctaggccactgcagagggcagactgctggtctccacagatacctgctgttctcagctccagcttcaaacctcgagtctcgagagggccacggggtggtttttatgaccggaatcccgcttcctccctcacgtctgatgtcctgaaggtgcagtcccacctgtacagcccctccccgcccagaactgtgaatggcctgctccaggccatggctgggggcagggagtgaggggacaatttctgagtgaaagagaaagaatggggtcggtggtgaaggtgctctcactttacagaatggagagaacatcgtgtgtgtgtgtgtgtgtgtgtgtgtgtgtgtgtgtgtgtaaggggaggaaagccaccttgacagcccaggtccctccaggtcacccacagccagtttcaggaaggctgcccctctctcccactaagttctggcctgaagggacctgctttcttggcctggcttccacctctccactcctgtgtctacctggccagtggagtggtccatgctaagtctaacactcctgggagctcaggaggcttctgagcttctcctgtactgtgcatcgtgagggccagagacaggaatgtaaggattggcaactgtgttacctttcaagtttatctcaataaccaggtcatcagggacccattgttctcttcagaaccctatctgggagagaaggcgaaccacctccgggtttccatcatgtcaaggtcacaggcatccatgtgtgcaaaccatctgccccagctgcctccacagactgctgtctccttgtcctcctcggccctgccccacttcagggctgctgtgagatggaattccaggaaagaacttcaggtgtctggaccctttctatctagataatatttttagattcttctgctccctagtgacctacctgggggcaaagaaattgcaaggacttttttttaagggtcagagttttcaaaacaaaagcatcttccctagaaatttttgtgaattgtttgcacttgtgcctgttttaaattaaattgagtgttcaaagc

SEQ ID NO: 21405 - DNA, 1146 bp, Homo sapiens
ccccttctccccgtaagccccgcaaggagcctgccgcctcttgcacctgagccaggagttcagtcgggaggcgggcgcggagcggttcccagcgcctggacgtcagccagtcgcaacacccgcgggaacacttgctacatttgccataatgcatttctgatctgtttccgcgcaggcctgcggaggactggcccagcaaggtcccaggtcttccctctcctcagcgcctaagagagaggcccagtgcgggtgaggagtcgcgaggaagaggcggaaggcgccggaaggcaccatgttccgcaagaaaaagaagaaacgccctgagatctcagcgccacagaacttccagcaccgtgtccacacctccttcgaccccaaagaaggcaagtttgtgggcctccccccacaatggcagaacatcctggacacactgcggcgccccaagcccgtggtggacccttcgcgaatcacacgggtgcagctccagcccatgaagacagtggtgcggggcagcgcgatgcctgtggatggctacatctcggggctgctcaacgacatccagaagttgtcagtcatcagctccaacaccctgcgtggccgcagccccaccagccggcggcgggcacagtccctggggctgctgggggatgagcactgggccaccgacccagacatgtacctccagagcccccagtctgagcgcactgacccccacggcctctacctcagctgcaacgggggcacaccagcaggccacaagcagatgccgtggcccgagccacagagcccacgggtcctgcccaatgggctggctgcaaaggcacagtccctgggccccgccgagtttcagggtgcctcgcagcgctgtctgcagctgggtgcctgcctgcagagctccccaccaggagcctcgccccccacgggcaccaataggcatggaatgaaggctgccaagcatggctctgaggaggcccggccacagtcctgcctggtgggctcagccacaggcaggccaggtggggaaggcagccctagccctaagacccgggagagcagcctgaagcgcaggctattccgaagcatgttcctgtccactgctgccacagcccctccaagcagcagcaagccaggccctccaccacagag

SEQ ID NO: 21406 - DNA, 891 bp, Homo sapiens
aaaaccagctgagaccagcacctgccagatctgaatgcgcagctccaagttctggggggtgggggtgggggtgagccaaggaggtctggcttctctagggcaagggtaggaaggacagcagggaggctcaccctgagcccggcaggcagcccttcctcctcctccccttcagcaaagaaaggcagataaaaacgtgtttttataaatagctccagccccagctgatttgtaaattcagtgggttttttgtgtcaatgacatcaccttcctccccatggcaacccccgacgatatcaaaattgccaagcaacgttggagcagctcggcgccccaaacgagcaggtcgatgcctgaggatttaatggagaaatcccaaaggagtgccgcttcctgggctagagacaagcaccagcctgcagtggagaacgcaggaccccgctgcccagaaggagcagccacggcctgcggaggactggcccagcaaggtcccaggtcttccctctcctcagcgcctaagagagaggcccagtgcgggtgaggagtcgcgaggaagaggcggaaggcgccggaaggcaccatgttccgcaagaaaaagaagaaacgccctgagatctcagcgccacagaacttccagcaccgtgtccacacctccttcgaccccaaagaaggcaagtttgtgggcctccccccacaatggcagaacatcctggacacactgcggcgccccaagcccgtggtggacccttcgcgaatcacacgggtgcagctccagcccatgaagacagtggtgcggggcagcgcgatgcctgtggatggctacatctcggggctgctcaacgacatccagaagttgtcagtcatcagctccaacaccctgcgtggccgcagccc

SEQ ID NO: 21407 - DNA, 586 bp, Homo sapiens
ccagcggtgagtgctatctttcgcggcgacggcgggcatcaggtgggctgagtcgatggatcacgggagccccccagcccggcctgcatccctgagggcagtgcccctcgcagtcaggtgtctcggcggcccccacaacacagtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggag

SEQ ID NO: 21408 - DNA, 548 bp, Homo sapiens
gagtgctatctttcgcggcgacggcgggtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcg

SEQ ID NO: 21409 - DNA, 736 bp, Homo sapiens
aagaaaagttgctatattttgcaaaagacataaatctacagattcaagaaactgagtgaaccccacagaaggtataaagaagaaactcagagattaaagactctttcagggcagaaggctcacacaggcttccagaacctcctcggagcgattgtagggactgcctgacccggaagagagttgtcagtcaagaccgccagagttttcccatcagagtatttggcatagcagaggtggctcccaaactgtgccagggcactgcagcaaactcacaagtgatcattctcaatgcggcggacgctcaagtctgttgaactccatgcgaagtgctagcttgggacagttcacggttccaacgtgagatccttgctgcattccttcttaggattttacatctttgcgaagctgggtttgcagtggttgttcagacctaactatacgtggaactgttaggcatttttttttggcctacggataccattaaaaatttgctgagataccagggactccacaaacgaaggacatttgggatctgtccagacagtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacatt

SEQ ID NO: 21410 - DNA, 2158 bp, Homo sapiens
gaaggcggtggtagcgcctcagtggtgtgggcctgagccctgcccaggtgcccgcagagagcagccgggctgccagcgtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgtttggtcttgggaacaagacctacgagcacttcaatgccatgggcaagtacgtggacaagcggctggagcagctcggcgcccagcgcatctttgagctggggttgggcgacgacgatgggaacttggaggaggacttcatcacctggcgagagcagttctggccggccgtgtgtgaacactttggggtggaagccactggcgaggagtccagcattcgccagtacgagcttgtggtccacaccgacatagatgcggccaaggtgtacatgggggagatgggccggctgaagagctacgagaaccagaagcccccctttgatgccaagaatccgttcctggctgcagtcaccaccaaccggaagctgaaccagggaaccgagcgccacctcatgcacctggaattggacatctcggactccaaaatcaggtatgaatctggggaccacgtggctgtgtacccagccaacgactctgctctcgtcaaccagctgggcaaaatcctgggtgccgacctggacgtcgtcatgtccctgaacaacctggatgaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtccaccccaactctgtgcacatctgtgcggtggttgtggagtacgagaccaaggctggccgcatcaacaagggcgtggccaccaactggctgcgggccaaggagcctgccggggagaacggcggccgtgcgctggcggtgcccacatctacgtctgtggggatgcacggaacatggccagggatgtgcagaacaccttctacgacatcgtggctgagctcggggccatggagcacgcgcaggcggtggactacatcaagaaactgatgaccaagggccgctactccctggacgtgtggagctaggggcctgcctgccccacccaccccacagactccggcctgtaatcagctctcctggctccctcccgtagtctcctgggtgtgtttggcttggccttggcatgggcgcaggcccagtgacaaagactcctctgggcctggggtgcatcctcctcagcccccaggccaggtgaggtccaccggcccctggcagcacagcccagggcctgcatgggggcaccgggctccatgcctctggaggcctctggccctcggtggctgcacagaagggctctttctctctgctgagctgggcccagcccctccacgtgatttccagtgagtgtaaataattttaaataacctctggcccttggaataaagttctgttttctgt

SEQ ID NO: 21411 - DNA, 631 bp, Homo sapiens
agagagcagccgggctgccagcggtgagtgctatctttcgcggcgacggcggggtgggtgaggtcgggccccaagactcggggtttgccgggcgcctcagttcaccgcggccgcctggctctctgcgtcggggtgggccctcgggcctgggcactgcgcgtctggcccgacgctcgggcggaaggcatggctcccaccccggccctcctccgcgtcgcccttcccctagagctgatctcccgcggcggcctgagggtcgacttttccacagcttgggccgagagagcccggcaggccctcggctgagggttagggctcggtatctcagggctcggggtccagtccccgcgccgccgccccccacgggctaagccactttaactctccgagcctcagtttccccatctgtacgatgaatgggcctcgggaggcagcgaattctgggggtacctaacgtgagaggcgctcgatgcatgctcatgggacccgaatctaaccctgcagcatcagtttcatgatcaacatgggagactcccacgtggacaccagctccaccgtgtccgaggcggtggccgaagaagtatctcttttcagcatgacggacatgattctgttttcgctcatcgtgggt

SEQ ID NO: 21412 - DNA, 561 bp, Homo sapiens
gcacttgagaactctcacagggagggaagcaagcatacaattcaacaagaatggcacgtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctct

SEQ ID NO: 21413 - DNA, 625 bp, Homo sapiens
agcaaggagaccggaagaaggtctggggaagttatttggacaatgaagagagccagtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgtttggtcttgggaacaagacctacgagcacttcaatgccatgggca

SEQ ID NO: 21414 - DNA, 283 bp, Homo sapiens
gacttcctgggccctgaagctccaaggacaaaagactcctgtcccttttcccttcctctccattctgggtctcccaccaccaccaagtccttttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacatt

SEQ ID NO: 21415 - DNA, 1888 bp, Homo sapiens
agagactgctatgggctcccggtggcctgcggtgcctccctggggactccagatccatgtatctgaaaggcagccctccagacccccaccctgtcctcagcagccagggcaggccacttgtgagaccctctcctctgccccagaccccagcactacgagaatgtcccctccctgtccccagccccagtcggctccagggggcattgggtgctggagactaaaggtgtttggtcttgggaacaagacctacgagcacttcaatgccatgggcaagtacgtggacaagcggctggagcagctcggcgcccagcgcatctttgagctggggttgggcgacgacgatgggaacttggaggaggacttcatcacctggcgagagcagttctggccggccgtgtgtgaacactttggggtggaagccactggcgaggagtccagcattcgccagtacgagcttgtggtccacaccgacatagatgcggccaaggtgtacatgggggagatgggccggctgaagagctacgagaaccagaagcccccctttgatgccaagaatccgttcctggctgcagtcaccaccaaccggaagctgaaccagggaaccgagcgccacctcatgcacctggaattggacatctcggactccaaaatcaggtatgaatctggggaccacgtggctgtgtacccagccaacgactctgctctcgtcaaccagctgggcaaaatcctgggtgccgacctggacgtcgtcatgtccctgaacaacctggatgaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtccaccccaactctgtgcacatctgtgcggtggttgtggagtacgagaccaaggctggccgcatcaacaagggcgtggccaccaactggctgcgggccaaggagcctgccggggagaacggcggccgtgcgctggtgcccatgttcgtgcgcaagtcccagttccgcctgcccttcaaggccaccacgcctgtcatcatggtgggccccggcaccggggtggcacccttcataggcttcatccaggagcgggcctggctgcgacagcagggcaaggaggtgggggagacgctgctgtactacggctgccgccgctcggatgaggactacctgtaccgggaggagctggcgcagttccacagggacggtgcgctcacccagctcaacgtggccttctcccgggagcagtcccacaaggtctacgtccagcacctgctaaagcaagaccgagagcacctgtggaagttgatcgaaggcggtgcccacatctacgtctgtggcaccccctcttcctgcccagggatgcacggaacatggccagggatgtgcagaacaccttctacgacatcgtggctgagctcggggccatggagcacgcgcaggcggtggactacatcaagaaactgatgaccaagggccgctactccctggacgtgtggagctaggggcctgcctgccccacccaccccacagactccggcctgtaatcagctctcctggctccctcccgtagtctcctgggtgtgtttggcttggccttggcatgggcgcaggcccagtgac

SEQ ID NO: 21416 - DNA, 498 bp, Homo sapiens
agaccgccctcagcacaggacctgccctggctggtcagccctgcctggggcacccacagccccagctgtccagtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatgg

SEQ ID NO: 21417 - DNA, 2522 bp, Homo sapiens
acgcccccacccccgcggccggcgaaggcggtggtagcgcctcagtggtgtgggcctgagccctgcccaggtgcccgcagagagcagccgggctgccagcgtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgtttggtcttgggaacaagacctacgagcacttcaatgccatgggcaagtacgtggacaagcggctggagcagctcggcgcccagcgcatctttgagctggggttgggcgacgacgatgggaacttggaggaggacttcatcacctggcgagagcagttctggccggccgtgtgtgaacactttggggtggaagccactggcgaggagtccagcattcgccagtacgagcttgtggtccacaccgacatagatgcggccaaggtgtacatgggggagatgggccggctgaagagctacgagaaccagaagcccccctttgatgccaagaatccgttcctggctgcagtcaccaccaaccggaagctgaaccagggaaccgagcgccacctcatgcacctggaattggacatctcggactccaaaatcaggtatgaatctggggaccacgtggctgtgtacccagccaacgactctgctctcgtcaaccagctgggcaaaatcctgggtgccgacctggacgtcgtcatgtccctgaacaacctggatgaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtccaccccaactctgtgcacatctgtgcggtggttgtggagtacgagaccaaggctggccgcatcaacaagggcgtggccaccaactggctgcgggccaaggagcctgccggggagaacggcggccgtgcgctggtgcccatgttcgtgcgcaagtcccagttccgcctgcccttcaaggccaccacgcctgtcatcatggtgggccccggcaccggggtggcacccttcataggcttcatccaggagcgggcctggctgcgacagcagggcaaggaggtgggggagacgctgctgtactacggctgccgccgctcggatgaggactacctgtaccgggaggagctggcgcagttccacagggacggtgcgctcacccagctcaacgtggccttctcccgggagcagtcccacaaggtctacgtccagcacctgctaaagcaagaccgagagcacctgtggaagttgatcgaaggcggtgcccacatctacgtctgtggggatgcacggaacatggccagggatgtgcagaacaccttctacgacatcgtggctgagctcggggccatggagcacgcgcaggcggtggactacatcaagaaactgatgaccaagggccgctactccctggacgtgtggagctaggggcctgcctgccccacccaccccacagactccggcctgtaatcagctctcctggctccctcccgtagtctcctgggtgtgtttggcttggccttggcatgggcgcaggcccagtgacaaagactcctctgggcctggggtgcatcctcctcagcccccaggccaggtgaggtccaccggcccctggcagcacagcccagggcctgcatgggggcaccgggctccatgcctctggaggcctctggccctcggtggctgcacagaagggctctttctctctgctgagctgggcccagcccctccacgtgatttccagtgagtgtaaataattttaaataacctctggcccttggaataaagttctgttttctgta

SEQ ID NO: 21418 - DNA, 1905 bp, Homo sapiens
agagatcgacaacgccctggtggttttctgcatggccacctacggtgagggagaccccaccgacaatgcccaggacttctacgactggctgcaggagacagacgtggatctctctggggtcaagttcgcgcttggaggaggacttcatcacctggcgagagcagttctggccggccgtgtgtgaacactttggggtggaagccactggcgaggagtccagcattcgccagtacgagcttgtggtccacaccgacatagatgcggccaaggtgtacatgggggagatgggccggctgaagagctacgagaaccagaagcccccctttgatgccaagaatccgttcctggctgcagtcaccaccaaccggaagctgaaccagggaaccgagcgccacctcatgcacctggaattggacatctcggactccaaaatcaggtatgaatctggggaccacgtggctgtgtacccagccaacgactctgctctcgtcaaccagctgggcaaaatcctgggtgccgacctggacgtcgtcatgtccctgaacaacctggatgaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtccaccccaactctgtgcacatctgtgcggtggttgtggagtacgagaccaaggctggccgcatcaacaagggcgtggccaccaactggctgcgggccaaggagcctgccggggagaacggcggccgtgcgctggtgcccatgttcgtgcgcaagtcccagttccgcctgcccttcaaggccaccacgcctgtcatcatggtgggccccggcaccggggtggcacccttcataggcttcatccaggagcgggcctggctgcgacagcagggcaaggaggtgggggagacgctgctgtactacggctgccgccgctcggatgaggactacctgtaccgggaggagctggcgcagttccacagggacggtgcgctcacccagctcaacgtggccttctcccgggagcagtcccacaaggtctacgtccagcacctgctaaagcaagaccgagagcacctgtggaagttgatcgaaggcggtgcccacatctacgtctgtggggatgcacggaacatggccagggatgtgcagaacaccttctacgacatcgtggctgagctcggggccatggagcacgcgcaggcggtggactacatcaagaaactgatgaccaagggccgctactccctggacgtgtggagctaggggcctgcctgccccacccaccccacagactccggcctgtaatcagctctcctggctccctcccgtagtctcctgggtgtgtttggcttggccttggcatgggcgcaggcccagtgacaaagactcctctgggcctggggtgcatcctcctcagcccccaggccaggtgaggtccaccggcccctggcagcacagcccagggcctgcatgggggcaccgggctccatgcctctggaggcctctggccctcggtggctgcacagaagggctctttctctctgctgagctgggcccagcccctccacgtgatttccagtgagtgtaaataattttaaataacctctggcccttggaataaagttctgttttctgt

SEQ ID NO: 21419 - DNA, 1385 bp, Homo sapiens
agcctgcgcaccaccgttcttttaactgcgcaggcgcgccggaagcacctagagagcggcgcgtgcgcagcgggagtcgaagcggagatcccggggtcgcgcgagagccgcaagcggagttggtgggcgctatgctatcacccgaggcagagcgagtgctgcggtaccttgtagaagtggaggagctcgccgaggaggtgctggcggacaagcggcagattgtggacctggacactaaaaggaatcagaatcgagagggcctgagggccctgcagaaggatctcagcctctctgaagatgtgatggtttgcttcgggaacatgtttatcaagatgcctcaccctgagacaaaggaaatgattgaaaaagatcaagatcatctggataaagaaatagaaaaactgcggaagcaacttaaagtgaaggtcaaccgcctttttgaggcccaaggcaaaccggagctgaagggttttaacttgaaccccctcaaccaggatgagcttaaagctctcaaggtcatcttgaaaggatgagactcaagaaccaagatgggggaccagcaaccccccagggtcatggaggacccaggaccctccaaccttgacacctgtaaggacaggatctgccctgtaaggggccagccgtcaggaatctggccatgaaaacctctttgtagtgcttggctactctgtgatggcaggagggaaccttcagcctgtctggctgctggacctggacaccagggctcggtggacacaagatctattgacgggccttggtagccaccagtgggtgtgtggggcagtggctgtgggggtgtaagaatgactgcaacaggcacttcccaacaatggcctgctgttcacatggaccctgagcaaggaaggagggagggaggggcagagtggagtgtcattccagcattcctctcagaagggagagaggttttcaggctggtgccatgcgattggaataaagcaggaggctcatgggtggttgctgaatgaagaacagaatcttggtgctttgtggctcaccacagccatctgtggggcaggcacacacacctcccgccagctccaattttgcactttttccctgcttgattccaagagtaggtgctgcctagcagcccttcgtggccactctttactcaggagggccttgcagagtcctgcaccaggcctgggtgagtggatgcgcctcttaccatatgacacgtgtcaagatgcccttccgccccctctgaaagtggggcccggccagcactgctcgttactgtctgccttcagtggtctgaggtcccagtatgaactgccgtgaagtcaaaactcttatgtgttcattaagggctcaataaatgttagctgaatgaatgaatagca

SEQ ID NO: 21420 - DNA, 2838 bp, Homo sapiens
aaattgattcccgcacgctgcagcctcccggtcagacgaatttctcccaatcggatgaagttcaccctgggcctggggtcgcgggcgtggagagtgtcctgggagggggcagcagcggcggcggcaggccctggagcgggcggcagcgcgctccgctgccgcgcacagcgcgtctccagcccgcggctgggccgccgcggctctcggctctcgggcgccctccctctatgcctctcacgcggcggcggcggcgcccaagctctcccggactgcgccgggcccagccccggccaccccggccaccccggcgccaggcagctggccggcccgctcgctatggagcagacgtatggcgaggtgaaccagctgggcggtgtgttcgtcaacggccgccccctgcccaacgccatccgcttgcgcattgtggagctggcgcagctgggcatccgaccctgtgacatcagtcggcagctccgcgtatcccacggctgcgtgagcaagatcctggcgcgctacaacgagaccggctccattctgcccggggccatcggggggagcaagccccgcgtcaccactcccaacgtggtcaagcacatccgggactacaagcaaggagaccctggcatctttgcctgggagatccgcgaccggctgctggccgacggcgtctgtgacaagtacaatgtgccttcggtgagctccatcagccgcatcctgcgcaacaagatcggcagcctggcgcagcccggaccgtacgaggcaagtaagcagccgccgtcgcagcctacgctgccctacaaccacatctaccagtacccctaccccagtcccgtgtcgcccacgggcgccaagatgggcagccaccccggggtcccgggcacggcgggccacgtcagcatcccgcgctcatggccctcggcacactcggtcagcaacatcctgggcatccggacgtttatggagcaaacaggggccctggctgggagcgaaggcaccgcttactctcccaagatggaagactgggccggcgtgaaccgcacggccttccccgccacccccgcagtgaatgggctagagaaacctgccttagaggcagacattaaatacactcagtcggcctccaccctctctgccgtgggcggctttctccccgcctgcgcctacccggcctccaaccagcacggcgtgtacagcgccccgggcggcggctacctcgccccgggcccgccgtggccgcctgcgcaaggtcctcctctggcgccccccggggccggcgtagctgtgcatggcggggaactcgcggcagcaatgaccttcaagcatcccagccgagaaggaagcctcccagctccggcagcaaggccccggacgccctcagtagcttacacggactgcccatcccggcctcgacctcctaggggcagctctccccggacccgagcccggagggaacggcaggcggacccgggcgcacaggtctgcgcggcggccccggcaatcggcacgggcaggatcggaggactcgcggaggaggaagccagtgccggcccgcggggtgcacgcccagccagcccccaggcccagccctgcctctggccggacccaccacacttcctttattggtctgggtttttaggcttctctgaacttgggttttagactgccgtaccctcctcacaatccttgctctgacgtggcctccttcgctctgccagcttcaaatttcttttttgtcactcccttgtccgtctccgtctcgcctctctccctgtttccttcccccctctttctttctcactctccctcccttccctttctctttcccttcctccctaccttccaccccggctttccccgaccttccagggctccctctgcccttccactctcttttccttgctccgacctctgctccagtcccgcttcttcccccgtctcctctttctagtcctctatatgctatcagccctttttcctggtccatccctgtcgttccttctctctctgtctctggttctactgtcaagggccctagttccctttgttttactgcttccccaaccctccctcagtccctgagagccctagagccatctcggtgacagtcccttctctggcacctgggactttgtagccttcactcctctgagcccaccagccctaatggaggggggctcaaacctaggaagtggacagaaaagccacagcctttattttgtattttttttgtaataacaaaccctaaaaaaccctccatgaactgtcctctcccgtcgatccccgcagcatattgtctggaaatctgttttctttctcagagcccagtggccgccgggcttctcttcccttctgagatgatgtcaccccaaagaagactggggtaggagtagggagcacaggggttgttggtgttttcagtgcttagaaaactgggttgtcctgcaggtgtctcctcccacccctccactcgcaacacttgctagggaatccgaccagtggtaaacacatcagcactttttggtgttcaggggtcagcacatttgttaatttaaaccacagactgcttccaggtacaaaggttcatttggacttctggtttgcaagggatgagggttaaaaaaaacaaaacaaaacaaacaacaacaacaacaaaaacaacccagaaagtatcttctagagccagccgcaagagctgtgagctgcttccaagttaggcgagctggtggtggtaccctggacataatgcaattctgtagtcagagcaatatccctggcgagagcctgacatcgcctgttaaaggtggctgcctctgaataaaggaaagcgtctgaaaggtg

SEQ ID NO: 21421 - DNA, 4057 bp, Homo sapiens
cgggggcctggcccgcgcgctcccctcccgcaggcgccacctcggacatccccgggattgctacttctctgccaacttcgccaactcgccagcacttggagaggcccggctcccctcccggcgccctctgaccgcccccgccccgcgcgctctccgaccaccgcctctcggatgaccaggttccaggggagctgagcgagtcgcctcccccgcccagcttcagccctggctgcagctgcagcgcgagccatgcgcccccagtgcaccccggcccggcccaccgccccggggccattctgctgaccgcccagccccgagccccgacagtggcaagttgcggctactgcagttgcaagctccggccaacccggaggagccccagcggggagcgcagtgctgcgccccccgcccccgcgcgccccgcagcagccgggcgttcactcatcctccctcccccaccgtccctcccttttctcctcaagtcctgaagttgagtttgagaggcgacacggcggcggcggccgcgctgctcccgctcctctgcctccccatggatatgcactgcaaagcagaccccttctccgcgatgcacccagggcacgggggtgtgaaccagctcgggggggtgtttgtgaacggccggcccctacccgacgtggtgaggcagcgcatcgtggagctggcccaccagggtgtgcggccctgtgacatctcccggcagctgcgggtcagccacggctgtgtcagcaaaatcctgggcaggtactacgagaccggcagcatcaagccgggtgtgatcggtggctccaagcccaaagtggcgacgcccaaagtggtggacaagattgctgaatacaaacgacagaacccgactatgttcgcctgggagattcgagaccggctcctggccgagggcatctgtgacaatgacacagtgcccagcgtctcttccatcaacagaatcatccggaccaaagttcagcagcctttccacccaacgccggatggggctgggacaggagtgaccgcccctggccacaccattgttcccagcacggcctcccctcctgtttccagcgcctccaatgacccagtgggatcctactccatcaatgggatcctggggattcctcgctccaatggtgagaagaggaaacgtgatgaagatgtgtctgagggctcagtccccaatggagattcccagagtggtgtggacagtttgcggaagcacttgcgagctgacaccttcacccagcagcagctggaagctttggatcgggtctttgagcgtccttcctaccctgacgtcttccaggcatcagagcacatcaaatcagaacaggggaacgagtactccctcccagccctgacccctgggcttgatgaagtcaagtcgagtctatctgcatccaccaaccctgagctgggcagcaacgtgtcaggcacacagacatacccagttgtgactggtcgtgacatggcgagcaccactctgcctggttacccccctcacgtgccccccactggccagggaagctaccccacctccaccctggcaggaatggtgcctgggagcgagttctccggcaacccgtacagccacccccagtacacggcctacaacgaggcttggagattcagcaaccccgccttactaagttccccttattattatagtgccgccccccggggctccgcccctgccgctgctgccgctgcctatgaccgccactagttaccgcggggaccacatcaagcttcaggccgacagcttcggcctccacatcgtccccgtctgaccccaccccggagggagggaggaccgacgcgacgcgatgcctcccggccaccgccccagcctcaccccatcccacgacccccgcaacccttcacatcacccccctcgaaggtcggacaggacgggtggagccgtgggcgggaccctcaggcccgggcccgccgcccccagccccgcctgccgcccctccccgcctgcctggactgcgcggcgccgtgagggggattcggcccagctcgtcccggcctccaccaagccagccccgaagcccgccagccaccctgccggactcgggcgcgacctgctggcgcgcgccggatgtttctgtgacacacaatcagcgcggaccgcagcgcggcccagccccgggcacccgcctcggacgctcgggcgccaggaggcttcgctggaggggctgggccaaggagattaagaagaaaacgactttctgcaggaggaagagcccgctgccgaatccctgggaaaaattcttttcccccagtgccagccggactgccctcgccttccgggtgtgccctgtcccagaagatggaatgggggtgtgggggtccggctctaggaacgggctttgggggcgtcaggtctttccaaggttgggacccaaggatcggggggcccagcagcccgcaccgatcgagccggactctcggctcttcactgctcctcctggcctgcctagttccccagggcccggcacctcctgctgcgagacccggctctcagccctgccttgcccctacctcagcgtctcttccacctgctggcctcccagtttcccctcctgccagtccttcgcctgtcccttgacgccctgcatcctcctccctgactcgcagccccatcggacgctctcccgggaccgccgcaggaccagtttccatagactgcggactggggtcttcctccagcagttacttgatgccccctcccccgacacagactctcaatctgccggtggtaagaaccggttctgagctggcgtctgagctgctgcggggtggaagtggggggctgcccactccactcctcccatcccctcccagcctcctcctccggcaggaactgaacagaaccacaaaaagtctacatttatttaatatgatggtctttgcaaaaaggaacaaaacaacacaaaagcccaccaggctgctgctttgtggaaagacggtgtgtgtcgtgtgaaggcgaaacccggtgtacataacccctccccctccgccccgccccgcccggccccgtagagtccctgtcgcccgccggccctgcctgtagatacgccccgctgtctgtgctgtgagagtcgccgctcgctgggggggaagggggggacacagctacacgcccattaaagcacagcacgtcctgggggaggggggcattttttatgttacaaaaaaaaattacgaaagaaaagaaatctctatgcaaaatgacgaacatggtcctgtggactcctctggcctgttttgttggctctttctctgtaattccgtgttttcgctttttcctccctgcccctctctccctctgcccctctctcctctccgcttctctccccctctgtctctgtctctctccgtctctgtcgctcttgtctgtctgtctctgctctttcctcggcctctctccccagacctggcccggccgccctgtctccgcaggctagatccgaggtggcagctccagcccccgggctcgccccctcgcgggcgtgccccgcgcgccccgggcggccgaaggccgggccgccccgtcccgccccgtagttgctctttcggtagtggcgatgcgccctgcatgtctcctcacccgtggatcgtgacgactcgaaataacagaaacaaagtcaataaagtgaaaataaataaaaatccttgaacaaatccgaaaaggcttggagtcctcgcccagatctctctcccctgcgagccctttttatttgagaaggaaaaagagaaaagagaatcgtttaagggaacccggcgcccagccaggctccagtggcccgaacggggcggcgagggcggcgagggcgccgaggtccggcccatcccagtcctgtggggctggccgggcagagaccccggacccaggcccaggcctaacctgctaaatgtccccggacggttctggtctcctcggccactttcagtgcgtcggttcgttttgattctttttcttttgtgcacataagaaataaataataataataaataaagaataaaattttgtatgtca

SEQ ID NO: 21422 - DNA, 3516 bp, Homo sapiens
cgggggcctggcccgcgcgctcccctcccgcaggcgccacctcggacatccccgggattgctacttctctgccaacttcgccaactcgccagcacttggagaggcccggctcccctcccggcgccctctgaccgcccccgccccgcgcgctctccgaccaccgcctctcggatgaccaggttccaggggagctgagcgagtcgcctcccccgcccagcttcagccctggctgcagctgcagcgcgagccatgcgcccccagtgcaccccggcccggcccaccgccccggggccattctgctgaccgcccagccccgagccccgacagtggcaagttgcggctactgcagttgcaagctccggccaacccggaggagccccagcggggagcgcagtgctgcgccccccgcccccgcgcgccccgcagcagccgggcgttcactcatcctccctcccccaccgtccctcccttttctcctcaagtcctgaagttgagtttgagaggcgacacggcggcggcggccgcgctgctcccgctcctctgcctccccatggatatgcactgcaaagcagaccccttctccgcgatgcacccagggcacgggggtgtgaaccagctcgggggggtgtttgtgaacggccggcccctacccgacgtggtgaggcagcgcatcgtggagctggcccaccagggtgtgcggccctgtgacatctcccggcagctgcgggtcagccacggctgtgtcagcaaaatcctgggcaggtactacgagaccggcagcatcaagccgggtgtgatcggtggctccaagcccaaagtggcgacgcccaaagtggtggacaagattgctgaatacaaacgacagaacccgactatgttcgcctgggagattcgagaccggctcctggccgagggcatctgtgacaatgacacagtgcccagcgtctcttccatcaacagaatcatccggaccaaagttcagcagcctttccacccaacgccggatggggctgggacaggagtgaccgcccctggccacaccattgttcccagcacggcctcccctcctgtttccagcgcctccaatgacccagtgggatcctactccatcaatgggatcctggggattcctcgctccaatggtgagaagaggaaacgtgatgaagatgtgtctgagggctcagtccccaatggagattcccagagtggtgtggacagtttgcggaagcacttgcgagctgacaccttcacccagcagcagctggaagctttggatcgggtctttgagcgtccttcctaccctgacgtcttccaggcatcagagcacatcaaatcagaacaggggaacgagtactccctcccagccctgacccctgggcttgatgaagtcaagtcgagtctatctgcatccaccaaccctgagctgggcagcaacgtgtcaggcacacagacatacccagttgtgactggtcgtgacatggcgagcaccactctgcctggttacccccctcacgtgccccccactggccagggaagctaccccacctccaccctggcaggaatggtgcctgaggctgcagttggtccctcatcctccctcatgagcaagccggggaggaagcttgcagaagtgcccccttgtgtgcaacccactggagcgagttctccggcaacccgtacagccacccccagtacacggcctacaacgaggcttggagattcagcaaccccgccttactaagttccccttattattatagtgccgccccccggggctccgcccctgccgctgctgccgctgcctatgaccgccactagttaccgcggggaccacatcaagcttcaggccgacagcttcggcctccacatcgtccccgtctgaccccaccccggagggagggaggaccgacgcgacgcgatgcctcccggccaccgccccagcctcaccccatcccacgacccccgcaacccttcacatcacccccctcgaaggtcggacaggacgggtggagccgtgggcgggaccctcaggcccgggcccgccgcccccagccccgcctgccgcccctccccgcctgcctggactgcgcggcgccgtgagggggattcggcccagctcgtcccggcctccaccaagccagccccgaagcccgccagccaccctgccggactcgggcgcgacctgctggcgcgcgccggatgtttctgtgacacacaatcagcgcggaccgcagcgcggcccagccccgggcacccgcctcggacgctcgggcgccaggaggcttcgctggaggggctgggccaaggagattaagaagaaaacgactttctgcaggaggaagagcccgctgccgaatccctgggaaaaattcttttcccccagtgccagccggactgccctcgccttccgggtgtgccctgtcccagaagatggaatgggggtgtgggggtccggctctaggaacgggctttgggggcgtcaggtctttccaaggttgggacccaaggatcggggggcccagcagcccgcaccgatcgagccggactctcggctcttcactgctcctcctggcctgcctagttccccagggcccggcacctcctgctgcgagacccggctctcagccctgccttgcccctacctcagcgtctcttccacctgctggcctcccagtttcccctcctgccagtccttcgcctgtcccttgacgccctgcatcctcctccctgactcgcagccccatcggacgctctcccgggaccgccgcaggaccagtttccatagactgcggactggggtcttcctccagcagttacttgatgccccctcccccgacacagactctcaatctgccggtggtaagaaccggttctgagctggcgtctgagctgctgcggggtggaagtggggggctgcccactccactcctcccatcccctcccagcctcctcctccggcaggaactgaacagaaccacaaaaagtctacatttatttaatatgatggtctttgcaaaaaggaacaaaacaacacaaaagcccaccaggctgctgctttgtggaaagacggtgtgtgtcgtgtgaaggcgaaacccggtgtacataacccctccccctccgccccgccccgcccggccccgtagagtccctgtcgcccgccggccctgcctgtagatacgccccgctgtctgtgctgtgagagtcgccgctcgctgggggggaagggggggacacagctacacgcccattaaagcacagcacgtcctgggggaggggggcattttttatgttacaaaaaaaaattacgaaagaaaagaaatctctatgcaaaatgacgaacatggtcctgtggactcctctggcctgttttgttggctctttctctgtaattccgtgttttcgctttttcctccctgcccctctctccctctgcccctctctcctctccgcttctctccccctctgtctctgtctctctccgtctctgtcgctcttgtctgtctgtctctgctcttt

SEQ ID NO: 21423 - DNA, 4122 bp, Homo sapiens
cgggggcctggcccgcgcgctcccctcccgcaggcgccacctcggacatccccgggattgctacttctctgccaacttcgccaactcgccagcacttggagaggcccggctcccctcccggcgccctctgaccgcccccgccccgcgcgctctccgaccaccgcctctcggatgaccaggttccaggggagctgagcgagtcgcctcccccgcccagcttcagccctggctgcagctgcagcgcgagccatgcgcccccagtgcaccccggcccggcccaccgccccggggccattctgctgaccgcccagccccgagccccgacagtggcaagttgcggctactgcagttgcaagctccggccaacccggaggagccccagcggggagcgcagtgctgcgccccccgcccccgcgcgccccgcagcagccgggcgttcactcatcctccctcccccaccgtccctcccttttctcctcaagtcctgaagttgagtttgagaggcgacacggcggcggcggccgcgctgctcccgctcctctgcctccccatggatatgcactgcaaagcagaccccttctccgcgatgcacccagggcacgggggtgtgaaccagctcgggggggtgtttgtgaacggccggcccctacccgacgtggtgaggcagcgcatcgtggagctggcccaccagggtgtgcggccctgtgacatctcccggcagctgcgggtcagccacggctgtgtcagcaaaatcctgggcaggtactacgagaccggcagcatcaagccgggtgtgatcggtggctccaagcccaaagtggcgacgcccaaagtggtggacaagattgctgaatacaaacgacagaacccgactatgttcgcctgggagattcgagaccggctcctggccgagggcatctgtgacaatgacacagtgcccagcgtctcttccatcaacagaatcatccggaccaaagttcagcagcctttccacccaacgccggatggggctgggacaggagtgaccgcccctggccacaccattgttcccagcacggcctcccctcctgtttccagcgcctccaatgacccagtgggatcctactccatcaatgggatcctggggattcctcgctccaatggtgagaagaggaaacgtgatgaagttgaggtatacactgatcctgcccacattagaggaggtggaggtttgcatctggtctggactttaagagatgtgtctgagggctcagtccccaatggagattcccagagtggtgtggacagtttgcggaagcacttgcgagctgacaccttcacccagcagcagctggaagctttggatcgggtctttgagcgtccttcctaccctgacgtcttccaggcatcagagcacatcaaatcagaacaggggaacgagtactccctcccagccctgacccctgggcttgatgaagtcaagtcgagtctatctgcatccaccaaccctgagctgggcagcaacgtgtcaggcacacagacatacccagttgtgactggtcgtgacatggcgagcaccactctgcctggttacccccctcacgtgccccccactggccagggaagctaccccacctccaccctggcaggaatggtgcctggtagcgagttctccggcaacccgtacagccacccccagtacacggcctacaacgaggcttggagattcagcaaccccgccttactaagttccccttattattatagtgccgccccccggggctccctgccgctgctgccgctgcctatgaccgccactagttaccgcggggaccacatcaagcttcaggccgacagcttcggcctccacatcgtccccgtctgaccccaccccggagggagggaggaccgacgcgacgcgatgcctcccggccaccgccccagcctcaccccatcccacgacccccgcaacccttcacatcacccccctcgaaggtcggacaggacgggtggagccgtgggcgggaccctcaggcccgggcccgccgcccccagccccgcctgccgcccctccccgcctgcctggactgcgcggcgccgtgagggggattcggcccagctcgtcccggcctccaccaagccagccccgaagcccgccagccaccctgccggactcgggcgcgacctgctggcgcgcgccggatgtttctgtgacacacaatcagcgcggaccgcagcgcggcccagccccgggcacccgcctcggacgctcgggcgccaggaggcttcgctggaggggctgggccaaggagattaagaagaaaacgactttctgcaggaggaagagcccgctgccgaatccctgggaaaaattcttttcccccagtgccagccggactgccctcgccttccgggtgtgccctgtcccagaagatggaatgggggtgtgggggtccggctctaggaacgggctttgggggcgtcaggtctttccaaggttgggacccaaggatcggggggcccagcagcccgcaccgatcgagccggactctcggctcttcactgctcctcctggcctgcctagttccccagggcccggcacctcctgctgcgagacccggctctcagccctgccttgcccctacctcagcgtctcttccacctgctggcctcccagtttcccctcctgccagtccttcgcctgtcccttgacgccctgcatcctcctccctgactcgcagccccatcggacgctctcccgggaccgccgcaggaccagtttccatagactgcggactggggtcttcctccagcagttacttgatgccccctcccccgacacagactctcaatctgccggtggtaagaaccggttctgagctggcgtctgagctgctgcggggtggaagtggggggctgcccactccactcctcccatcccctcccagcctcctcctccggcaggaactgaacagaaccacaaaaagtctacatttatttaatatgatggtctttgcaaaaaggaacaaaacaacacaaaagcccaccaggctgctgctttgtggaaagacggtgtgtgtcgtgtgaaggcgaaacccggtgtacataacccctccccctccgccccgccccgcccggccccgtagagtccctgtcgcccgccggccctgcctgtagatacgccccgctgtctgtgctgtgagagtcgccgctcgctgggggggaagggggggacacagctacacgcccattaaagcacagcacgtcctgggggaggggggcattttttatgttacaaaaaaaaattacgaaagaaaagaaatctctatgcaaaatgacgaacatggtcctgtggactcctctggcctgttttgttggctctttctctgtaattccgtgttttcgctttttcctccctgcccctctctccctctgcccctctctcctctccgcttctctccccctctgtctctgtctctctccgtctctgtcgctcttgtctgtctgtctctgctctttcctcggcctctctccccagacctggcccggccgccctgtctccgcaggctagatccgaggtggcagctccagcccccgggctcgccccctcgcgggcgtgccccgcgcgccccgggcggccgaaggccgggccgccccgtcccgccccgtagttgctctttcggtagtggcgatgcgccctgcatgtctcctcacccgtggatcgtgacgactcgaaataacagaaacaaagtcaataaagtgaaaataaataaaaatccttgaacaaatccgaaaaggcttggagtcctcgcccagatctctctcccctgcgagccctttttatttgagaaggaaaaagagaaaagagaatcgtttaagggaacccggcgcccagccaggctccagtggcccgaacggggcggcgagggcggcgagggcgccgaggtccggcccatcccagtcctgtggggctggccgggcagagaccccggacccaggcccaggcctaacctgctaaatgtccccggacggttctggtctcctcggccactttcagtgcgtcggttcgttttgattctttttcttttgtgcacataagaaataaataataataataaataaagaataaaattttgtatgtca

SEQ ID NO: 21424 - DNA, 4209 bp, Homo sapiens
cgggggcctggcccgcgcgctcccctcccgcaggcgccacctcggacatccccgggattgctacttctctgccaacttcgccaactcgccagcacttggagaggcccggctcccctcccggcgccctctgaccgcccccgccccgcgcgctctccgaccaccgcctctcggatgaccaggttccaggggagctgagcgagtcgcctcccccgcccagcttcagccctggctgcagctgcagcgcgagccatgcgcccccagtgcaccccggcccggcccaccgccccggggccattctgctgaccgcccagccccgagccccgacagtggcaagttgcggctactgcagttgcaagctccggccaacccggaggagccccagcggggagcgcagtgctgcgccccccgcccccgcgcgccccgcagcagccgggcgttcactcatcctccctcccccaccgtccctcccttttctcctcaagtcctgaagttgagtttgagaggcgacacggcggcggcggccgcgctgctcccgctcctctgcctccccatggatatgcactgcaaagcagaccccttctccgcgatgcacccagggcacgggggtgtgaaccagctcgggggggtgtttgtgaacggccggcccctacccgacgtggtgaggcagcgcatcgtggagctggcccaccagggtgtgcggccctgtgacatctcccggcagctgcgggtcagccacggctgtgtcagcaaaatcctgggcaggtactacgagaccggcagcatcaagccgggtgtgatcggtggctccaagcccaaagtggcgacgcccaaagtggtggacaagattgctgaatacaaacgacagaacccgactatgttcgcctgggagattcgagaccggctcctggccgagggcatctgtgacaatgacacagtgcccagcgtctcttccatcaacagaatcatccggaccaaagttcagcagcctttccacccaacgccggatggggctgggacaggagtgaccgcccctggccacaccattgttcccagcacggcctcccctcctgtttccagcgcctccaatgacccagtgggatcctactccatcaatgggatcctggggattcctcgctccaatggtgagaagaggaaacgtgatgaagttgaggtatacactgatcctgcccacattagaggaggtggaggtttgcatctggtctggactttaagagatgtgtctgagggctcagtccccaatggagattcccagagtggtgtggacagtttgcggaagcacttgcgagctgacaccttcacccagcagcagctggaagctttggatcgggtctttgagcgtccttcctaccctgacgtcttccaggcatcagagcacatcaaatcagaacaggggaacgagtactccctcccagccctgacccctgggcttgatgaagtcaagtcgagtctatctgcatccaccaaccctgagctgggcagcaacgtgtcaggcacacagacatacccagttgtgactggtcgtgacatggcgagcaccactctgcctggttacccccctcacgtgccccccactggccagggaagctaccccacctccaccctggcaggaatggtgcctgaggctgcagttggtccctcatcctccctcatgagcaagccggggaggaagcttgcagaagtgcccccttgtgtgcaacccactggagcgagttctccggcaacccgtacagccacccccagtacacggcctacaacgaggcttggagattcagcaaccccgccttactaagttccccttattattatagtgccgccccccggggctccgcccctgccgctgctgccgctgcctatgaccgccactagttaccgcggggaccacatcaagcttcaggccgacagcttcggcctccacatcgtccccgtctgaccccaccccggagggagggaggaccgacgcgacgcgatgcctcccggccaccgccccagcctcaccccatcccacgacccccgcaacccttcacatcacccccctcgaaggtcggacaggacgggtggagccgtgggcgggaccctcaggcccgggcccgccgcccccagccccgcctgccgcccctccccgcctgcctggactgcgcggcgccgtgagggggattcggcccagctcgtcccggcctccaccaagccagccccgaagcccgccagccaccctgccggactcgggcgcgacctgctggcgcgcgccggatgtttctgtgacacacaatcagcgcggaccgcagcgcggcccagccccgggcacccgcctcggacgctcgggcgccaggaggcttcgctggaggggctgggccaaggagattaagaagaaaacgactttctgcaggaggaagagcccgctgccgaatccctgggaaaaattcttttcccccagtgccagccggactgccctcgccttccgggtgtgccctgtcccagaagatggaatgggggtgtgggggtccggctctaggaacgggctttgggggcgtcaggtctttccaaggttgggacccaaggatcggggggcccagcagcccgcaccgatcgagccggactctcggctcttcactgctcctcctggcctgcctagttccccagggcccggcacctcctgctgcgagacccggctctcagccctgccttgcccctacctcagcgtctcttccacctgctggcctcccagtttcccctcctgccagtccttcgcctgtcccttgacgccctgcatcctcctccctgactcgcagccccatcggacgctctcccgggaccgccgcaggaccagtttccatagactgcggactggggtcttcctccagcagttacttgatgccccctcccccgacacagactctcaatctgccggtggtaagaaccggttctgagctggcgtctgagctgctgcggggtggaagtggggggctgcccactccactcctcccatcccctcccagcctcctcctccggcaggaactgaacagaaccacaaaaagtctacatttatttaatatgatggtctttgcaaaaaggaacaaaacaacacaaaagcccaccaggctgctgctttgtggaaagacggtgtgtgtcgtgtgaaggcgaaacccggtgtacataacccctccccctccgccccgccccgcccggccccgtagagtccctgtcgcccgccggccctgcctgtagatacgccccgctgtctgtgctgtgagagtcgccgctcgctgggggggaagggggggacacagctacacgcccattaaagcacagcacgtcctgggggaggggggcattttttatgttacaaaaaaaaattacgaaagaaaagaaatctctatgcaaaatgacgaacatggtcctgtggactcctctggcctgttttgttggctctttctctgtaattccgtgttttcgctttttcctccctgcccctctctccctctgcccctctctcctctccgcttctctccccctctgtctctgtctctctccgtctctgtcgctcttgtctgtctgtctctgctctttcctcggcctctctccccagacctggcccggccgccctgtctccgcaggctagatccgaggtggcagctccagcccccgggctcgccccctcgcgggcgtgccccgcgcgccccgggcggccgaaggccgggccgccccgtcccgccccgtagttgctctttcggtagtggcgatgcgccctgcatgtctcctcacccgtggatcgtgacgactcgaaataacagaaacaaagtcaataaagtgaaaataaataaaaatccttgaacaaatccgaaaaggcttggagtcctcgcccagatctctctcccctgcgagccctttttatttgagaaggaaaaagagaaaagagaatcgtttaagggaacccggcgcccagccaggctccagtggcccgaacggggcggcgagggcggcgagggcgccgaggtccggcccatcccagtcctgtggggctggccgggcagagaccccggacccaggcccaggcctaacctgctaaatgtccccggacggttctggtctcctcggccactttcagtgcgtcggttcgttttgattctttttcttttgtgcacataagaaataaataataataataaataaagaataaaattttgtatgtca

SEQ ID NO: 21425 - DNA, 677 bp, Homo sapiens
gcggccgcgctgctcccgctcctctgcctccccatggatatgcactgcaaagcagaccccttctccgcgatgcacccagggcacgggggtgtgaaccagctcgggggggtgtttgtgaacggccggcccctacccgacgtggtgaggcagcgcatcgtggagctggcccaccagggtgtgcggccctgtgacatctcccggcagctgcgggtcagccacggctgtgtcagcaaaatcctgggcaggtactacgagaccggcagcatcaagccgggtgtgatcggtggctccaagcccaaagtggcgacgcccaaagtggtggacaagattgctgaatacaaacgacagaacccgactatgttcgcctgggagattcgagaccggctcctggccgagggcatctgtgacaatgacacagtgcccagcgtctcttccatcaacagaatcatccggaccaaagttcagcagcctttccacccaacgccggatggggctgggacaggagtgaccgcccctggccacaccattgttcccagcacggcctcccctcctgtttccagcgcctccaatgacccagtgggatcctactccatcaatgggatcctggggattcctcgctccaatggtgagaagaggaaacgtgatgaagttgaggtatacactgatcctgcccacat

SEQ ID NO: 21426 - DNA, 4126 bp, Homo sapiens
cgggggcctggcccgcgcgctcccctcccgcaggcgccacctcggacatccccgggattgctacttctctgccaacttcgccaactcgccagcacttggagaggcccggctcccctcccggcgccctctgaccgcccccgccccgcgcgctctccgaccaccgcctctcggatgaccaggttccaggggagctgagcgagtcgcctcccccgcccagcttcagccctggctgcagctgcagcgcgagccatgcgcccccagtgcaccccggcccggcccaccgccccggggccattctgctgaccgcccagccccgagccccgacagtggcaagttgcggctactgcagttgcaagctccggccaacccggaggagccccagcggggagcgcagtgctgcgccccccgcccccgcgcgccccgcagcagccgggcgttcactcatcctccctcccccaccgtccctcccttttctcctcaagtcctgaagttgagtttgagaggcgacacggcggcggcggccgcgctgctcccgctcctctgcctccccatggatatgcactgcaaagcagaccccttctccgcgatgcacccagggcacgggggtgtgaaccagctcgggggggtgtttgtgaacggccggcccctacccgacgtggtgaggcagcgcatcgtggagctggcccaccagggtgtgcggccctgtgacatctcccggcagctgcgggtcagccacggctgtgtcagcaaaatcctgggcaggtactacgagaccggcagcatcaagccgggtgtgatcggtggctccaagcccaaagtggcgacgcccaaagtggtggacaagattgctgaatacaaacgacagaacccgactatgttcgcctgggagattcgagaccggctcctggccgagggcatctgtgacaatgacacagtgcccagcgtctcttccatcaacagaatcatccggaccaaagttcagcagcctttccacccaacgccggatggggctgggacaggagtgaccgcccctggccacaccattgttcccagcacggcctcccctcctgtttccagcgcctccaatgacccagtgggatcctactccatcaatgggatcctggggattcctcgctccaatggtgagaagaggaaacgtgatgaagttgaggtatacactgatcctgcccacattagaggaggtggaggtttgcatctggtctggactttaagagatgtgtctgagggctcagtccccaatggagattcccagagtggtgtggacagtttgcggaagcacttgcgagctgacaccttcacccagcagcagctggaagctttggatcgggtctttgagcgtccttcctaccctgacgtcttccaggcatcagagcacatcaaatcagaacaggggaacgagtactccctcccagccctgacccctgggcttgatgaagtcaagtcgagtctatctgcatccaccaaccctgagctgggcagcaacgtgtcaggcacacagacatacccagttgtgactggtcgtgacatggcgagcaccactctgcctggttacccccctcacgtgccccccactggccagggaagctaccccacctccaccctggcaggaatggtgcctgggagcgagttctccggcaacccgtacagccacccccagtacacggcctacaacgaggcttggagattcagcaaccccgccttactaagttccccttattattatagtgccgccccccggggctccgcccctgccgctgctgccgctgcctatgaccgccactagttaccgcggggaccacatcaagcttcaggccgacagcttcggcctccacatcgtccccgtctgaccccaccccggagggagggaggaccgacgcgacgcgatgcctcccggccaccgccccagcctcaccccatcccacgacccccgcaacccttcacatcacccccctcgaaggtcggacaggacgggtggagccgtgggcgggaccctcaggcccgggcccgccgcccccagccccgcctgccgcccctccccgcctgcctggactgcgcggcgccgtgagggggattcggcccagctcgtcccggcctccaccaagccagccccgaagcccgccagccaccctgccggactcgggcgcgacctgctggcgcgcgccggatgtttctgtgacacacaatcagcgcggaccgcagcgcggcccagccccgggcacccgcctcggacgctcgggcgccaggaggcttcgctggaggggctgggccaaggagattaagaagaaaacgactttctgcaggaggaagagcccgctgccgaatccctgggaaaaattcttttcccccagtgccagccggactgccctcgccttccgggtgtgccctgtcccagaagatggaatgggggtgtgggggtccggctctaggaacgggctttgggggcgtcaggtctttccaaggttgggacccaaggatcggggggcccagcagcccgcaccgatcgagccggactctcggctcttcactgctcctcctggcctgcctagttccccagggcccggcacctcctgctgcgagacccggctctcagccctgccttgcccctacctcagcgtctcttccacctgctggcctcccagtttcccctcctgccagtccttcgcctgtcccttgacgccctgcatcctcctccctgactcgcagccccatcggacgctctcccgggaccgccgcaggaccagtttccatagactgcggactggggtcttcctccagcagttacttgatgccccctcccccgacacagactctcaatctgccggtggtaagaaccggttctgagctggcgtctgagctgctgcggggtggaagtggggggctgcccactccactcctcccatcccctcccagcctcctcctccggcaggaactgaacagaaccacaaaaagtctacatttatttaatatgatggtctttgcaaaaaggaacaaaacaacacaaaagcccaccaggctgctgctttgtggaaagacggtgtgtgtcgtgtgaaggcgaaacccggtgtacataacccctccccctccgccccgccccgcccggccccgtagagtccctgtcgcccgccggccctgcctgtagatacgccccgctgtctgtgctgtgagagtcgccgctcgctgggggggaagggggggacacagctacacgcccattaaagcacagcacgtcctgggggaggggggcattttttatgttacaaaaaaaaattacgaaagaaaagaaatctctatgcaaaatgacgaacatggtcctgtggactcctctggcctgttttgttggctctttctctgtaattccgtgttttcgctttttcctccctgcccctctctccctctgcccctctctcctctccgcttctctccccctctgtctctgtctctctccgtctctgtcgctcttgtctgtctgtctctgctctttcctcggcctctctccccagacctggcccggccgccctgtctccgcaggctagatccgaggtggcagctccagcccccgggctcgccccctcgcgggcgtgccccgcgcgccccgggcggccgaaggccgggccgccccgtcccgccccgtagttgctctttcggtagtggcgatgcgccctgcatgtctcctcacccgtggatcgtgacgactcgaaataacagaaacaaagtcaataaagtgaaaataaataaaaatccttgaacaaatccgaaaaggcttggagtcctcgcccagatctctctcccctgcgagccctttttatttgagaaggaaaaagagaaaagagaatcgtttaagggaacccggcgcccagccaggctccagtggcccgaacggggcggcgagggcggcgagggcgccgaggtccggcccatcccagtcctgtggggctggccgggcagagaccccggacccaggcccaggcctaacctgctaaatgtccccggacggttctggtctcctcggccactttcagtgcgtcggttcgttttgattctttttcttttgtgcacataagaaataaataataataataaataaagaataaaattttgtatgtca

SEQ ID NO: 21427 - DNA, 958 bp, Homo sapiens
caaacttttccgccctgggctcgggatcctggactccggggcctccccgtcctcccctttcccgggttccagctccggcctctggactaggaaccgacagcccccctccccgcgtccctccctctctctccagccgttttggggaggggctctccacgctccggatagttcccgagggtcatccgcgccgcactcgcctttccgtttcgccttcacctggatataatttccgagcgaagctgcccccaggatgaccacgctggccggcgctgtgcccaggatgatgcggccgggcccggggcagaactacccgcgtagcgggttcccgctggaagtgtccactcccctcggccagggccgcgtcaaccagctcggcggtgtttttatcaacggcaggccgctgcccaaccacatccgccacaagatcgtggagatggcccaccacggcatccggccctgcgtcatctcgcgccagctgcgcgtgtcccacggctgcgtctccaagatcctgtgcaggtaccaggagactggctccatacgtcctggtgccatcggcggcagcaagcccaagcaggtgacaacgcctgacgtggagaagaaaattgaggaatacaaaagagagaacccgggcatgttcagctgggaaatccgagacaaattactcaaggacgcggtctgtgatcgaaacaccgtgccgtcagtgagttccatcagccgcatcctgagaagtaaattcgggaaaggtgaagaggaggaggccgacttggagaggaaggaggcagaggaaagcgagaagaaggccaaacacagcatcgacggcatcctgagcgagcgaggaaaggccctggtctccggagtttcctcgcattaaaggagagagagagagagtactcttttgggcaacggccctccaaaattgcccccacattggctgccttataaatatgtctgtgtgttg

SEQ ID NO: 21428 - DNA, 1715 bp, Homo sapiens
actcggtgtcaccacaggaggagactcaggcaggccgcgctccagcctcaccaggctccccggctcgccgtggctctctgagcccccttttcagggaccccagtcgctggaacatttgcccagactcgtaccaaacttttccgccctgggctcgggatcctggactccggggcctccccgtcctcccctttcccgggttccagctccggcctctggactaggaaccgacagcccccctccccgcgtccctccctctctctccagccgttttggggaggggctctccacgctccggatagttcccgagggtcatccgcgccgcactcgcctttccgtttcgccttcacctggatataatttccgagcgaagctgcccccaggatgaccacgctggccggcgctgtgcccaggatgatgcggccgggcccggggcagaactacccgcgtagcgggttcccgctggaagtgtccactcccctcggccagggccgcgtcaaccagctcggcggtgtttttatcaacggcaggccgctgcccaaccacatccgccacaagatcgtggagatggcccaccacggcatccggccctgcgtcatctcgcgccagctgcgcgtgtcccacggctgcgtctccaagatcctgtgcaggtaccaggagactggctccatacgtcctggtgccatcggcggcagcaagcccaagcaggtgacaacgcctgacgtggagaagaaaattgaggaatacaaaagagagaacccgggcatgttcagctgggaaatccgagacaaattactcaaggacgcggtctgtgatcgaaacaccgtgccgtcagtgagttccatcagccgcatcctgagaagtaaattcgggaaaggtgaagaggaggaggccgacttggagaggaaggaggcagaggaaagcgagaagaaggccaaacacagcatcgacggcatcctgagcgagcgagcctcagcaccccaatcagatgaaggctctgatattgactctgaaccagatttaccactaaagaggaaacagcgcagaagccgaaccaccttcacagcagaacagctggaggaactggagcgtgcttttgagagaactcattaccctgacatttatactagggaggaactggcccagagggcgaagctcaccgaggcccgagtacaggtctggtttagcaaccgccgtgcaagatggaggaagcaagctggggccaatcaactgatggctttcaaccatctcattcccggggggttccctcccactgccatgccgaccttgccaacgtaccagctgtcggagacctcttaccagcccacatctattccacaagctgtgtcagatcccagcagcaccgttcacagacctcaaccgcttcctccaagcactgtacaccaaagcacgattccttccaacccagacagcagctctgcctactgcctccccagcaccaggcatggattttccagctatacagacagctttgtgcctccgtcggggccctccaaccccatgaaccccaccattggcaatggcctctcacctcaggtgcctttcattatctcaagccagatatcgcttggtttcaaatccttttgaacacgttcgacaaaagcagtggagaagaggaagacctggagcaataaaagacaaatgcaacattttaaggcaatggtttcacatggttacatatcaaaacatcccaattc

SEQ ID NO: 21429 - DNA, 3109 bp, Homo sapiens
actcggtgtcaccacaggaggagactcaggcaggccgcgctccagcctcaccaggctccccggctcgccgtggctctctgagcccccttttcagggaccccagtcgctggaacatttgcccagactcgtaccaaacttttccgccctgggctcgggatcctggactccggggcctccccgtcctcccctttcccgggttccagctccggcctctggactaggaaccgacagcccccctccccgcgtccctccctctctctccagccgttttggggaggggctctccacgctccggatagttcccgagggtcatccgcgccgcactcgcctttccgtttcgccttcacctggatataatttccgagcgaagctgcccccaggatgaccacgctggccggcgctgtgcccaggatgatgcggccgggcccggggcagaactacccgcgtagcgggttcccgctggaagtgtccactcccctcggccagggccgcgtcaaccagctcggcggtgtttttatcaacggcaggccgctgcccaaccacatccgccacaagatcgtggagatggcccaccacggcatccggccctgcgtcatctcgcgccagctgcgcgtgtcccacggctgcgtctccaagatcctgtgcaggtaccaggagactggctccatacgtcctggtgccatcggcggcagcaagcccaagcaggtgacaacgcctgacgtggagaagaaaattgaggaatacaaaagagagaacccgggcatgttcagctgggaaatccgagacaaattactcaaggacgcggtctgtgatcgaaacaccgtgccgtcagtgagttccatcagccgcatcctgagaagtaaattcgggaaaggtgaagaggaggaggccgacttggagaggaaggaggcagaggaaagcgagaagaaggccaaacacagcatcgacggcatcctgagcgagcgagcctcagcaccccaatcagatgaaggctctgatattgactctgaaccagatttaccactaaagaggaaacagcgcagaagccgaaccaccttcacagcagaacagctggaggaactggagcgtgcttttgagagaactcattaccctgacatttatactagggaggaactggcccagagggcgaagctcaccgaggcccgagtacaggtctggtttagcaaccgccgtgcaagatggaggaagcaagctggggccaatcaactgatggctttcaaccatctcattcccggggggttccctcccactgccatgccgaccttgccaacgtaccagctgtcggagacctcttaccagcccacatctattccacaagctgtgtcagatcccagcagcaccgttcacagacctcaaccgcttcctccaagcactgtacaccaaagcacgattccttccaacccagacagcagctctgcctactgcctccccagcaccaggcatggattttccagctatacagacagctttgtgcctccgtcggggccctccaaccccatgaaccccaccattggcaatggcctctcacctcaggtgcctttcattatctcaagccagatatcgcgtaagtgaactgtccacttggagctaaaactggccctgtttctggtcttcgcagcctagatatgaagaatctgctctgaaaacaaaaaaaaattacccttttgttggggggggtggggcagtggtcccaataggagacaaaggagagtgattgattttcttcctccaatagttggtttcaaatccttttgaacacgttcgacaaaagcagtggagaagaggaagacctggagcaataaaagacaaatgcaacattttaaggcaatggtttcacatggttacatatcaaaacatcccaattctttagtgctgatcatcgaggagctagaacattccatttgcttgtgtgcgtgcgtgcgtgtgtgtgtgtgtgtgtgtattgagatttacccagactggtttgggcaagcagactgttctaaaatataatagaataccctaaagtataacatgtcgatgttcgatgctgatacttctacaactttaaaactgctcatttcatgaagcaagaatggaggaatccttgactcttacacactggaaattgaaataaagataaatgcaaccatttttaggaagctagactagctgtaaaggacctcctaaataaattatttgttactgtatcctcatttgtaatctagttgtcaataaatggcccggacatgtcttgctaacaggatatgggctaccaggaagaaggacttgtttccctttcctgtgtggggagaggtgtgtgacgtttttccagttcacatttatttggtagcccacctgggttggaggaagggcacggtggagagaaagtgacatgcattcacatatctgcttatcagtgtgcaatactgtgtacctcatggatgctttggcaatgcccaaggcgatataagcaaaatcagaagtatatttttgcaggtgcttttattttcacagcccataattcatagtgatagagtgcagtgatgtttgccatttgctggacaaccaacacccgggttgctcctttgattagagaccagatcagataattatgcttttaaactgattacgtttacattcttctcttttctatgaaaggcagggcaagaacagaagtgttcacatggctctcatgtacttttaaattatacaatgatatccaatattaaaagattataggaactgaggtttacatacgtttgtgtggtgacattttagaatgtcaataaatttgctttttgagatgttgagaggaacaagaaggtggaaggcagtgttatttatttctttctattcttggaaccacgaatgaggtaggcacaaatacattccttttagagttaagaactatgacgtagcgagttagtgagactagacatagtaccgaatttagttcatgcattggtcttagagggtgatggaacaagagaagtactatctttgtgttgcagcctcaaccaacaacaatgtgttgtaaaaatgtctttcatgtaaaaagtgcagtaaatatttactatttataatgaataaacagttatgaaaactt

SEQ ID NO: 21430 - DNA, 3610 bp, Homo sapiens
gtccctccctctctctccagccgttttggggaggggctctccacgctccggatagttcccgagggtcatccgcgccgcactcgcctttccgtttcgccttcacctggatataatttccgagcgaagctgcccccaggatgaccacgctggccggcgctgtgcccaggatgatgcggccgggcccggggcagaactacccgcgtagcgggttcccgctggaagtgtccactcccctcggccagggccgcgtcaaccagctcggcggtgtttttatcaacggcaggccgctgcccaaccacatccgccacaagatcgtggagatggcccaccacggcatccggccctgcgtcatctcgcgccagctgcgcgtgtcccacggctgcgtctccaagatcctgtgcaggtaccaggagactggctccatacgtcctggtgccatcggcggcagcaagcccaagcaggtgacaacgcctgacgtggagaagaaaattgaggaatacaaaagagagaacccgggcatgttcagctgggaaatccgagacaaattactcaaggacgcggtctgtgatcgaaacaccgtgccgtcagtgagttccatcagccgcatcctgagaagtaaattcgggaaaggtgaagaggaggaggccgacttggagaggaaggaggcagaggaaagcgagaagaaggccaaacacagcatcgacggcatcctgagcgagcgagcctcagcaccccaatcagatgaaggctctgatattgactctgaaccagatttaccactaaagaggaaacagcgcagaagccgaaccaccttcacagcagaacagctggaggaactggagcgtgcttttgagagaactcattaccctgacatttatactagggaggaactggcccagagggcgaagctcaccgaggcccgagtacaggtctggtttagcaaccgccgtgcaagatggaggaagcaagctggggccaatcaactgatggctttcaaccatctcattcccggggggttccctcccactgccatgccgaccttgccaacgtaccagctgtcggagacctcttaccagcccacatctattccacaagctgtgtcagatcccagcagcaccgttcacagacctcaaccgcttcctccaagcactgtacaccaaagcacgattccttccaacccagacagcagctctgcctactgcctccccagcaccaggcatggattttccagctatacagacagctttgtgcctccgtcggggccctccaaccccatgaaccccaccattggcaatggcctctcacctcaggtaatgggactcctgaccaaccacggtggggtacctcatcagccccagactgattacgcgctctcccctctcaccgggggtctggaacctaccaccacggtgtcggccagctgcagtcagagactagaccatatgaagagcttggacagtctgccaacatctcagtcctactgtccacccacctatagcaccacaggctacagtatggaccctgtcacaggctaccaatatgggcagtatggacaaagtaagccttggactttttagggggcaatttctcctggaagggagataaactcaactcttccttaagaaaggtgaattagaggcaagattaagccacacatgccggtatcaatttttttttttttttgcaaagccagctgactgttccagcaggggcttccttgtgtaattattttcttaactgatgtcaacaacatcttgcggttattaattgttgagacgtgaaacctgattgccactaggtaaaacacaagggttggccaaaatgaaataatccctgacattagaaacacatgttcttaatgaggtcagctccaggatcatatgggggataatcccagggacacaaagttgtgtcaaacttgtctcaggaataaaaatattagtctcaagcctttgatagcacggtattaaatatgacattgtcagcctgtagctgatcttgcccctgactgtgaattgtcccagcatgacctaaaaagctgcgtgtgtttccttacaggtgcctttcattatctcaagccagatatcgcgtaagtgaactgtccacttggagctaaaactggccctgtttctggtcttcgcagcctagatatgaagaatctgctctgaaaacaaaaaaaaattacccttttgttggggggggtggggcagtggtcccaataggagacaaaggagagtgattgattttcttcctccaatagttggtttcaaatccttttgaacacgttcgacaaaagcagtggagaagaggaagacctggagcaataaaagacaaatgcaacattttaaggcaatggtttcacatggttacatatcaaaacatcccaattctttagtgctgatcatcgaggagctagaacattccatttgcttgtgtgcgtgcgtgcgtgtgtgtgtgtgtgtgtgtattgagatttacccagactggtttgggcaagcagactgttctaaaatataatagaataccctaaagtataacatgtcgatgttcgatgctgatacttctacaactttaaaactgctcatttcatgaagcaagaatggaggaatccttgactcttacacactggaaattgaaataaagataaatgcaaccatttttaggaagctagactagctgtaaaggacctcctaaataaattatttgttactgtatcctcatttgtaatctagttgtcaataaatggcccggacatgtcttgctaacaggatatgggctaccaggaagaaggacttgtttccctttcctgtgtggggagaggtgtgtgacgtttttccagttcacatttatttggtagcccacctgggttggaggaagggcacggtggagagaaagtgacatgcattcacatatctgcttatcagtgtgcaatactgtgtacctcatggatgctttggcaatgcccaaggcgatataagcaaaatcagaagtatatttttgcaggtgcttttattttcacagcccataattcatagtgatagagtgcagtgatgtttgccatttgctggacaaccaacacccgggttgctcctttgattagagaccagatcagataattatgcttttaaactgattacgtttacattcttctcttttctatgaaaggcagggcaagaacagaagtgttcacatggctctcatgtacttttaaattatacaatgatatccaatattaaaagattataggaactgaggtttacatacgtttgtgtggtgacattttagaatgtcaataaatttgctttttgagatgttgagaggaacaagaaggtggaaggcagtgttatttatttctttctattcttggaaccacgaatgaggtaggcacaaatacattccttttagagttaagaactatgacgtagcgagttagtgagactagacatagtaccgaatttagttcatgcattggtcttagagggtgatggaacaagagaagtactatctttgtgttgcagcctcaaccaacaacaatgtgttgtaaaaatgtctttcatgtaaaaagtgcagtaaatatttactatttataatgaataaacagttatgaaaa

SEQ ID NO: 21431 - DNA, 3170 bp, Homo sapiens
aggaggagactcaggcaggccgcgctccagcctcaccaggctccccggctcgccgtggctctctgagcccccttttcagggaccccagtcgctggaacatttgcccagactcgtaccaaacttttccgccctgggctcgggatcctggactccggggcctccccgtcctcccctttcccgggttccagctccggcctctggactaggaaccgacagcccccctccccgcgtccctccctctctctccagccgttttggggaggggctctccacgctccggatagttcccgagggtcatccgcgccgcactcgcctttccgtttcgccttcacctggatataatttccgagcgaagctgcccccaggatgaccacgctggccggcgctgtgcccaggatgatgcggccgggcccggggcagaactacccgcgtagcgggttcccgctggaagtgtccactcccctcggccagggccgcgtcaaccagctcggcggtgtttttatcaacggcaggccgctgcccaaccacatccgccacaagatcgtggagatggcccaccacggcatccggccctgcgtcatctcgcgccagctgcgcgtgtcccacggctgcgtctccaagatcctgtgcaggtaccaggagactggctccatacgtcctggtgccatcggcggcagcaagcccaagcaggtgacaacgcctgacgtggagaagaaaattgaggaatacaaaagagagaacccgggcatgttcagctgggaaatccgagacaaattactcaaggacgcggtctgtgatcgaaacaccgtgccgtcagtgagttccatcagccgcatcctgagaagtaaattcgggaaaggtgaagaggaggaggccgacttggagaggaaggaggcagaggaaagcgagaagaaggccaaacacagcatcgacggcatcctgagcgagcgagcctcagcaccccaatcagatgaaggctctgatattgactctgaaccagatttaccactaaagaggaaacagcgcagaagccgaaccaccttcacagcagaacagctggaggaactggagcgtgcttttgagagaactcattaccctgacatttatactagggaggaactggcccagagggcgaagctcaccgaggcccgagtacaggtctggtttagcaaccgccgtgcaagatggaggaagcaagctggggccaatcaactgatggctttcaaccatctcattcccggggggttccctcccactgccatgccgaccttgccaacgtaccagctgtcggagacctcttaccagcccacatctattccacaagctgtgtcagatcccagcagcaccgttcacagacctcaaccgcttcctccaagcactgtacaccaaagcacgattccttccaacccagacagcagctctgcctactgcctccccagcaccaggcatggattttccagctatacagacagctttgtgcctccgtcggggccctccaaccccatgaaccccaccattggcaatggcctctcacctcaggtaatgggactcctgaccaaccacggtggggtacctcatcagccccagactgattacgcgctctcccctctcaccgggggtctggaacctaccaccacggtgtcggccagctgcagtcagagactagaccatatgaagagcttggacagtctgccaacatctcagtcctactgtccacccacctatagcaccacaggctacagtatggaccctgtcacaggctaccaatatgggcagtatggacaaagtgcctttcattatctcaagccagatatcgcttggtttcaaatccttttgaacacgttcgacaaaagcagtggagaagaggaagacctggagcaataaaagacaaatgcaacattttaaggcaatggtttcacatggttacatatcaaaacatcccaattctttagtgctgatcatcgaggagctagaacattccatttgcttgtgtgcgtgcgtgcgtgtgtgtgtgtgtgtgtgtattgagatttacccagactggtttgggcaagcagactgttctaaaatataatagaataccctaaagtataacatgtcgatgttcgatgctgatacttctacaactttaaaactgctcatttcatgaagcaagaatggaggaatccttgactcttacacactggaaattgaaataaagataaatgcaaccatttttaggaagctagactagctgtaaaggacctcctaaataaattatttgttactgtatcctcatttgtaatctagttgtcaataaatggcccggacatgtcttgctaacaggatatgggctaccaggaagaaggacttgtttccctttcctgtgtggggagaggtgtgtgacgtttttccagttcacatttatttggtagcccacctgggttggaggaagggcacggtggagagaaagtgacatgcattcacatatctgcttatcagtgtgcaatactgtgtacctcatggatgctttggcaatgcccaaggcgatataagcaaaatcagaagtatatttttgcaggtgcttttattttcacagcccataattcatagtgatagagtgcagtgatgtttgccatttgctggacaaccaacacccgggttgctcctttgattagagaccagatcagataattatgcttttaaactgattacgtttacattcttctcttttctatgaaaggcagggcaagaacagaagtgttcacatggctctcatgtacttttaaattatacaatgatatccaatattaaaagattataggaactgaggtttacatacgtttgtgtggtgacattttagaatgtcaataaatttgctttttgagatgttgagaggaacaagaaggtggaaggcagtgttatttatttctttctattcttggaaccacgaatgaggtaggcacaaatacattccttttagagttaagaactatgacgtagcgagttagtgagactagacatagtaccgaatttagttcatgcattggtcttagagggtgatggaacaagagaagtactatctttgtgttgcagcctcaaccaacaacaatgtgttgtaaaaatgtctttcatgtaaaaagtgcagtaaatatttactatttataatgaataaacagttatgaaaactt

SEQ ID NO: 21432 - DNA, 2258 bp, Homo sapiens
actcggtgtcaccacaggaggagactcaggcaggccgcgctccagcctcaccaggctccccggctcgccgtggctctctgagcccccttttcagggaccccagtcgctggaacatttgcccagactcgtaccaaacttttccgccctgggctcgggatcctggactccggggcctccccgtcctcccctttcccgggttccagctccggcctctggactaggaaccgacagcccccctccccgcgtccctccctctctctccagccgttttggggaggggctctccacgctccggatagttcccgagggtcatccgcgccgcactcgcctttccgtttcgccttcacctggatataatttccgagcgaagctgcccccaggatgaccacgctggccggcgctgtgcccaggatgatgcggccgggcccggggcagaactacccgcgtagcgggttcccgctggaagtgtccactcccctcggccagggccgcgtcaaccagctcggcggtgtttttatcaacggcaggccgctgcccaaccacatccgccacaagatcgtggagatggcccaccacggcatccggccctgcgtcatctcgcgccagctgcgcgtgtcccacggctgcgtctccaagatcctgtgcaggtaccaggagactggctccatacgtcctggtgccatcggcggcagcaagcccaagcaggtgacaacgcctgacgtggagaagaaaattgaggaatacaaaagagagaacccgggcatgttcagctgggaaatccgagacaaattactcaaggacgcggtctgtgatcgaaacaccgtgccgtcagtgagttccatcagccgcatcctgagaagtaaattcgggaaaggtgaagaggaggaggccgacttggagaggaaggaggcagaggaaagcgagaagaaggccaaacacagcatcgacggcatcctgagcgagcgagcctcagcaccccaatcagatgaaggctctgatattgactctgaaccagatttaccactaaagaggaaacagcgcagaagccgaaccaccttcacagcagaacagctggaggaactggagcgtgcttttgagagaactcattaccctgacatttatactagggaggaactggcccagagggcgaagctcaccgaggcccgagtacaggtctggtttagcaaccgccgtgcaagatggaggaagcaagctggggccaatcaactgatggctttcaaccatctcattcccggggggttccctcccactgccatgccgaccttgccaacgtaccagctgtcggagacctcttaccagcccacatctattccacaagctgtgtcagatcccagcagcaccgttcacagacctcaaccgcttcctccaagcactgtacaccaaagcacgattccttccaacccagacagcagctctgcctactgcctccccagcaccaggcatggattttccagctatacagacagctttgtgcctccgtcggggccctccaaccccatgaaccccaccattggcaatggcctctcacctcaggtaatgggactcctgaccaaccacggtggggtacctcatcagccccagactgattacgcgctctcccctctcaccgggggtctggaacctaccaccacggtgtcggccagctgcagtcagagactagaccatatgaagagcttggacagtctgccaacatctcagtcctactgtccacccacctatagcaccacaggctacagtatggaccctgtcacaggctaccaatatgggcagtatggacaaagtgcctttcattatctcaagccagatatcgcgtaagtgaactgtccacttggagctaaaactggccctgtttctggtcttcgcagcctagatatgaagaatctgctctgaaaacaaaaaaaaattacccttttgttggggggggtggggcagtggtcccaataggagacaaaggagagtgattgattttcttcctccaatagttggtttcaaatccttttgaacacgttcgacaaaagcagtggagaagaggaagacctggagcaataaaagacaaatgcaacattttaaggcaatggtttcacatggttacatatcaaaacatcccaattctttagtgctgatcatcgaggagctagaacattccatttgcttgtgtgcgtgcgtgcgtgtgtgtgtgtgtgtgtgtattgagatttacccagactggtttgggcaagcagactgttctaaaatat

SEQ ID NO: 21433 - DNA, 1782 bp, Homo sapiens
agtcgctggaacatttgcccagactcgtaccaaacttttccgccctgggctcgggatcctggactccggggcctccccgtcctcccctttcccgggttccagctccggcctctggactaggaaccgacagcccccctccccgcgtccctccctctctctccagccgttttggggaggggctctccacgctccggatagttcccgagggtcatccgcgccgcactcgcctttccgtttcgccttcacctggatataatttccgagcgaagctgcccccaggatgaccacgctggccggcgctgtgcccaggatgatgcggccgggcccggggcagaactacccgcgtagcgggttcccgctggaagtgtccactcccctcggccagggccgcgtcaaccagctcggcggtgtttttatcaacggcaggccgctgcccaaccacatccgccacaagatcgtggagatggcccaccacggcatccggccctgcgtcatctcgcgccagctgcgcgtgtcccacggctgcgtctccaagatcctgtgcaggtaccaggagactggctccatacgtcctggtgccatcggcggcagcaagcccaaggtgacaacgcctgacgtggagaagaaaattgaggaatacaaaagagagaacccgggcatgttcagctgggaaatccgagacaaattactcaaggacgcggtctgtgatcgaaacaccgtgccgtcagtgagttccatcagccgcatcctgagaagtaaattcgggaaaggtgaagaggaggaggccgacttggagaggaaggaggcagaggaaagcgagaagaaggccaaacacagcatcgacggcatcctgagcgagcgagcctcagcaccccaatcagatgaaggctctgatattgactctgaaccagatttaccactaaagaggaaacagcgcagaagccgaaccaccttcacagcagaacagctggaggaactggagcgtgcttttgagagaactcattaccctgacatttatactagggaggaactggcccagagggcgaagctcaccgaggcccgagtacaggtctggtttagcaaccgccgtgcaagatggaggaagcaagctggggccaatcaactgatggctttcaaccatctcattcccggggggttccctcccactgccatgccgaccttgccaacgtaccagctgtcggagacctcttaccagcccacatctattccacaagctgtgtcagatcccagcagcaccgttcacagacctcaaccgcttcctccaagcactgtacaccaaagcacgattccttccaacccagacagcagctctgcctactgcctccccagcaccaggcatggattttccagctatacagacagctttgtgcctccgtcggggccctccaaccccatgaaccccaccattggcaatggcctctcacctcaggtaatgggactcctgaccaaccacggtggggtacctcatcagccccagactgattacgcgctctcccctctcaccgggggtctggaacctaccaccacggtgtcggccagctgcagtcagagactagaccatatgaagagcttggacagtctgccaacatctcagtcctactgtccacccacctatagcaccacaggctacagtatggaccctgtcacaggctaccaatatgggcagtatggacaaagtgcctttcattatctcaagccagatatcgcgtaagtgaactgtccacttggagctaaaactggccctgtttctggtcttcgcag

SEQ ID NO: 21434 - DNA, 1254 bp, Homo sapiens
ccctctctctccagccgttttggggaggggctctccacgctccggatagttcccgagggtcatccgcgccgcactcgcctttccgtttcgccttcacctggatataatttccgagcgaagctgcccccaggatgaccacgctggccggcgctgtgcccaggatgatgcggccgggcccggggcagaactacccgcgtagcgggttcccgctggaagtgtccactcccctcggccagggccgcgtcaaccagctcggcggtgtttttatcaacggcaggccgctgcccaaccacatccgccacaagatcgtggagatggcccaccacggcatccggccctgcgtcatctcgcgccagctgcgcgtgtcccacggctgcgtctccaagatcctgtgcaggtaccaggagactggctccatacgtcctggtgccatcggcggcagcaagcccaagcaggtgacaacgcctgacgtggagaagaaaattgaggaatacaaaagagagaacccgggcatgttcagctgggaaatccgagacaaattactcaaggacgcggtctgtgatcgaaacaccgtgccgtcagtgagttccatcagccgcatcctgagaagtaaattcgggaaaggtgaagaggaggaggccgacttggagaggaaggaggcagaggaaagcgagaagaaggccaaacacagcatcgacggcatcctgagcgagcgaggtaagcggtggcgccttgggcggcgcacttgctgggtgacttggagggcatcggctagctgacattggtgatctgacggcagccaagcccagctcggatcaaggtcccttcatgcgcggtgtctctgcgcctgagtaacgacatggaactgaaagaccagagggacactaggaatcaaaacaaacatttctattctgcttagtttttctgttttgtaaatctttctttcttaaccactttcagcccctgggattctagaactgtgaattgtgctctgttgtagggggcaggggaagctctcactctgttgccattaaatgtatgagactgggcatctctgagcaattgtagggccggggatagagggtacttgaatcttcagaagttgaagtagcttttatgccctcaggaaaggccctggtctccggagtttcctcgcattaaaggagagagagagagagtactcttttgggcaacggccctccaaaattgcccccacattggctgccttataaatatgtctgtgtgttgactggt

SEQ ID NO: 21435 - DNA, 1772 bp, Homo sapiens
atgcatcaggacgggatcagcagcatgaaccagcttggggggctctttgtgaatggccggcccctgcctctggatacccggcagcagattgtgcggctagcagtcagtggaatgcggccctgtgacatctcacggatccttaaggtatctaatggctgtgtgagcaagatcctagggcgttactaccgcacaggtgtcttggagccaaagggcattgggggaagcaagccacggctggctacaccccctgtggtggctcgaattgcccagctgaagggtgagtgtccagccctctttgcctgggaaatccaacgccagctttgtgctgaagggctttgcacccaggacaagactcccagtgtctcctccatcaaccgagtcctgcgggcattacaggaggaccagggactaccgtgcacacggctcaggtcaccagctgttttggctccagctgtcctcactccccatagtggctctgagactccccggggtacccacccagggaccggccaccggaatcggactatcttctccccaagccaagcagaggcactggagaaagagttccagcgtgggcagtatcctgattcagtggcccgtggaaagctggctactgccacctctctgcctgaggacacggtgagggtctggttttccaacagaagagccaaatggcgtcggcaagagaagctcaagtgggaaatgcagctgccagcagtcccctggcagtgtgcccacagcagccctgcctgccctggaaccactgggtccctcctgctatcagctgtgctgggcaacagcaccagaaaggtgtctgagtgacaccccacctaaagcctgtctcaagccctgctggggccacttgcccccacagccgaattccctggactcaggactgctttgccttccttgcccttcctcccactgtcacctggccagtcttagtggctctcaggccctgctctggcctggctgcccactactgtatggcttggaatgaggcaggagtgggaaggagatggcatagagaagatctaataccatcctgcccattgtccttaccgtcctgcccatacagactgtggctccttcctccttcctgtgattgctccctcctgtgtggacgttgcctggccctgcctcgatgcctctctggcgcatcacctgattggaggggctggtaaagcaacacccacccacttctcacactagccttaagaggcctccactcagcagtaataaaagctgtttttattagcagtagttctgttgtccatcatgttttccctatgagcacccctatgcccactctaatattcaacaattatagacaatttgccctatcatttatttacatctatgtatctaccatctaatctatgcatgtatgtaggcaatacatgtatctaaacaatgtatttgtcaatgcatcaatttacctactctatgtatgcatctatatgtgtattatgtatgcgtgcatgcgtgcgcgcacacacacacacacacacacacactgacattatatcatggcattttattcctaaatcttccagcatgcatccccaaaaaacaagaaacttgtcttacataatcacaataatatatccacatctaagaaaatttactgtaacttcttaatctaagaaaattatgtatttttgtcatatgtattttgtcatatgtattttgtatttgcatatgtattttgtatttgcatatgtatttttgtcatagcagcaaacagagtgaaatgccatttttcatattct

SEQ ID NO: 21436 - DNA, 2010 bp, Homo sapiens
caaagactcacccgtgagccagctctcaaagaaagcagcttgcgttgacagcctgggggcagcaaggatgcagtctcccaggagaggatgcactcggtggtgggaagccaggctggaggggcctgagtgaccctctccacaggcgggcagggcagtgggagaggtggtgtgtggatacctctgtctcacgcccagggatcagcagcatgaaccagcttggggggctctttgtgaatggccggcccctgcctctggatacccggcagcagattgtgcggctagcagtcagtggaatgcggccctgtgacatctcacggatccttaaggtatctaatggctgtgtgagcaagatcctagggcgttactaccgcacaggtgtcttggagccaaagggcattgggggaagcaagccacggctggctacaccccctgtggtggctcgaattgcccagctgaagggtgagtgtccagccctctttgcctgggaaatccaacgccagctttgtgctgaagggctttgcacccaggacaagactcccagtgtctcctccatcaaccgagtcctgcgggcattacaggaggaccagggactaccgtgcacacggctcaggtcaccagctgttttggctccagctgtcctcactccccatagtggctctgagactccccggggtacccacccagggaccggccaccggaatcggactatcttctccccaagccaagcagaggcactggagaaagagttccagcgtgggcagtatcctgattcagtggcccgtggaaagctggctactgccacctctctgcctgaggacacggtgagggtctggttttccaacagaagagccaaatggcgtcggcaagagaagctcaagtgggaaatgcagctgccaggtgcttcccaggggctgactgtaccaagggttgccccaggaatcatctctgcacagcagtcccctggcagtgtgcccacagcagccctgcctgccctggaaccactgggtccctcctgctatcagctgtgctgggcaacagcaccagaaaggtgtctgagtgacaccccacctaaagcctgtctcaagccctgctggggccacttgcccccacagccgaattccctggactcaggactgctttgccttccttgcccttcctcccactgtcacctggccagtcttagtggctctcaggccctgctctggcctggctgcccactactgtatggcttggaatgaggcaggagtgggaaggagatggcatagagaagatctaataccatcctgcccattgtccttaccgtcctgcccatacagactgtggctccttcctccttcctgtgattgctccctcctgtgtggacgttgcctggccctgcctcgatgcctctctggcgcatcacctgattggaggggctggtaaagcaacacccacccacttctcacactagccttaagaggcctccactcagcagtaataaaagctgtttttattagcagtagttctgttgtccatcatgttttccctatgagcacccctatgcccactctaatattcaacaattatagacaatttgccctatcatttatttacatctatgtatctaccatctaatctatgcatgtatgtaggcaatacatgtatctaaacaatgtatttgtcaatgcatcaatttacctactctatgtatgcatctatatgtgtattatgtatgcgtgcatgcgtgcgcgcacacacacacacacacacacacactgacattatatcatggcattttattcctaaatcttccagcatgcatccccaaaaaacaagaaacttgtcttacataatcacaataatatatccacatctaagaaaatttactgtaacttcttaatctaagaaaattatgtatttttgtcatatgtattttgtcatatgtattttgtatttgcatatgtattttgtatttgcatatgtatttttgtcatagcagcaaacagagtgaaatgccatttttcatattct

SEQ ID NO: 21437 - DNA, 1088 bp, Homo sapiens
atgcatcaggacgggatcagcagcatgaaccagcttggggggctctttgtgaatggccggcccctgcctctggatacccggcagcagattgtgcggctagcagtcagtggaatgcggccctgtgacatctcacggatccttaaggtatctaatggctgtgtgagcaagatcctagggcgttactaccgcacaggtgtcttggagccaaagggcattgggggaagcaagccacggctggctacaccccctgtggtggctcgaattgcccagctgaagggtgagtgtccagccctctttgcctgggaaatccaacgccagctttgtgctgaagggctttgcacccaggacaagactcccagtgtctcctccatcaaccgagtcctgcgggcattacaggaggaccagggactaccgtgcacacggctcaggtcaccagctgttttggctccagctgtcctcactccccatagtggctctgagactccccggggtacccacccagggaccggccaccggaatcggactatcttctccccaagccaagcagaggcactggagaaagagttccagcgtgggcagtatcctgattcagtggcccgtggaaagctggctactgccacctctctgcctgaggacacggtgagggtctggttttccaacagaagagccaaatggcgtcggcaagagaagctcaagtgggaaatgcagctgccaggtgcttcccaggggctgactgtaccaagggttgccccaggaatcatctctgcacagcagtcccctggcagtgtgcccacagcagccctgcctgccctggaaccactgggtccctcctgctatcagctgtgctgggcaacagcaccagaaaggtgtctgagtgacaccccacctaaagcctgtctcaagccctgctgggactgtggctccttcctccttcctgtgattgctccctcctgtgtggacgttgcctggccctgcctcgatgcctctctggcgcatcacctgattggaggggctggtaaagcaacacccacccacttctcacactagccttaagaggcctccactcagcagtaataaaagctgttttt

SEQ ID NO: 21438 - DNA, 2260 bp, Homo sapiens
gaaagctggtgtggagggagaagcgagtgtggtccggagaaagaaggcgtggagaagagggagggagcgagagcgagagaataaatatataaataaatacgagaacgaaatccactccgcagtctccgggctcggaaactttggccccgagcgccagagcgccagagcgcgagagcgcggcgctcgccactctgaggctggcggcctcgattccggccgcgttcccccggcccccctccgccgcggggcctggtctccgggttctgccaggcgcatcagcccgcacaacttctggccgaggccagccggcagaggcggacttggggttggagtgtttgtttgtttgaacttcctcgtcgtcgccaccttccctccccccaacctccaccccacctcacccccctccccagcttctggacgcgtttgactgcagccaggggtggggggtgggggtagggagtgtgtgtggaggggagggagaagaggttaaaaaaaagaagacgaagaagacggaaagaaagagatcgcagcaggggtgaagggagcggacgggaagcgatttttgccgactttggattcgtccccggcgtgcgcaagaatggcggcccttcccggcacggtaccgagaatgatgcggccggctccggggcagaactacccccgcacgggattccctttggaagtgtccaccccgcttggccaaggccgggtcaatcagctgggaggggtcttcatcaatgggcgacccctgcctaaccacatccgccacaagatagtggagatggcccaccatggcatccggccctgtgtcatctcccgacagctgcgtgtctcccacggctgcgtctccaagattctttgccgctaccaggagaccgggtccatccggcctggggccatcggcggcagcaagcccagacaggtggcgactccggatgtagagaaaaagattgaggagtacaagagggaaaacccaggcatgttcagctgggagatccgggacaggctgctgaaggatgggcactgtgaccgaagcactgtgccctcaggtttagtgagttcgattagccgcgtgctcagaatcaagttcgggaagaaagaggaggaggatgaagcggacaagaaggaggacgacggcgaaaagaaggccaaacacagcatcgacggcatcctgggcgacaaagggaaccggctggacgagggctcggatgtggagtcggaacctgacctcccactgaagcgcaagcagcgacgcagtcggaccacattcacggccgagcagctggaggagctggagaaggcctttgagaggacccactacccagacatatacacccgcgaggagctggcgcagaggaccaagctgacagaggcgcgtgtgcaggtctggttcagtaaccgccgcgcccgttggcgtaagcaggcaggagccaaccagctggcggcgttcaaccaccttctgccaggaggcttcccacccaccggcatgcccacgctgcccccctaccagctgccggactccacctaccccaccaccaccatctcccaagatgggggcagcactgtgcaccggcctcagcccctgccaccgtccaccatgcaccagggcgggctggctgcagcggctgcagccgccgacaccagctctgcctacggagcccgccacagcttctccagctactctgacagcttcatgaatccggcggcgccctccaaccacatgaacccggtcagcaacggcctgtctcctcaggtgatgagcatcttgggcaaccccagtgcggtgcccccgcagccacaggctgacttctccatctccccgctgcatggcggcctggactcggccacctccatctcagccagctgcagccagcgggccgactccatcaagccaggagacagcctgcccacctcccaggcctactgcccacccacctacagcaccaccggctacagcgtggaccccgtggccggctatcagtacggccagtacggccagagtgagtgcctggtgccctgggcgtcccccgtccccattccttctcccacccccagggcctcctgcttgtttatggagagctacaaggtggtgtcagggtggggaatgtccatttcacagatggaaaaattgaagtccagccagatggaacagttcacctaaaatgacactgagttgggcaaaacccaggacatctcctggctaagcctctgcttccgtactatggctccaacagaaataaaatacacaacacaaatatca

SEQ ID NO: 21439 - DNA, 1700 bp, Homo sapiens
aagagatcgcagcaggggtgaagggagcggacgggaagcgatttttgccgactttggattcgtccccggcgtgcgcaagaatggcggcccttcccggcacggtaccgagaatgatgcggccggctccggggcagaactacccccgcacgggattccctttggaagtgtccaccccgcttggccaaggccgggtcaatcagctgggaggggtcttcatcaatgggcgacccctgcctaaccacatccgccacaagatagtggagatggcccaccatggcatccggccctgtgtcatctcccgacagctgcgtgtctcccacggctgcgtctccaagattctttgccgctaccaggagaccgggtccatccggcctggggccatcggcggcagcaagcccagacaggtggcgactccggatgtagagaaaaagattgaggagtacaagagggaaaacccaggcatgttcagctgggagatccgggacaggctgctgaaggatgggcactgtgaccgaagcactgtgccctcagtgagttcgattagccgcgtgctcagaatcaagttcgggaagaaagaggaggaggatgaagcggacaagaaggaggacgacggcgaaaagaaggccaaacacagcatcgacggcatcctgggcgacaaagggaaccggctggacgagggctcggatgtggagtcggaacctgacctcccactgaagcgcaagcagcgacgcagtcggaccacattcacggccgagcagctggaggagctggagaaggcctttgagaggacccactacccagacatatacacccgcgaggagctggcgcagaggaccaagctgacagaggcgcgtgtgcaggtctggttcagtaaccgccgcgcccgttggcgtaagcaggcaggagccaaccagctggcggcgttcaaccaccttctgccaggaggcttcccacccaccggcatgcccacgctgcccccctaccagctgccggactccacctaccccaccaccaccatctcccaagatgggggcagcactgtgcaccggcctcagcccctgccaccgtccaccatgcaccagggcgggctggctgcagcggctgcagccgccgacaccagctctgcctacggagcccgccacagcttctccagctactctgacagcttcatgaatccggcggcgccctccaaccacatgaacccggtcagcaacggcctgtctcctcaggtgatgagcatcttgggcaaccccagtgcggtgcccccgcagccacaggctgacttctccatctccccgctgcatggcggcctggactcggccacctccatctcagccagctgcagccagcgggccgactccatcaagccaggagacagcctgcccacctcccaggcctactgcccacccacctacagcaccaccggctacagcgtggaccccgtggccggctatcagtacggccagtacggccagagtgagtgcctggtgccctgggcgtcccccgtccccattccttctcccacccccagggcctcctgcttgtttatggagagctacaaggtggtgtcagggtggggaatgtccatttcacagatggaaaaattgaagtccagccagatggaacagttcacctaaaatgacactgagttgggcaaaacccaggacatctcctggctaagcctctgcttccgtactatg

SEQ ID NO: 21440 - DNA, 5538 bp, Homo sapiens
agaaagagatcgcagcaggggtgaagggagcggacgggaagcgatttttgccgactttggattcgtccccggcgtgcgcaagaatggcggcccttcccggcacggtaccgagaatgatgcggccggctccggggcagaactacccccgcacgggattccctttggaagtgtccaccccgcttggccaaggccgggtcaatcagctgggaggggtcttcatcaatgggcgacccctgcctaaccacatccgccacaagatagtggagatggcccaccatggcatccggccctgtgtcatctcccgacagctgcgtgtctcccacggctgcgtctccaagattctttgccgctaccaggagaccgggtccatccggcctggggccatcggcggcagcaagcccagacaggtggcgactccggatgtagagaaaaagattgaggagtacaagagggaaaacccaggcatgttcagctgggagatccgggacaggctgctgaaggatgggcactgtgaccgaagcactgtgccctcaggtttagtgagttcgattagccgcgtgctcagaatcaagttcgggaagaaagaggaggaggatgaagcggacaagaaggaggacgacggcgaaaagaaggccaaacacagcatcgacggcatcctgggcgacaaagggaaccggctggacgagggctcggatgtggagtcggaacctgacctcccactgaagcgcaagcagcgacgcagtcggaccacattcacggccgagcagctggaggagctggagaaggcctttgagaggacccactacccagacatatacacccgcgaggagctggcgcagaggaccaagctgacagaggcgcgtgtgcaggtctggttcagtaaccgccgcgcccgttggcgtaagcaggcaggagccaaccagctggcggcgttcaaccaccttctgccaggaggcttcccacccaccggcatgcccacgctgcccccctaccagctgccggactccacctaccccaccaccaccatctcccaagatgggggcagcactgtgcaccggcctcagcccctgccaccgtccaccatgcaccagggcgggctggctgcagcggctgcagccgccgacaccagctctgcctacggagcccgccacagcttctccagctactctgacagcttcatgaatccggcggcgccctccaaccacatgaacccggtcagcaacggcctgtctcctcaggtgatgagcatcttgggcaaccccagtgcggtgcccccgcagccacaggctgacttctccatctccccgctgcatggcggcctggactcggccacctccatctcagccagctgcagccagcgggccgactccatcaagccaggagacagcctgcccacctcccaggcctactgcccacccacctacagcaccaccggctacagcgtggaccccgtggccggctatcagtacggccagtacggccagactgctgttgattatctggccaaaaatgtgagcctctccacccagcgtcgcatgaagctcggggagcactctgctgtgctgggactcctgcctgtggaaactggccaggcctactagggcccctggggcgacttgccccagcccaattcccagcccaaccctaactgacccctgagcttcccagccttgccgcctcacccccctgttgtcctaggaggccaggaaaggagcccacctgcttctcatcaccagccccctggaggtagacagccagcttgtcactcacctgtggttagggatccagagtgatgcccttggagtctgctccccactttccccaaggagggtttctggtcagcctgaggtcctcccctgtcaaatcccatggtggcctctgtgccatctcaggcatggagattggggcccaccttgaacaccttgggtgtccagaggaggatggtgcctgagaggaggtcctacagccctttggacccaactccagtgggggccctagctagaagtggaggtgaagctttcagggctgctctcagctggatgtactgggagccagccctgcaaggagggtctctggctcagtgtcagaaccacagccctttcctcctctagacattgggactccagcaaagaggggaccctggccctggggtcttcccaggggagtcagcaggggggcagtctcacccccacccaggaatttgaaggacttcagaaccctccccagacacctctactgggtgcatggggaaatctagcacaggcagggagactggggagaccaggaagaggcttaaccagagggtaggggcacatgggggtggggcttgtcagccgtgggcccgcccaggatacaaggacccaactcaggcttctggaagcagagggctcttatcctgaagcccaagttcccagcatgtccactccatctggggcctggggagcccacagaacttttcagtttccttcattagctgaatcagatgagatggggaggggataaagtcttgaggatacatgagtggaggagcaggaagtgggctcagaaggcactttcataaccagatccctctgtttgtgggagggcaagcctttgttgcccaaggcttcagctctctgcctgcaagtccacaccccagggagttgagattttgcccaaagccttccgcagaggcccgagcccatccttaccatgccccatcctctaggaagaggtctccatcttccccaaacccctttcagtttgtggggatgcagagagctaccctcagagctttggaggagggttgtagactgggcagggatggtttgccccacagacaagatgatcccccctggcatgttgttaggggcaaattgctgtcctgctcagagtggcatctttcaatgttgcctccatcttggccaagaggtccctgcctcctgatccggcacagctgagctgaggcagatgtgaccagttttcaagctaccagccctgggcagaggaagatgtcaacaattccagagcagagggaagaggcaccttccttgaccacaccagtggcctcctgaagttccatgcttttaagagctgggaccttgggaggatgattcaaaccctcaattcctcctccctgggaactttttaccacctttacctatttatcaaaatcatattcatctttaccatcactgtcactgtaatctacattccatcacctttatcaggtgctgctgagtacaaagcacttgggatgggagacacagcactgaattcacaaacattggaccaaactgtttgtccccatctgggttcatgaggccacctctttgctcaatccatgcctcttgccctcagtcaacaagacattcctagagggaaagggctgctgctctgggagtcaacctgagttcctccctcctgggaagctgggttggcaagattctaggacactcacctgcatggacatcacctctgtgacaaatgcttacctgtttctcatcttcagacttggcgatatcaagcctgttctggaccatgaccaggctggctcatatctctggtttagagaaacctatgaataactggggacaaacagactctttggtagcagcagacacatgtgatccatcaagatcaaccaaggttgcaactggagcgtccactgccagagacctttggctcttcaagctcgggacaaaaaagaagactctgttgtcccttggtaacccagtccctgcttttgtagctatcacagcagaaagcaactcttcctgaagaccaaacactcgtcatccacattccttgaatggccaatccttccatctggaggcctggctcagaaagtatctgagtatcctgacaccctctgtgactcaggagcagggatctcaggcagctgatatcaaaaccacccagccccatccccaggaggcgacattccaatgctaggaccaatcccagatatctggtcccgatggtgaaatggaacaaagacctgcttgggaataaaccaaatgatttctcatgacgttgaacataagttctcccaagccatcatcttggtagaaaatgggacttattccttgacaggccccacccccttcagaaagaggcccttgaccctgataggttctctctaaaacccgtatattaacgcatctggccaacttgggttataaaattcagccttgtgttggcaactcgaaacatcaccagagaggtgatgttgaatgagagacacaaggcctccatctctttggggctgaccacagcctgagaaagaaggtctgggttccagtggccaggccgtcccagaaacaacccccatccatccctgtaaatagagtctgtagcaaaataagagctgcttcctccaacttatcacaagtcgccgttggtcctctctaaggagggctctcttctgagttcattgtacaatagttggaaacgtggtgatgtgctgttcgtttatagaaagctgactttttataaatatatatatatactaaaaaaggaaagaaatcccccacagtgtgtgtcgtgctagtgccagagaccatctgtagggatatatcttcatattgtgtgtttcaaattatgcattccaggctctagtgggttctttcaatcttgttcctttatttttttcatttggtatttctctcttgctatataaagaaaaaaagaagtgatgtgtaagaaccaagctatgcttttatacttccattttatacttgatttagctttgttgttcttttgccagaggaacatcaaagggcagagcaaacagagaactagggggataagagagaagaaaagaagaatggagagagaggtttgcccagaaggaaaacgaagagccagattgaaatctgactctggcttgagaacaggacgggtcccagagtttgaccactgccagaatccagtgtttcaagatggagttggtgaagcatccaagattttggatcctgggcctcagtgacactccatcacccaactaaaaagatgttctctgggacctctctcaggctgatgttcttctcatcaagctcccgaatgtgtctcgcactattggacactttttgggggtacacaggtcttctctcctcccctcctgcagaggcaccaaaaccaagaccaaatgggggttctctagccgccaacttgaaacgctctgagacttctgtgtatttgatgcttcttcaagtcagctctgacgtggccaattccctgacctgggaaatatttacatagtactctagatcattccttcttcctagtaactgcaactttgttgcttctgtgtttgactcacagccactttcccccatgcggaagtgagtgggtgtacgtgagggtgtgagtggggtgtgtgcgtgggcgtgtgggcgtgaggtgtgtgtttaaatataatcacaccataatttattcagctatatggagtagtagactagaaagagaaactggtatttgctttaactacctgctgcttgtaagcgcttcctctgtaactcaggcgtaactgttatacattaaaagaaattaaaagca

SEQ ID NO: 21441 - DNA, 4514 bp, Homo sapiens
agcccacgttgctgcttagattgaaatgcagaactcaagcctctttcatcggggcacagacttccttttacttcttccttttgccctctcgcctcctcctcctgggaagaagcggaggcgccggcggtcggccgggatagcaacaggccgggccactgaggcggtgcggaaagtttctgtctgggagtgcggaactggggccgggttggtgtactgctcggagcaatggagccagccttcggggaggtgaaccagctgggaggagtgttcgtgaacgggaggccgctgcccaacgccatccggcttcgcatcgtggaactggcccaactgggcatccgaccgtgtgacatcagccgccagctacgggtctcgcacggctgcgtcagcaagatcctggcgcgatacaacgagacgggctcgatcttgccaggagccatcgggggcagcaagccccgggtcactacccccaccgtggtgaaacacatccggacctacaagcagagagaccccggcatcttcgcctgggagatccgggaccgcctgctggcggacggcgtgtgcgacaagtacaatgtgccctccgtgagctccatcagccgcattctgcgcaacaagatcggcaacttggcccagcagggtcattacgactcatacaagcagcaccagccgacgccgcagccagcgctgccctacaaccacatctactcgtaccccagccctatcacggcggcggccgccaaggtgcccacgccacccggggtgcctgccatccccggttcggtggccatgccgcgcacctggccctcctcgcactccgtcaccgacatcctgggcatccgctccatcaccgaccaagtgagcgacagctccccctaccacagccccaaggtggaggagtggagcagcctgggccgcaacaacttccccgccgccgccccgcacgcggtgaacgggttggagaagggagccctggagcaggaagccaagtacggtcaggcaccaaatggtctcccagctgtgggcagttttgtgtcagcatccagcatggctccttaccctaccccagcccaagtgtcgccttacatgacctacagtgctgctccttctggttatgttgctggacatgggtggcaacatgctgggggcacctcattgtctccccacaactgtgacattccggcatcgctggcgttcaagggaatgcaggcagccagagaaggtagtcattctgtcacggcttccgcgctctgatgggaaattccgtctccagcagcttcacccgggtctccctgtctcagcacctcctcccccaattcccaggtctcacatcccacccctcctgccctccaacccttctgccttgaaagctggctgtacggactcacatcctttgtgctaatgacacttacatatttcttgccataacttttctcttgcagaaaaactgacatgactttaggatttaaaaacaagagcaacaataagcattgaatgagacatttgtgttgcccacatactgtcttaacataacaaagaaacctacacccctcaaagggtttaaggaactttacaaactagtctttggtaaaaccacatgtgtatatttattctaaatcaacctgaacttttgaaatgtgcaattgttgagattttgcaaaatcaataaaggaaaatacttatagaaaaaattatgctacaccctctaatcaaatatggtaaccaagtaagctttaattcatcattaggaaacaaatcaataagtgacttgtttgagtgatcctttgtttaagacatgacctattttgttgaaaaatatatgtagaacccaagcaatatctgaatctagctctccctggtgttttgacttggttccaaatacaataatgtttatattttctattagtttgtaaatacggactctggatggtgcatttgtgtcttcattccataagatattcccctcccctcagccccaccccctctctatttttttctttcttttttgcaaaggtgactttctggcaacgtctttgtctctgtttggtggtgggctgctcgggctcctggacctggacttgcccccaaattttgtgtatgcagtgaaggcttcaacatctcatgaaggacactttatttctacagcagaggacacgaaaaacagataaaacaagccagtctcccattttgtacctaatcaaacaacacacatgctaagcatataaagacaagagggtggaaaatatctgaacaagaaggctctaaaggaagtcacttagaaacttaagtttaatgtgaaatgttttgcaaagatgcttaaaatgaactttgtgttaagaaaaccactgtgaaactaaattgtcctattattgttggcttacctgtgtgttcagcaatctcagccccaaataatgttgtaatttaaagaaaatggaaaattctgctctaatgaatgtaacaatggcttgctgtgaagtttacattgttgtacagaagcatgtttcgcatgtaggtaaactggtggtggtactagaaatacaatgttatttaattttaacaaattccctttattcatttctgaaattacaggacacagtttaactcataaacctttctagaccaatttatttttcactttaatgttaataacagttgtggagtatatgtgtgtgtgagcatgtgagtatgtgttgtattttaaaacaattgattttctggggcaaaattctacagtttttaatcccttctgtttaggaagttcttcctgtttggcaatataggcttaaaaatatgtttttaggacattggtacaattcagctgttggaaaattaatatattgagggttttttggtactaattctgtgcaataactaaaagagcacctcactggatatggatgttgaagatggattccctaggtgattttaatttcttccggtctgtgctgtgcacagtctacatggcaatgcggttccaccacatcggtttcgtggcttcgtttaaaactcagatggctagattagttaggttttcaaatcactaggatgtaaacagtaagcagatttctgacacacaaattatgttagagtgactgcttttttcagacagcagatatcttatagagagctttgaactgcatttatttctaaagcaaccgaaattcagtgctacaaatagaggattataacttcaggagaagaataagcagaaggagcagatgaactctcagggccatagtcttcctttgatcttgtaaaacttccattgacatctggagttcccagtctggtgagaaaatagactataaactgaatggaacaaagatccaatccaatattttggtggagacttctttaaaaccataccatacagggactctcctgtcatctgaaaaactgatgtaaggtacagaactattctttatcaaatgtttttaggtggctgttagggggctttaaaaaatattacttgcttgtgtggaaatgcaaataatgttattttctttatctaaattaagaaatctcttgttattgtgctatttataatttttttctggttcttgtattttaaaaaatctaatattaatggtattgaagtttccttttctccctctaggtcttaacagtgaattcacatggagtaatttttaaaagatatcagatacaatttgctattcaaagaaaattatgatttaaagccactttttaaaatacgagaaggaaaataggatggattaaagggttaacttttaaagattattattggttaatgttgacatatttcctctatctcatagatggtaaaagtgttgcttttaaactggcaaatgcactcttcagaaatccttttctatctgatccacatggagaggttaaaggttcaatttcatgacctctatgcaggcagcgctctcattggatgtaagaatattacctgcaaggatagaatgcagttgtgcaacagagacacattcttatttcttttttttcacaattttgttttgtttttaatgacccttttattgaatattggactgaaatataaattttaaaaaacacgttggaaaggatgtacaacagaaggctatgtatgtatatacagtatgtcaaaagccttttatttttatacttcaaatgctctaaattaataaaaagtaataattaccatgttatcttttactttttattttcaaaatgctttagtgaaatagccccgtagtagaaatagcccacggtagtaacttaggacaggtgtcatatggactttcagttattcttgttgactttactgaatcagcatcatctctggatgcagatataaaatcaagtttggttacatcaagaccaaggagatatttttgttgatacatgttagtatagtaatccttagaaatgctaagtgtatttctttttcagaacatttccccttcatcatacatattttaatactgcagacagctgacttcccacctgaagttgtcgtttaaaactaataacctgaaaatgcagttctgttc

SEQ ID NO: 21442 - DNA, 3102 bp, Homo sapiens
ccctcccctgctctcgcaaggagaaagcgggcgacgagcgctcgcagcccgtggggctgatcccacctcccgcagggctccggtcgtgtcgctgtcggaccgcagaacgccgggacgcatttccgagctcgggcccgacccaacccgctgccattctagctacctagtggagccgcggagagactcttgaaccgtgaggctccttgatgagaaggtggagaggctgccgggctattctccgagcatcttccggccgagctctgctcctctccgtgcgcttgcggcttctccttgggctagcgcgtccgcagtccctccaagtccaggccgcagtcacccaggtggggagctagcctgaaagagacagcggaaggagtttcctggactgcgctgtcgctcaccgacccgcaccaatcaccatgcagcttgccctcggacccgccccttttagggcgtgtccccagtgagtgatagacggagccgccctgccctgctcagcccagcccacgttgctgcttagattgaaatgcagaactcaagcctctttcatcggggcacagacttccttttacttcttccttttgccctctcgcctcctcctcctgggaagaagcggaggcgccggcggtcggccgggatagcaacaggccgggccactgaggcggtgcggaaagtttctgtctgggagtgcggaactggggccgggttggtgtactgctcggagcaatggagccagccttcggggaggtgaaccagctgggaggagtgttcgtgaacgggaggccgctgcccaacgccatccggcttcgcatcgtggaactggcccaactgggcatccgaccgtgtgacatcagccgccagctacgggtctcgcacggctgcgtcagcaagatcctggcgcgatacaacgagacgggctcgatcttgccaggagccatcgggggcagcaagccccgggtcactacccccaccgtggtgaaacacatccggacctacaagcagagagaccccggcatcttcgcctgggagatccgggaccgcctgctggcggacggcgtgtgcgacaagtacaatgtgccctccgtgagctccatcagccgcattctgcgcaacaagatcggcaacttggcccagcagggtcattacgactcatacaagcagcaccagccgacgccgcagccagcgctgccctacaaccacatctactcgtaccccagccctatcacggcggcggccgccaaggtgcccacgccacccggggtgcctgccatccccggttcggtggccatgccgcgcacctggccctcctcgcactccgtcaccgacatcctgggcatccgctccatcaccgaccaagtgagcgacagctccccctaccacagccccaaggtggaggagtggagcagcctgggccgcaacaacttccccgccgccgccccgcacgcggtgaacgggttggagaagggagccctggagcaggaagccaagtacggtcaggcaccaaatggtctcccagctgtgggcagttttgtgtcagcatccagcatggctccttaccctaccccagcccaagtgtcgccttacatgacctacagtgctgctccttctggttatgttgctggacatgggtggcaacatgctgggggcacctcattgtctccccacaactgtgacattccggcatcgctggcgttcaagggaatgcaggcagccagagaaggtagtcattctgtcacggcttccgcgctctgatgggaaattccgtctccagcagcttcacccgggtctccctgtctcagcacctcctcccccaattcccaggtctcacatcccacccctcctgccctccaacccttctgccttgaaagctggctgtacggactcacatcctttgtgctaatgacacttacatatttcttgccataacttttctcttgcagaaaaactgacatgactttaggatttaaaaacaagagcaacaataagcattgaatgagacatttgtgttgcccacatactgtcttaacataacaaagaaacctacacccctcaaagggtttaaggaactttacaaactagtctttggtaaaaccacatgtgtatatttattctaaatcaacctgaacttttgaaatgtgcaattgttgagattttgcaaaatcaataaaggaaaatacttatagaaaaaattatgctacaccctctaatcaaatatggtaaccaagtaagctttaattcatcattaggaaacaaatcaataagtgacttgtttgagtgatcctttgtttaagacatgacctattttgttgaaaaatatatgtagaacccaagcaatatctgaatctagctctccctggtgttttgacttggttccaaatacaataatgtttatattttctattagtttgtaaatacggactctggatggtgcatttgtgtcttcattccataagatattcccctcccctcagccccaccccctctctatttttttctttcttttttgcaaaggtgactttctggcaacgtctttgtctctgtttggtggtgggctgctcgggctcctggacctggacttgcccccaaattttgtgtatgcagtgaaggcttcaacatctcatgaaggacactttatttctacagcagaggacacgaaaaacagataaaacaagccagtctcccattttgtacctaatcaaacaacacacatgctaagcatataaagacaagagggtggaaaatatctgaacaagaaggctctaaaggaagtcacttagaaacttaagtttaatgtgaaatgttttgcaaagatgcttaaaatgaactttgtgttaagaaaaccactgtgaaactaaattgtcctattattgttggcttacctgtgtgttcagcaatctcagccccaaataatgttgtaatttaaagaaaatggaaaattctgctctaatgaatgtaacaatggcttgctgtgaagtttacattgttgtacagaagcatgtttcgcatgtaggtaaactggtggtggtactagaaatacaatgttatttaattttaacaaattccctttattcatttctgaaattacaggacacagtttaactc

SEQ ID NO: 21443 - DNA, 987 bp, Homo sapiens
agtgcaggcacccttagtgagcgacagctccccctaccacagccccaaggtggaggagtggagcagcctgggccgcaacaacttccccgccgccgccccgcacgcggtgaacgggttggagaagggagccctggagcaggaagccaagtacggtcagatccaaaactttttcttgcttatgatatcgaggttgaaattctaggtgaagcacatctctatttgtggctaaatctactttattataaagccaaggtagaagatagtttgctatagagagcacccttgcacagttctttcaggggaaagaattctcatgcctttcatggaagatccacatgagaaaggagttgatggattgaagtcttatttatggaatctttaggcaccaaatggtctcccagctgtgggcagttttgtgtcagcatccagcatggctccttaccctaccccagcccaagtgtcgccttacatgacctacagtgctgctccttctggttatgttgctggacatgggtggcaacatgctgggggcacctcattgtctccccacaactgtgacattccggcatcgctggcgttcaagggaatgcaggcagccagagaaggtagtcattctgtcacggcttccgcgctctgatgggaaattccgtctccagcagcttcacccgggtctccctgtctcagcacctcctcccccaattcccaggtctcacatcccacccctcctgccctccaacccttctgccttgaaagctggctgtacggactcacatcctttgtgctaatgacacttacatatttcttgccataacttttctcttgcagaaaaactgacatgactttaggatttaaaaacaagagcaacaataagcattgaatgagacatttgtgttgcccacatactgtcttaacataacaaagaaacctacacccctcaaagggtttaaggaactttacaaactagtctttggtaaaaccacatgtgta

SEQ ID NO: 21444 - DNA, 1313 bp, Homo sapiens
aataggggaaaataagccagatggataaaggaagtgctggtcaccctggaggtgcactggtttggggaaggctcctggcccccacagccctcttcggagcctgagcccggctctcctcactcacctcaacccccaggcggcccctccacagggcccctctcctgcctggacggctctgctggtctccccgtcccctggagaagaacaaggccatgggtcggcccctgctgctgcccctactgcccttgctgctgccgccagcatttctgcagcctagtggctccacaggatctggtccaagctacctttatggggtcactcaaccaaaacacctctcagcctccatgggtggctctgtggaaatccccttctccttctattacccctgggagttagccacagctcccgacgtgagaatatcctggagacggggccacttccacaggcagtccttctacagcacaaggccgccttccattcacaaggattatgtgaaccggctctttctgaactggacagagggtcagaagagcggcttcctcaggatctccaacctgcagaagcaggaccagtctgtgtatttctgccgagttgagctggacacacggagctcagggaggcagcagtggcagtccatcgaggggaccaaactctccatcacccaggctgtcacgaccaccacccagaggcccagcagcatgactaccacctggaggctcagtagcacaaccaccacaaccggcctcagggtcacacagggcaaacgacgctcagactcttggcacataagtctggagactgctgtgggggtggcagtggctgtcactgtgctcggaatcatgattttgggactgatctgcctcctcaggtggaggagaaggaaaggtcagcagcggactaaagccacaaccccagccagggaacccttccaaaacacagaggagccatatgagaatatcaggaatgaaggacaaaatacagatcccaagctaaatcccaaggatgacggcatcgtctatgcttcccttgccctctccagctccacctcacccagagcacctcccagccaccgtcccctcaagagcccccagaacgagaccctgtactctgtcttaaaggcctaaccaatggacagccctctcaagactgaatggtgaggccaggtacagtggcgcacacctgtaatcccagctactctgaagcctgaggcagaatcaagtgagcccaggagttcagggccagctttgataatggagcgagatgccatctctagttaaaaatatatattaacaataaagtaacaaatttaaaaa

SEQ ID NO: 21445 - DNA, 1011 bp, Homo sapiens
acagccctcttcggagcctgagcccggctctcctcactcacctcaacccccaggcggcccctccacagggcccctctcctgcctggacggctctgctggtctccccgtcccctggagaagaacaaggccatgggtcggcccctgctgctgcccctactgcccttgctgctgccgccagcatttctgcagcctagtggctccacaggatctggtccaagctacctttatggggtcactcaaccaaaacacctctcagcctccatgggtggctctgtggaaatccccttctccttctattacccctgggagttagccacagctcccgacgtgagaatatcctggagacggggccacttccacaggcagtccttctacagcacaaggccgccttccattcacaaggattatgtgaaccggctctttctgaactggacagagggtcagaagagcggcttcctcaggatctccaacctgcagaagcaggaccagtctgtgtatttctgccgagttgagctggacacacggagctcagggaggcagcagtggcagtccatcgaggggaccaaactctccatcacccagggtcagcagcggactaaagccacaaccccagccagggaacccttccaaaacacagaggagccatatgagaatatcaggaatgaaggacaaaatacagatcccaagctaaatcccaaggatgacggcatcgtctatgcttcccttgccctctccagctccacctcacccagagcacctcccagccaccgtcccctcaagagcccccagaacgagaccctgtactctgtcttaaaggcctaaccaatggacagccctctcaagactgaatggtgaggccaggtacagtggcgcacacctgtaatcccagctactctgaagcctgaggcagaatcaagtgagcccaggagttcagggccagctttgataatggagcgagatgccatctctagttaaaaatatatattaacaataaagtaacaaatttaaaaa

SEQ ID NO: 21446 - DNA, 909 bp, Homo sapiens
acagccctcttcggagcctgagcccggctctcctcactcacctcaacccccaggcggcccctccacagggcccctctcctgcctggacggctctgctggtctccccgtcccctggagaagaacaaggccatgggtcggcccctgctgctgcccctactgcccttgctgctgccgccagcatttctgcagcctagtggctccacaggatctggtccaagctacctttatggggtcactcaaccaaaacacctctcagcctccatgggtggctctgtggaaatccccttctccttctattacccctgggagttagccacagctcccgacgtgagaatatcctggagacggggccacttccacaggcagtccttctacagcacaaggccgccttccattcacaaggattatgtgaaccggctctttctgaactggacagagggtcagaagagcggcttcctcaggatctccaacctgcagaagcaggaccagtctgtgtatttctgccgagttgagctggacacacggagctcagggaggcagcagtggcagtccatcgaggggaccaaactctccatcacccaggggaacccttccaaaacacagaggagccatatgagaatatcaggaatgaaggacaaaatacagatcccaagctaaatcccaaggatgacggcatcgtctatgcttcccttgccctctccagctccacctcacccagagcacctcccagccaccgtcccctcaagagcccccagaacgagaccctgtactctgtcttaaaggcctaaccaatggacagccctctcaagactgaatggtgaggccaggtacagtggcgcacacctgtaatcccagctactctgaagcctgaggcagaatcaagtgagcccaggagttcagggccagctt

SEQ ID NO: 21447 - DNA, 653 bp, Homo sapiens
gctgggtccctgaatcaccgactggaggagagttacctacaagagccttcatccaggagcatccacactgcaatgatataggaatgaggcggcccctccacagggcccctctcctgcctggacggctctgctggtctccccgtcccctggagaagaacaaggccatgggtcggcccctgctgctgcccctactgcccttgctgctgccgccagcatttctgcagcctagtggctccacaggatctggtccaagctacctttatggggtcactcaaccaaaacacctctcagcctccatgggtggctctgtggaaatccccttctccttctattacccctgggagttagccacagctcccgacgtgagaatatcctggagacggggccacttccacaggcagtccttctacagcacaaggccgccttccattcacaaggattatgtgaaccggctctttctgaactggacagagggtcagaagagcggcttcctcaggatctccaacctgcagaagcaggaccagtctgtgtatttctgccgagttgagctggacacacggagctcagggaggcagcagtggcagtccatcgaggggaccaaactctccatcacccagggtcagcagcggactaaagccacaaccccagccagg

SEQ ID NO: 21448 - DNA, 3634 bp, Homo sapiens
agaagggaggtagtcgccctccgtcgtggcctggcgtggattccgagcgttggtgtctggcggtttccgaccgttggtgtctggcacgcgccaccccgatgtaccaggtaaagccctatcacggggtcggcgcccctctccgtgtggagcccacctgcatgtactggctccccaacatgcacggcaggagcggcggcccagcactcggcactggccacttgcagacaagaagacaagaaaatgatttgaggacagcttcaatcgcggtgtgaagaagaaagcaacaaaacgaccactgaaaacaatgccggtggcaaaacatccaaagaaagggtcccaagtggtacatcgtcatagctggaaacagtcagagccaccagccaatgatcttttcaatgctgcgaaagctgccaaaagtgacatgcagtgtggccatgaggtctgccggaagtgacttgttggtgttatctcctgagttaaaatgtgaagggatttttttttttcagattactgagagtcttcagttactagaggcggatttccctgactgaagaccatgttgcaggcccacagctgcctacagaaccgtcccaaaatatggcaaagaaacctattctgagcgatagggtctcaccatgttgcccaggctggtcttgaactcctggactcatcctaaagtgctggcctctcattccctgtctgtgcacacctcacggcaagggccagcctgtttcctcccggtcacctccaaatcttgctgcttttaattcaactcagaggcctagccagggttgagttctcacccacctgtgccgccctgccttgttacctggaagcacagccttggggactgagcaggccctcactgtcactttaagaagggaatcagccactttgtgctcaccacctctggggaaggtgtgagaggagagaaggaagtggctgtttggctgctgacaacatgaagacttcctgcgatgagaacagaggcacaggtgccggccctgcagcccccagaacccggactggagggggccatggggcgccggaccctggccctgccctgggtgctgctgaccctgcgtgtcactgcagggaccccggaggtgtgagtacaagttcggatggaggccaccgagctctcgtccttcaccatccgttgtgggttcctggagtctggctccatctccctggtgactgcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccagggctctctgtcccgccgactcctgcccccattctgcgggcagacctggccgggatcttgggggtctcaggagtccttctctttgactgtggctacctccttcatctgctgtgccgacagaagcaccgccctgcccctaggctccagccatcccacaccagctcctaggcactgagagcacgagcatgggcacccagccaggcctcccaggctgctctccacgtcccttatgccactatcaacaccagctgctgcccagctactttggacacagctcacccccgacagggggccgtcctggtgggcatcactccccacccacaccgcacactggccccagggccctgctgcctgggcctccacatccatccctgcacatggcagctttgtctctgttgagaatggactctacgcttaggctgggcagaggcctccctgcactggtcctggcctcactcttttccctgacccttggggcccagggccatggagggacccttaggagttcaatgagagagaccatgaggccactgggctttccccttcccaggcctcctgggtgccacccccttacgttattcttgggcctctaataagtgtcccacaggtgcctggccaggcccacctgctgcagatgtggtctgtgtgtgtgcatgtgtgggtgtgtgtgggcacaggtgtgagtgtgtgagcaacagtaccccattccagtcgtttcctgctgtgactaagtcagcaacacagttcctctgacatgggccttggctgtgcttctttgggggtgaagagattggggaggaagtctccacccctgggaggcagaagccaggcatagcgcgctggctaggactccagtaccgtgaagggaggcagtgagagcagacatctgtgcctcattcctgatctcaaggggaaagcaagaacaagggaggcttcctcaggatctcgaacctgcggaaggaggaccagtctgtgtacttctgccaagtccagctggacatacagatcagggaggctgtcgtggcagtccatcaaggggacccacctcaccatcacccaggccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggtggctccacaggatctggtccaagctacctttatggggtcactcaaccaaaacacctctcagcctccatgggtggctctgtggaaatccccttctccttctattacccctgggagttagccatagttcccaacgtgagaatatcctggagacggggccacttccacgggcagtccttctacagcacaaggccgccttccattcacaaggattatgtgaaccggctctttctgaactggacagagggtcaggagagcggcttcctcaggatctcaaacctgcggaaggaggaccagtctgtgtatttctgccgagtcgagctggacacccggagatcagggaggcagcagttgcagtccatcaaggggaccaaactcaccatcacccaggctgtcacaaccaccaccacctggaggcccagcagcacaaccaccatagccggcctcagggtcacagaaagcaaagggcactcagaatcatggcacctaagtctggacactgccatcagggttgcattggctgtcgctgtgctcaaaactgtcattttgggactgctgtgcctcctcctcctgtggtggaggagaaggaaaggtagcagggcgccaagcagtgacttctgaccaacagagtgtggggagaagggatgtgtattagccccggaggacgtgatgtgagacccgcttgtgagtcctccacactcgttccccattggcaagatacatggagagcaccctgaggacctttaaaaggcaaagccgcaaggcagaaggaggctgggtccctgaatcaccgactggaggagagttacctacaagagccttcatccaggagcatccacactgcaatgatataggaatgaggtctgaactccactgaattaaaccactggcatttgggggctgtttattatagcagtgcaaagagttcctttatcctccccaaggatggaaaaatacaatttattttgcttaccatacaccccttttctcctcgtccacattttccaatctgtatggtggctgtcttctatggcagaaggttttggggaataaatagcgtgaaatgctgctgaca

SEQ ID NO: 21449 - DNA, 1373 bp, Homo sapiens
gatgccaccttactctggagaggatgggcagagcctcctatggagggagccctgtgggtcaccaaagctccagtgaccacccccgggcaaagacctgcagatcccctgttagagacgggcccaggactttgtgcggggtgcccactgttgctctgagccttcacttcctcagggaggcttcctcaggatctcgaacctgcggaaggaggaccagtctgtgtacttctgccaagtccagctggacatacagatcagccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggtggctccacaggatctggtccaagctacctttatggggtcactcaaccaaaacacctctcagcctccatgggtggctctgtggaaatccccttctccttctattacccctgggagttagccatagttcccaacgtgagaatatcctggagacggggccacttccacgggcagtccttctacagcacaaggccgccttccattcacaaggattatgtgaaccggctctttctgaactggacagagggtcaggagagcggcttcctcaggatctcaaacctgcggaaggaggaccagtctgtgtatttctgccgagtcgagctggacacccggagatcagggaggcagcagttgcagtccatcaaggggaccaaactcaccatcacccaggctgtcacaaccaccaccacctggaggcccagcagcacaaccaccatagccggcctcagggtcacagaaagcaaagggcactcagaatcatggcacctaagtctggacactgccatcagggttgcattggctgtcgctgtgctcaaaactgtcattttgggactgctgtgcctcctcctcctgtggtggaggagaaggaaaggtagcagggcgccaagcagtgacttctgaccaacagagtgtggggagaagggatgtgtattagccccggaggacgtgatgtgagacccgcttgtgagtcctccacactcgttccccattggcaagatacatggagagcaccctgaggacctttaaaaggcaaagccgcaaggcagaaggaggctgggtccctgaatcaccgactggaggagagttacctacaagagccttcatccaggagcatccacactgcaatgatataggaatgaggtctgaactccactgaattaaaccactggcatttgggggctgtttattatagcagtgcaaagagttcctttatcctccccaaggatggaaaaatacaatttattttgctta

SEQ ID NO: 21450 - DNA, 1506 bp, Homo sapiens
tgaagacttcctgcgatgagaacagaggcacaggtgccggccctgcagcccccagaacccggactggagggggccatggggcgccggaccctggccctgccctgggtgctgctgaccctgcgtgtcactgcagggaccccggaggtgtgagtacaagttcggatggaggccaccgagctctcgtccttcaccatccgttgtgggttcctggagtctggctccatctccctggtgactgcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccagggctctctgtcccgccgactcctgcccccattctgcgggcagacctggccgggatcttgggggtctcaggagtccttctctttgactgtggctacctccttcatctgctgtgccgacagaagcaccgccctgcccctaggctccagccatcccacaccagctcctaggcactgagagcacgagcatgggcacccagccaggcctcccaggctgctctccacgtcccttatgccactatcaacaccagctgctgcccagctactttggacacagctcacccccgacagggggccgtcctgtcgtttcctgctgtgactaagtcagcaacacagttcctctgacatgggccttggctgtgcttctttgggggtgaagagattggggaggaagtctccacccctgggaggcagaagccaggcatagcgcgctggctaggactccagtaccgtgaagggaggcagtgagagcagacatctgtgcctcattcctgatctcaaggggaaagcaagaacaagggaggcttcctcaggatctcgaacctgcggaaggaggaccagtctgtgtacttctgccaagtccagctggacatacagatcagggaggctgtcgtggcagtccatcaaggggacccacctcaccatcacccaggccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggtggctccacaggatctggtccaagctacctttatggggtcactcaaccaaaacacctctcagcctccatgggtggctctgtggaaatccccttctccttctattacccctgggagttagccatagttcccaacgtgagaatatcctggagacggggccacttccacgggcagtccttctacagcacaaggccgccttccattcacaaggattatgtgaaccggctctttctgaactggacagagggtcaggagagcggcttcctcaggatctcaaacctgcggaaggaggaccagtctgtgtatttctgccgagtcga

SEQ ID NO: 21451 - DNA, 2885 bp, Homo sapiens
ccaggcctagccagggttgagttctcacccacctgtgccgccctgccttgttacctggaagcacagccttggggactgagcaggccctcactgtcactttaagaagggaatcagccactttgtgctcaccacctctggggaaggtgtgagaggagagaaggaagtggctgtttggctgctgacaacatgaagacttcctgcgatgagaacagaggcacaggtgccggccctgcagcccccagaacccggactggagggggccatggggcgccggaccctggccctgccctgggtgctgctgaccctgcgtgtcactgcagggaccccggaggtgtgagtacaagttcggatggaggccaccgagctctcgtccttcaccatccgttgtgggttcctggagtctggctccatctccctggtgactgtgagcagggggggccccgatggtgctggggggaccacgctggctgtgttgcacccggaacttggcatccagcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccaggtggggccggggtgaggggtccaggagggcagggaggggctcgggaactggccatccatctgattcttgcctctgtgcccagggctctctgtcccgccgactcctgcccccattctgcgggcagacctggccgggatcttgggggtctcaggagtccttctctttgactgtggctacctccttcatctgctgtgccgacagaagcaccgccctgcccctaggctccagccatcccacaccagctcctaggcactgagagcacgagcatgggcacccagccaggcctcccaggctgctctccacgtcccttatgccactatcaacaccagctgctgcccagctactttggacacagctcacccccgacagggggccgtcctggtgggcatcactccccacccacaccgcacactggccccagggccctgctgcctgggcctccacatccatccctgcacatggcagctttgtctctgttgagaatggactctacgcttaggctgggcagaggcctccctgcactggtcctggcctcactcttttccctgacccttggggcccagggccatggagggacccttaggagttcaatgagagagaccatgaggccactgggctttccccttcccaggcctcctgggtgccacccccttacgttattcttgggcctctaataagtgtcccacaggtgcctggccaggcccacctgctgcagatgtggtctgtgtgtgtgcatgtgtgggtgtgtgtgggcacaggtgtgagtgtgtgagcaacagtaccccattccagtcgtttcctgctgtgactaagtcagcaacacagttcctctgacatgggccttggctgtgcttctttgggggtgaagagattggggaggaagtctccacccctgggaggcagaagccaggcatagcgcgctggctaggactccagtaccgtgaagggaggcagtgagagcagacatctgtgcctcattcctgatctcaaggggaaagcaagaacaagggaggcttcctcaggatctcgaacctgcggaaggaggaccagtctgtgtacttctgccaagtccagctggacatacagatcagccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggtggctccacaggatctggtccaagctacctttatggggtcactcaaccaaaacacctctcagcctccatgggtggctctgtggaaatccccttctccttctattacccctgggagttagccatagttcccaacgtgagaatatcctggagacggggccacttccacgggcagtccttctacagcacaaggccgccttccattcacaaggattatgtgaaccggctctttctgaactggacagagggtcaggagagcggcttcctcaggatctcaaacctgcggaaggaggaccagtctgtgtatttctgccgagtcgagctggacacccggagatcagggaggcagcagttgcagtccatcaaggggaccaaactcaccatcacccaggctgtcacaaccaccaccacctggaggcccagcagcacaaccaccatagccggcctcagggtcacagaaagcaaagggcactcagaatcatggcacctaagtctggacactgccatcagggttgcattggctgtcgctgtgctcaaaactgtcattttgggactgctgtgcctcctcctcctgtggtggaggagaaggaaaggtagcagggcgccaagcagtgacttctgaccaacagagtgtggggagaagggatgtgtattagccccggaggacgtgatgtgagacccgcttgtgagtcctccacactcgttccccattggcaagatacatggagagcaccctgaggacctttaaaaggcaaagccgcaaggcagaaggaggctgggtccctgaatcaccgactggaggagagttacctacaagagccttcatccaggagcatccacactgcaatgatataggaatgaggtctgaactccactgaattaaaccactggcatttgggggctgtttattatagcagtgcaaagagttcctttatcctccccaaggatggaaaaatacaatttattttgcttaccata

SEQ ID NO: 21452 - DNA, 1599 bp, Homo sapiens
tgaagacttcctgcgatgagaacagaggcacaggtgccggccctgcagcccccagaacccggactggagggggccatggggcgccggaccctggccctgccctgggtgctgctgaccctgcgtgtcactgcagggaccccggaggtgtgagtacaagttcggatggaggccaccgagctctcgtccttcaccatccgttgtgggttcctggagtctggctccatctccctggtgactgtgagcagggggggccccgatggtgctggggggaccacgctggctgtgttgcacccggaacttggcatccagcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccagggctctctgtcccgccgactcctgcccccattctgcgggcagacctggccgggatcttgggggtctcaggagtccttctctttgactgtggctacctccttcatctgctgtgccgacagaagcaccgccctgcccctaggctccagccatcccacaccagctcctaggcactgagagcacgagcatgggcacccagccaggcctcccaggctgctctccacgtcccttatgccactatcaacaccagctgctgcccagctactttggacacagctcacccccgacagggggccgtcctgtcgtttcctgctgtgactaagtcagcaacacagttcctctgacatgggccttggctgtgcttctttgggggtgaagagattggggaggaagtctccacccctgggaggcagaagccaggcatagcgcgctggctaggactccagtaccgtgaagggaggcagtgagagcagacatctgtgcctcattcctgatctcaaggggaaagcaagaacaagggaggcttcctcaggatctcgaacctgcggaaggaggaccagtctgtgtacttctgccaagtccagctggacatacagatcagggaggctgtcgtggcagtccatcaaggggacccacctcaccatcacccaggccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggtggctccacaggatctggtccaagctacctttatggggtcactcaaccaaaacacctctcagcctccatgggtggctctgtggaaatccccttctccttctattacccctgggagttagccatagttcccaacgtgagaatatcctggagacggggccacttccacgggcagtccttctacagcacaaggccgccttccattcacaaggattatgtgaaccggctctttctgaactggacagagggtcaggagagcggcttcctcaggatctcaaacctgcggaaggaggaccagtctgtgtatttctgccgagtcga

SEQ ID NO: 21453 - DNA, 772 bp, Homo sapiens
ctcctgggtgccacccccttacgttattcttgggcctctaataagtgtcccacaggtgcctggccaggcccacctgctgcagatgtggtctgtgtgtgtgcatgtgtgggtgtgtgtgggcacaggtgtgagtgtgtgagcaacagtaccccattccagtcgtttcctgctgtgactaagtcagcaacacagttcctctgacatgggccttggctgtgcttctttgggggtgaagagattggggaggaagtctccacccctgggaggcagaagccaggcatagcgcgctggctaggactccagtaccgtgaagggaggcagtgagagcagacatctgtgcctcattcctgatctcaaggggaaagcaagaacaagggaggcttcctcaggatctcgaacctgcggaaggaggaccagtctgtgtacttctgccaagtccagctggacatacagatcagggaggctgtcgtggcagtccatcaaggggacccacctcaccatcacccaggccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggattatgtgaaccggctctttctgaactggacagagggtcaggagagcggcttcctcaggatctcaaacctgcggaaggaggaccagtctgtgtatttctgccgagtcgagctgga

SEQ ID NO: 21454 - DNA, 603 bp, Homo sapiens
gcttgggctgggggctgagcgcctgtgacctccactggcttcctccttctcctctctgaggactgaatctggggtgcagcagagcacagactcaggcccgcctttcctctccctgaaagagcctgcgctggccttggacagagaaagggatgagaaccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggtggctccacaggatctggtccaagctacctttatggggtcactcaaccaaaacacctctcagcctccatgggtggctctgtggaaatccccttctccttctattacccctgggagttagccatagttcccaacgtgagaatatcctggagacggggccacttccacgggcagtccttctacagcacaaggccgccttccattcacaaggattatgtgaaccggctctttctgaactggacagagggtcaggagagcggcttcctcaggatctcaaacctgcggaaggaggaccagtctg

SEQ ID NO: 21455 - DNA, 1364 bp, Homo sapiens
tgaagacttcctgcgatgagaacagaggcacaggtgccggccctgcagcccccagaacccggactggagggggccatggggcgccggaccctggccctgccctgggtgctgctgaccctgcgtgtcactgcagggaccccggaggtgtgagtacaagttcggatggaggccaccgagctctcgtccttcaccatccgttgtgggttcctggagtctggctccatctccctggtgactgtgagcagggggggccccgatggtgctggggggaccacgctggctgtgttgcacccggaacttggcatccagcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccagggctctctgtcccgccgactcctgcccccattctgcgggcagacctggccgggatcttgggggtctcaggagtccttctctttgactgtggctacctccttcatctgctgtgccgacagaagcaccggcatagcgcgctggctaggactccagtaccgtgaagggaggcagtgagagcagacatctgtgcctcattcctgatctcaaggggaaagcaagaacaagggaggcttcctcaggatctcgaacctgcggaaggaggaccagtctgtgtacttctgccaagtccagctggacatacagatcagggaggctgtcgtggcagtccatcaaggggacccacctcaccatcacccagggtgagtccagctgccctggcaccaaggaaccttcctggttcagccataggctcagccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggtggctccacaggatctggtccaagctacctttatggggtcactcaaccaaaacacctctcagcctccatgggtggctctgtggaaatccccttctccttctattacccctgggagttagccatagttcccaacgtgagaatatcctggagacggggccacttccacgggcagtccttctacagcacaaggccgccttccattcacaaggattatgtgaaccggctctttctgaactggacagagggtcaggagagcggcttcctcaggatctcaaacctgcggaaggaggaccagtctgtgtatttctgccgagtcga

SEQ ID NO: 21456 - DNA, 1414 bp, Homo sapiens
gcttctttgggggtgaagagattggggaggaagtctccacccctgggaggcagaagccaggcatagcgcgctggctaggactccagtaccgtgaagggaggcagtgagagcagacatctgtgcctcattcctgatctcaaggggaaagcaagaacaagggaggcttcctcaggatctcgaacctgcggaaggaggaccagtctgtgtacttctgccaagtccagctggacatacagatcagggaggctgtcgtggcagtccatcaaggggacccacctcaccatcacccaggccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggtggctccacaggatctggtccaagctacctttatggggtcactcaaccaaaacacctctcagcctccatgggtggctctgtggaaatccccttctccttctattacccctgggagttagccatagttcccaacgtgagaatatcctggagacggggccacttccacgggcagtccttctacagcacaaggccgccttccattcacaaggattatgtgaaccggctctttctgaactggacagagggtcaggagagcggcttcctcaggatctcaaacctgcggaaggaggaccagtctgtgtatttctgccgagtcgagctggacacccggagatcagggaggcagcagttgcagtccatcaaggggaccaaactcaccatcacccaggctgtcacaaccaccaccacctggaggcccagcagcacaaccaccatagccggcctcagggtcacagaaagcaaagggcactcagaatcatggcacctaagtctggacactgccatcagggttgcattggctgtcgctgtgctcaaaactgtcattttgggactgctgtgcctcctcctcctgtggtggaggagaaggaaaggtagcagggcgccaagcagtgacttctgaccaacagagtgtggggagaagggatgtgtattagccccggaggacgtgatgtgagacccgcttgtgagtcctccacactcgttccccattggcaagatacatggagagcaccctgaggacctttaaaaggcaaagccgcaaggcagaaggaggctgggtccctgaatcaccgactggaggagagttacctacaagagccttcatccaggagcatccacactgcaatgatataggaatgaggtctgaactccactgaattaaaccactggcatttgggggctgtttattatagcagtgcaaagagttcctttatcctccccaaggatggaaaaatacaatttattttgcttaccat

SEQ ID NO: 21457 - DNA, 2661 bp, Homo sapiens
gcgcccctctccgtgtggagcccacctgcatgtactggctccccaacatgcacggcaggagcggcggcccagcactcggcactggccacttgcagacaagaagacaagaaaatgatttgaggacagcttcaatcgcggtgtgaagaagaaagcaacaaaacgaccactgaaaacaatgccggtggcaaaacatccaaagaaagggtcccaagtggtacatcgtcatagctggaaacagtcagagccaccagccaatgatcttttcaatgctgcgaaagctgccaaaagtgacatgcagtgtggccatgaggtctgccggaagtgacttgttggtgttatctcctgagttaaaatgtgaagggatttttttttttcagattactgagagtcttcagttactagatccagacacggggactgcagagaaaggctgtgtgcatccgctgtctactccactgtctcctctgcagaggcggatttccctgactgaagaccatgttgcaggcccacagctgcctacagaaccgtcccaaaatatggcaaagaaacctattctgagcgatagggtctcaccatgttgcccaggctggtcttgaactcctggactcatcctaaagtgctggcctctcattccctgtctgtgcacacctcacggcaagggccagcctgtttcctcccggtcacctccaaatcttgctgcttttaattcaactcagagaagggaatcagccactttgtgctcaccacctctggggaaggtgtgagaggagagaaggaagtggctgtttggctgctgacaacatgaagacttcctgcgatgagaacagaggcacaggtgccggccctgcagcccccagaacccggactggagggggccatggggcgccggaccctggccctgccctgggtgctgctgaccctgcgtgtcactgcagggaccccggaggtgtgagtacaagttcggatggaggccaccgagctctcgtccttcaccatccgttgtgggttcctggagtctggctccatctccctggtgactgtgagcagggggggccccgatggtgctggggggaccacgctggctgtgttgcacccggaacttggcatccagcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccagggctctctgtcccgccgactcctgcccccattctgcgggcagacctggccgggatcttgggggtctcaggagtccttctctttgactgtggctacctccttcatctgctgtgccgacagaagcaccgccctgcccctaggctccagccatcccacaccagctcctaggcactgagagcacgagcatgggcacccagccaggcctcccaggctgctctccacgtcccttatgccactatcaacaccagctgctgcccagctactttggacacagctcacccccgacagggggccgtcctggcatagcgcgctggctaggactccagtaccgtgaagggaggcagtgagagcagacatctgtgcctcattcctgatctcaaggggaaagcaagaacaagggaggcttcctcaggatctcgaacctgcggaaggaggaccagtctgtgtacttctgccaagtccagctggacatacagatcagggaggctgtcgtggcagtccatcaaggggacccacctcaccatcacccaggccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggattatgtgaaccggctctttctgaactggacagagggtcaggagagcggcttcctcaggatctcaaacctgcggaaggaggaccagtctgtgtatttctgccgagtcgagctggacacccggagatcagggaggcagcagttgcagtccatcaaggggaccaaactcaccatcacccaggctgtcacaaccaccaccacctggaggcccagcagcacaaccaccatagccggcctcagggtcacagaaagcaaagggcactcagaatcatggcacctaagtctggacactgccatcagggttgcattggctgtcgctgtgctcaaaactgtcattttgggactgctgtgcctcctcctcctgtggtggaggagaaggaaaggtagcagggcgccaagcagtgacttctgaccaacagagtgtggggagaagggatgtgtattagccccggaggacgtgatgtgagacccgcttgtgagtcctccacactcgttccccattggcaagatacatggagagcaccctgaggacctttaaaaggcaaagccgcaaggcagaaggaggctgggtccctgaatcaccgactggaggagagttacctacaagagccttcatccaggagcatccacactgcaatgatataggaatgaggtctgaactccactgaattaaaccactggcatttgggggctgttta

SEQ ID NO: 21458 - DNA, 2314 bp, Homo sapiens
cacctctggggaaggtgtgagaggagagaaggaagtggctgtttggctgctgacaacatgaagacttcctgcgatgagaacagaggcacaggtgccggccctgcagcccccagaacccggactggagggggccatggggcgccggaccctggccctgccctgggtgctgctgaccctgcgtgtcactgcagggaccccggaggtgtgagtacaagttcggatggaggccaccgagctctcgtccttcaccatccgttgtgggttcctggagtctggctccatctccctggtgactgtgagcagggggggccccgatggtgctggggggaccacgctggctgtgttgcacccggaacttggcatccagcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccaggtggggccggggtgaggggtccaggagggcagggaggggctcgggaactggccatccatctgattcttgcctctgtgcccagggctctctgtcccgccgactcctgcccccattctgcgggcagacctggccgggatcttgggggtctcaggagtccttctctttgactgtggctacctccttcatctgctgtgccgacagaagcaccgccctgcccctaggctccagccatcccacaccagctcctaggcactgagagcacgagcatgggcatagcgcgctggctaggactccagtaccgtgaagggaggcagtgagagcagacatctgtgcctcattcctgatctcaaggggaaagcaagaacaagacctgtgaagggaaggagggtggatcggcctgactggccctgggaagcacagaggagcctactgggaccagggaagagactgacaagagaagggaggcctgtccctgcctgcttctgtctcaagaagattgttatcacttcctctggtgaaatcctgccttcctgtccccacggcccctcagctgatgccaccttactctggagaggatgggcagagcctcctatggagggagccctgtgggtcaccaaagctccagtgaccacccccgggcaaagacctgcagatcccctgttagagacgggcccaggactttgtgcggggtgcccactgttgctctgagccttcacttcctcagggaggcttcctcaggatctcgaacctgcggaaggaggaccagtctgtgtacttctgccaagtccagctggacatacagatcagggaggctgtcgtggcagtccatcaaggggacccacctcaccatcacccaggccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggattatgtgaaccggctctttctgaactggacagagggtcaggagagcggcttcctcaggatctcaaacctgcggaaggaggaccagtctgtgtatttctgccgagtcgagctggacacccggagatcagggaggcagcagttgcagtccatcaaggggaccaaactcaccatcacccaggctgtcacaaccaccaccacctggaggcccagcagcacaaccaccatagccggcctcagggtcacagaaagcaaagggcactcagaatcatggcacctaagtctggacactgccatcagggttgcattggctgtcgctgtgctcaaaactgtcattttgggactgctgtgcctcctcctcctgtggtggaggagaaggaaaggtagcagggcgccaagcagtgacttctgaccaacagagtgtggggagaagggatgtgtattagccccggaggacgtgatgtgagacccgcttgtgagtcctccacactcgttccccattggcaagatacatggagagcaccctgaggacctttaaaaggcaaagccgcaaggcagaaggaggctgggtccctgaatcaccgactggaggagagttacctacaagagccttcatccaggagcatccacactgcaatgatataggaatgaggtctgaactccactgaattaaaccactggcatttgggggctgtttattatagcagtgcaaagagttcctttatcctccccaaggatggaaaaatacaatttattttgcttaccata

SEQ ID NO: 21459 - DNA, 2099 bp, Homo sapiens
tgagttctcacccacctgtgccgccctgccttgttacctggaagcacagccttggggactgagcaggccctcactgtcactttaagaagggaatcagccactttgtgctcaccacctctggggaaggtgtgagaggagagaaggaagtggctgtttggctgctgacaacatgaagacttcctgcgatgagaacagaggcacaggtgccggccctgcagcccccagaacccggactggagggggccatggggcgccggaccctggccctgccctgggtgctgctgaccctgcgtgtcactgcagggaccccggaggtgtgagtacaagttcggatggaggccaccgagctctcgtccttcaccatccgttgtgggttcctggagtctggctccatctccctggtgactgtgagcagggggggccccgatggtgctggggggaccacgctggctgtgttgcacccggaacttggcatccagcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccagggctctctgtcccgccgactcctgcccccattctgcgggcagacctggccgggatcttgggggtctcaggagtccttctctttgactgtggctacctccttcatctgctgtgccgacagaagcaccgccctgcccctaggctccagccatcccacaccagctcctaggcactgagagcacgagcatggggaggcttcctcaggatctcgaacctgcggaaggaggaccagtctgtgtacttctgccaagtccagctggacatacagatcagggaggctgtcgtggcagtccatcaaggggacccacctcaccatcacccaggccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggtggctccacaggatctggtccaagctacctttatggggtcactcaaccaaaacacctctcagcctccatgggtggctctgtggaaatccccttctccttctattacccctgggagttagccatagttcccaacgtgagaatatcctggagacggggccacttccacgggcagtccttctacagcacaaggccgccttccattcacaaggattatgtgaaccggctctttctgaactggacagagggtcaggagagcggcttcctcaggatctcaaacctgcggaaggaggaccagtctgtgtatttctgccgagtcgagctggacacccggagatcagggaggcagcagttgcagtccatcaaggggaccaaactcaccatcacccaggctgtcacaaccaccaccacctggaggcccagcagcacaaccaccatagccggcctcagggtcacagaaagcaaagggcactcagaatcatggcacctaagtctggacactgccatcagggttgcattggctgtcgctgtgctcaaaactgtcattttgggactgctgtgcctcctcctcctgtggtggaggagaaggaaaggtagcagggcgccaagcagtgacttctgaccaacagagtgtggggagaagggatgtgtattagccccggaggacgtgatgtgagacccgcttgtgagtcctccacactcgttccccattggcaagatacatggagagcaccctgaggacctttaaaaggcaaagccgcaaggcagaaggaggctgggtccctgaatcaccgactggaggagagttacctacaagagccttcatccaggagcatccacactgcaatgatataggaatgaggtctgaactccactgaattaaaccactggcatttgggggctgtttattatagcagtgcaaagagttcctttatcctccccaaggatggaaaaatacaatttattttgcttaccata

SEQ ID NO: 21460 - DNA, 902 bp, Homo sapiens
ctgcgggcagacctggccgggatcttgggggtctcaggagtccttctctttgactgtggctacctccttcatctgctgtgccgacagaagcaccgccctgcccctaggctccagccatcccacaccagctcctaggcactgagagcacgagcatggtcgtttcctgctgtgactaagtcagcaacacagttcctctgacatgggccttggctgtgcttctttgggggtgaagagattggggaggaagtctccacccctgggaggcagaagccaggcatagcgcgctggctaggactccagtaccgtgaagggaggcagtgagagcagacatctgtgcctcattcctgatctcaaggggaaagcaagaacaagacctgtgaagggaaggagggtggatcggcctgactggccctgggaagcacagaggagcctactgggaccagggaagagactgacaagagaagggaggcctgtccctgcctgcttctgtctcaagaagattgttatcacttcctctggtgaaatcctgccttcctgtccccacggcccctcagctgatgccaccttactctggagaggatgggcagagcctcctatggagggagccctgtgggtcaccaaagctccagtgaccacccccgggcaaagacctgcagatcccctgttagagacgggcccaggactttgtgcggggtgcccactgttgctctgagccttcacttcctcagggaggcttcctcaggatctcgaacctgcggaaggaggaccagtctgtgtacttctgccaagtccagctggacatacagatcagggaggctgtcgtggcagtccatcaaggggacccacctcaccatcacccaggccctcaggcagcccctccacagggcccctctcctgcctgg

SEQ ID NO: 21461 - DNA, 2074 bp, Homo sapiens
gctcaccacctctggggaaggtgtgagaggagagaaggaagtggctgtttggctgctgacaacatgaagacttcctgcgatgagaacagaggcacaggtgccggccctgcagcccccagaacccggactggagggggccatggggcgccggaccctggccctgccctgggtgctgctgaccctgcgtgtcactgcagggaccccggaggtgtgagtacaagttcggatggaggccaccgagctctcgtccttcaccatccgttgtgggttcctggagtctggctccatctccctggtgactgtgagcagggggggccccgatggtgctggggggaccacgctggctgtgttgcacccggaacttggcatccagcaatgggcccctgctcgccaggcccgctgggaaacccagagcagcatctctctcatcctggaaggctctggggccagcagcccctgcgccaacaccaccttctgctgcaagtttgcgtccttccctgagggctcctgggaggcctgtgggagcctcccgcccagctcagacccagggctctctgtcccgccgactcctgcccccattctgcgggcagacctggccgggatcttgggggtctcaggagtccttctctttgactgtggctacctccttcatctgctgtgccgacagaagcaccgccctgcccctaggctccagccatcccacaccagctcctaggcactgagagcacgagcatgggcacccagccaggcctcccaggctgctctccacgtcccttatgccactatcaacaccagctgctgcccagctactttggacacagctcacccccgacagggggccgtcctggtgggcatcactccccacccacaccgcacactggccccagggccctgctgcctgggcctccacatccatccctgcacatggcagctttgtctctgttgagaatggactctacgcttaggctgggcagaggcctccctgcactggtcctggcctcactcttttccctgacccttggggcccagggccatggagggacccttaggagttcaatgagagagaccatgaggccactgggctttccccttcccaggcctcctgggtgccacccccttacgttattcttgggcctctaataagtgtcccacaggtgcctggccaggcccacctgctgcagatgtggtctgtgtgtgtgcatgtgtgggtgtgtgtgggcacaggtgtgagtgtgtgagcaacagtaccccattccagtcgtttcctgctgtgactaagtcagcaacacagttcctctgacatgggccttggctgtgcttctttgggggtgaagagattggggaggaagtctccacccctgggaggcagaagccaggcatagcgcgctggctaggactccagtaccgtgaagggaggcagtgagagcagacatctgtgcctcattcctgatctcaaggggaaagcaagaacaagggaggcttcctcaggatctcgaacctgcggaaggaggaccagtctgtgtacttctgccaagtccagctggacatacagatcagggaggctgtcgtggcagtccatcaaggggacccacctcaccatcacccaggccctcaggcagcccctccacagggcccctctcctgcctggacagctctgctggtctccccgtcccctggagaagaacaaggccatgggtcggcccctgctgctgcccctgctgctcctgctgcagccgccagcatttctgcagcctggtggctccacaggatctggtccaagctacctttatggggtcactcaaccaaaacacctctcagcctccatgggtggctctgtggaaatccccttctccttctattacccctgggagttagccatagttcccaacgtgagaatatcctggagacggggccacttccacgggcagtccttctacagcacaaggccgccttccattcacaaggattatgtgaaccggctctttctgaactggacagagggtcaggagagcggcttcctcaggatctcaaacctgcggaaggaggaccagtctgtgtatttctgccgagtcga

SEQ ID NO: 21462 - DNA, 4284 bp, Homo sapiens
tttttaatattgtattttactgtggattatctctttggaccgcgccggacttggcctcaggaaatcaaccaatgctgcggaaggcggctggtgcacaacgctctgctctacagaagggggtcccccaccctcttttccaattttttttttttggccttcctctccttccctccctcttcctccctctctctctctctctctccactacccccctctttcttccccactcggctcctctcccccctcgcgcccacagcgtttggtgttgattcgagcgggaagaggggggtgggtgggatcggtgggggagaccatgacctccagctacgggcacgttctggagcggcaaccggcgctgggcggccgcttggacagcccgggcaacctcgacaccctgcaggcgaaaaagaacttctccgtcagtcacctgctagacctggaggaagccggggacatggtggcggcacaggcggatgagaacgtgggcgaggctggccggagcctgctggagtcgccgggactcaccagcggcagcgacaccccgcagcaggacaatgaccagctgaactcagaagaaaaaaagaagagaaagcagcgaaggaataggacaaccttcaatagcagccagctgcaggctttggagcgtgtctttgagcggacacactatcctgatgcttttgtgcgagaagaccttgcccgccgggtgaacctcaccgaggcgagagtgcaggtgtggtttcagaaccgaagagccaagttccgcaggaatgagagagccatgctagccaataaaaacgcttccctcctcaaatcctactcaggagacgtgactgctgtggagcagcccatcgtacctcgtcctgctccgagacccaccgattatctctcctgggggacagcgtctccgtacagcgccatggctacttattctgccacatgtgccaacaatagccctgcacagggcatcaacatggccaacagcattgccaacctgagactgaaggccaaggaatatagtttacagaggaaccaggtgccaacagtcaactgaggaaaaaaaataattaaacaggcctaagaagaaatcaaaaaccataagacacctatcctgctctgttatttcttcatctgctggggggaaaaagtaaattacaaacaaacaaacaaagcagaactaaaatattgggaccatggcagagaaaagcaggagaggagcaaaatgaaaattagttaacaaatgttcctcctccctctgggataccaccaccacttgtttctgtgtgtgtttattttgtttttctttcattcatgctttgcttaatgtactccaggcttcttcagataggttcagcccacccacccccatgattgtatgaagttttaaaaaaaactacagcagccaaagaaactatatatatatatatatatatatatatccagaatgattgcctctactgtcctcattgacttgtttgaaccttagtgccttaccctgtcctcttcccagttctctttatagaagctctaggagctttcgaaaagccaaagtctttctgaagaatctgtgctggacagacataattccctttctcattgtctccatctttgttggtcatggtaaggtttttccatcagcctctgaaaaaatagttgtgcacaacatctgctcactggactgtctgatccaatgtaattggctgcgtctggctaattctaagcactaaagtctacatctaagctatagatttaagcttgaagctacagattatatcactatcaccaccacccctcaccctatgcaatcaatcaatcaatcatcttaagttaaagatatttgttgtctttgaatgatttgctgtcacagactatttggtagaagaaatatttttcacctgagagaggaagagaaatttctctagtaacacaaagagtgagttctaaaaggcatgcccacatctctttcgtgccttaaggatagtgagatgcacacttatatatatactgtatatatttatatatttatatatatatttcatatatatatataatattgcaagcttaagtttgcaatttcccaaacaatacaaaaagcaaattacacaccctcaccactgttcttatctctatagtgatgaaacattaattagggatcttgctgcttttctttttctacacgaagttttcattaaagccacagaataattgatagggcagctgtttgagaacaggtcccattttcacattagggctttaaatgaattagaaactatttgaggctataaaaatgtccttgagtttggagcctgagctctggtgaaatgctgatacatctgatctatcatgggaattgcagttagagagagtaaggaataccatttagtcatctatccgttcttcacttagcaggaatatgaaagaaaggcacatgtttaagaggaatacctaaaggtttttctaaattccaacatttaaaaggcaattgtgggctatttttattttttaatattttgaaataaagtttagtgtctagggctgggagccaggactgatcttccatttctttttctttgttcccagccatgcttttgtaacttgccaggtggacttgaccaactacattaccatgctgtgcctcagtttacccatttgtaaaatgggattaataatacttacctacctcacaggggtgttgtgaggctctattcatttgctcctttattctttcctgtattctctgtatgtccagcactttgtagccatgggaggaaagggactataaaagtgtacaatgttaatggaatgatacggtacctgaaagccttgttttctagtaagaaaatgctaccttgctgtacatacttataaccttgtatttggaaatgagaaataggtttatattttcagatctctcaaaaatcacatcatttgaccaaagaataatttaagacacatagaacagatttttttaatttatattttcatcctgaccagcttagttctaataatttttagttgtgagtgattaaaaaactttggatcaattttggtcaaacatgccaactttgtagtctgagtgacaggcaaggatttttgggtttaagatgcacttttagcacacatttgtatttcccttggcatatcagattgagctaatggtgatgttatttcaatctaacagccaccaatctgaaattgtatttcaaatgttgattctgtagttctttaaataataatgaagctcatcttatacattttgctttcaccaattgattccttcttcttttagcccactattaaaacatttcttactgaatggttcatgtaggcttgctgaacagcacgcattacttgcttcctgaagagttcccccattcatccatttgtcccattagttgctgtggattatcaagttttgaaggaactgtacatcccaacagactgaaacattctaagtgaaatgagtataatccaagtaactggtgaactttggaggtttggagcttgaagagaatggctaagaagatttgaattatagggagggaacagaaatcatacatgaaaaggttttactgagaaggggaaaaccttagatagagggacatgtgaaacaaaatcatttgaaattttgattcagacatccatttccagtggcaaacagcaaagcctgaacccataaacccaaatgataggtgaagttgggtggttttatccaatgtctcaagcaagcaatgtctgggaatatcatagagtaacaagtgctggtcagccaaagaaacattcactgctggtgaaccaataccataagcatgtattatctaagcacttgatcaagaaatatacatgttgtacaagctctcaattttgttcatttattatcaaatttttaaaatacaagtttggtatgtgatttggaaaagatgccttctggatcttaagccagttgtcagtggaggtcctcagggctgcaaatgtcaagacataaccctgttcctcaccatcatgataccagatacaggtgaatacataggaactatctgcctgtgtcctcaatctcccttcaaacaagatgctgatttgtagggtacttggcaggttaaattaaaccagaagaggtgacttaataaaaaagggaatgacatttagggtataaagatctcataagaaatgtaatatgtaaattatatcttgctttatgttgtaaaatatacattgtttgcgctagaatagaaatgatttcttttcaataaaaagaaagaaggactctaccatgtcttttgttatata

SEQ ID NO: 21463 - DNA, 2217 bp, Homo sapiens
gatgttggcaaagggggttttcttaatcagactgttttttggtcccagggaaaggaggaagaaggagattgtgatggagaaagggggtctgtgaaacgtcaggcacagcacaaaggctttgccacgtaattacaggctcctattaagtcgagatctgccctcccaggggtctccaattttcttgtattccctacaaagcctcctctgcatgccagtttgtgccttttgaagtgccagagagcttcttgatccaactgagaaggaaaaaggagcccagcaagaagagggggagagagagaaggggaaaggggggaacccaccagcaccctccgtcggactcttgaagccttttttttttaattcttaatttttttttttactctttacaaaaagtaaagtgagaatcctgctctctaatacatctgcaagacatcaccctctcctcctgaaactttagtcactcctgagaatccacaggagtgcagagaggggggaacacgttttcttgaagatgttttaaagctggaacaagccttcttctgttggtgcttgaactcttgcctgggaataacttttttaacctttaaaaaaaccattcactttgattcttctctcccaccccttcttctctcttcttctgtttgcctaactcccccgccctgctggcctccgctttcctctctcccccttgttattatttttagtctgtgcgtgtggacacttttggagagttggaagggatttttttctcctgacttgaacatagggtgactttttaatattgtattttactgtggattatctctttggaccgcgccggacttggcctcaggaaatcaaccaatgctgcggaaggcggctggtgcacaacgctctgctctacagaagggggtcccccaccctcttttccaattttttttttttggccttcctctccttccctccctcttcctccctctctctctctctctctccactacccccctctttcttccccactcggctcctctcccccctcgcgcccacagcgtttggtgttgattcgagcgggaagaggggggtgggtgggatcggtgggggagaccatgacctccagctacgggcacgttctggagcggcaaccggcgctgggcggccgcttggacagcccgggcaacctcgacaccctgcaggcgaaaaagaacttctccgtcagtcacctgctagacctggaggaagccggggacatggtggcggcacaggcggatgagaacgtgggcgaggctggccggagcctgctggagtcgccgggactcaccagcggcagcgacaccccgcagcaggacaatgaccagctgaactcagaagaaaaaaagaagagaaagcagcgaaggaataggacaaccttcaatagcagccagctgcaggctttggagcgtgtctttgagcggacacactatcctgatgcttttgtgcgagaagaccttgcccgccgggtgaacctcaccgaggcgagagtgcaggtgtggtttcagaaccgaagagccaagttccgcaggaatgagagagccatgctagccaataaaaacgcttccctcctcaaatcctactcaggagacgtgactgctgtggagcagcccatcgtacctcgtcctgctccgagacccaccgattatctctcctgggggacagcgtctccgtacagatcctcgtccctcccaagatgttgtttacacgaggggcttcataacggattctaacggaagacactgaaaagcgccatggctacttattctgccacatgtgccaacaatagccctgcacagggcatcaacatggccaacagcattgccaacctgagactgaaggccaaggaatatagtttacagaggaaccaggtgccaacagtcaactgaggaaaaaaaataattaaacaggcctaagaagaaatcaaaaaccataagacacctatcctgctctgttatttcttcatctgctggggggaaaaagtaaattacaaacaaacaaacaaagcagaactaaaatattgggaccatggcagagaaaagcaggagaggagcaaaatgaaaattagttaacaaatgttcctcctccctctgggataccaccaccacttgtttctgtgtgtgtttattttgtttttctttcattcatgctttgcttaatgtactccaggcttcttcagataggttcagcccacccacccccatgattgta

SEQ ID NO: 21464 - DNA, 1233 bp, Homo sapiens
cgcagcgcgtgcaccagcggctccggagcgagcggccgtggctgagaaggggagggcggaaagtttgtttccccgacgtcagcgccgggcgggccgcgaggctaggaggcggcgggagctgggcagagcgcggggcggccggggctctcgctccgacccgcgcccgcgacccttcctgggacccgagcccgagacccccgccggcccccccggggccgctcgcgggcatggacagcgcggccgccgccttcgccctggacaagccggcgctgggcccggggccgccgccgcctccacccgcgctggggcccggcgactgcgcccaggcgcgcaagaacttctcggtgagccacctcctggacctggaagaggtggcggcggccgggcggctggcggcgcgccccggggccagggccgaggcgcgggagggcgcagcacgggagccgtccgggggcagcagcggcagcgaggcggcgccgcaggatggtgagtgtcccagcccggggcgcggtagcgccgccaagcggaagaagaagcagcggcggaaccgcaccacgttcaacagcagccaactgcaggcgctggagcgcgtgttcgagcgcacgcactaccccgacgcctttgtgcgcgaggagcttgcccggcgcgtcaacctcagcgaggcgcgcgttcaggtctggtttcagaaccgccgcgccaagttccgcaggaatgaaagggccatgctggccagccgctctgcctcgctgctcaagtcctacagccaggaggccgccatcgagcagcccgtggctccccggcccaccgccctgagtccagattatctctcctggacagcctcgtccccctacagcacagtgccaccctacagccctgggagctcaggccccgcaaccccaggggtcaacatggccaacagcatcgccagcctccgtctcaaggccaaggagttcagcctgcaccacagccaggtgcctacggtgaactgaagtccagtcccaccaggacccagacgcctccctgggtggacagcaatagaaaagggggcagacgcccaggaagtgaccttctcctggatgagctctcctggcccgtctgtccagcctggactcccgagcccacgaggctgttgaggcccctgcagccgggcccagctcttctgtccttggccaccagagactgcagcccacaacccttggaggggttgggccggaaggtggaagagcctgccaa

SEQ ID NO: 21465 - DNA, 1699 bp, Homo sapiens
acttgcgttgcacccgggctgagtgcggccgcgacggggcgggcggactctcgggcgctcagagctggcctcgggtcctcggagcctggcgctcgaacctcccttccgacctccacccggaccccgaccccgacccggcctggcccggcccccgcccccgccccccgggccgatggactactcctacctcaattcgtacgactcgtgcgtggcggccatggaggcgtccgcctacggcgactttggcgcctgcagccagcccggcggcttccaatacagccccctgcggcccgctttccccgcggcagggccgccctgccccgcgctcggctcctccaactgcgcacttggcgccctacgcgaccaccagcccgcgccctactcggcagtgccctacaagttcttcccagagccatccggcctgcacgagaagcgcaagcagcggcgcatccgcaccacgttcaccagcgcgcagctcaaggagctggagcgcgttttcgctgagacccactaccccgacatttacacgcgtgaggagctggcgctcaagatcgacctcactgaggctcgcgtgcaggtctggttccagaaccgccgggccaagttccgcaaacaggagcgcgcggccagcgccaagggcgcggcgggcgcggcgggcgccaaaaagggcgaggcgcgctgctcctccgaggacgacgattccaaggagtccacgtgcagccccacgcccgatagcaccgcctcgctgccgccgccgcctgcgcccggcctggccagcccgcgcctgagccccagcccgctgcccgtcgcactgggctccgggccgggacctgggccggggccacagccgctcaagggcgcactgtgggccggtgtggcgggcggtgggggcggcgggcctggcgcgggagcggccgaactacttaaggcttggcagccggcggagtccggccccgggcccttctccggggttctgtcctcctttcaccggaagcccggccccgccctgaagaccaatctcttctagctgccggcctctggaggctccgagcctgcccccagagacgtccctgcccctccaggacctgacagcccctcccatcctggccacccgcctggaagtccccatccgtctccactccctactgtctcacccctcggtgtgtcctccccaactttggagaccaagtcagggccactctcgtcctcacccaccctctaccagcagagcggagttctttataccgggacctcctccaggagaaccccggagctccttctagcttggccttctttggatgcggtatcacatgaggcctgtccctaacagtgccctcaaagtgaaggtcctcaaggaggatcggcacagcccccttccctggctctgcagcggctgggtcaccccttacgctggtgatcaggaaagcccgctgccccacccctcgggcccacccgtacagaggctggtggtcgccgggataattaatgaccaccgccaattcatccctcacgtgtctcctctcttccctagcccgtctggcacagagggtggacctgttagaggagtggaggggctgcctggggaatgggacagagggattctctttccctaatttttttggttgtcctttttctttgaaaaacttgtaatttattgaagttttactcaatccaaataaaacttaatttattgaagaca

SEQ ID NO: 21466 - DNA, 3030 bp, Homo sapiens
ttaaattctaattagagatgcaggaatcaatgatagggaggttggacagctcagttccccagtgccagcccaatagacggatgagttattgtcatgtaaaaagcgccagcaataagaccaaccgctttgctattgtccaagtggaaagagccaagtttattatgaggactatatgctctagagacctcagacaaggcatctcataggaggctttttcataaaactaggctctgctggtagtaaggaggccagtttggaggcaggcgttgagctgtgcacatctccccactccagccaccttctccatatccatcttttatttcatttttccacttggctgagccatccagaaccttttcaatgtataaaatggaatattcttacctcaattcctctgcctacgagtcctgtatggctgggatggacacctcgagcctggcttcagcctatgctgacttcagttcctgcagccaggccagtggcttccagtataacccgataaggaccacttttggggccacgtccggctgcccttccctcacgccgggatcctgcagcctgggcaccctcagggaccaccagagcagtccgtacgccgcagttccttacaaactcttcacggaccacggcggcctcaacgagaagcgcaagcagcggcgcatccgcaccactttcaccagtgcccagctcaaagagctggaaagggtcttcgcggagactcactaccccgacatctacactcgggaggagctggccctgaagatcgacctcacagaggcgcgagtccaggtgtggttccagaaccgccgcgccaagtttcgcaagcaggagcgcgcagcggcagccgcagcggccgcggccaagaacggctcctcgggcaaaaagtctgactcttccagggacgacgagagcaaagaggccaagagcactgacccggacagcactgggggcccaggtcccaatcccaaccccacccccagctgcggggcgaatggaggcggcggcggcgggcccagcccggctggagctccgggggcggcggggcccgggggcccgggaggcgaacccggcaagggcggcgcagcagcagcggcggcggccgcggcagcggcggcggcggcagcggcagcggcggcagctggaggcctggctgcggctgggggccctggacaaggctgggctcccggccccggccccatcacctccatcccggattcgcttgggggtcccttcgccagcgtcctatcttcgctccaaagacccaacggtgccaaagccgccttagtgaagagcagtatgttctgatctggaatcctgcggcggcggcggcggcggcgacagcgggcgagccagggcccgggcgggcgagtgggcgagcgggtaggcccaaggctattgtcgtcgctgctgccatggctttttcattgagggcctaaagtaatcgcgctaagaataaagggaaaacggcgtcgccctcatttcaaccccactcctacccccttcctcaacccccaaacaaaacaaacaaacttccctggcttcgcacctgcctggggcctcgcagcggggccagggctccgcctgctgatcgggggttgtgagcagcgcggcctggacgcggggcactctcagggggctgtgtctgcgtgtcagtttgtgtctgtctcggggaatgtgtgtctgtggcccaagcaggtgacaggaagagatggggggcctcaaccaacttagtgacttgtttagaaaaaaaagacaaaaaagtaaaaataaaaacaaaaaagttggaaggcagaaaccattaaaaaacaaaaagccaacaacccagaaaggtttaaaaaacataaggaaaaaaaagacaaattaaaggaggggctaggggagaagctgcagctggagctgaaggctcgatcttgtgaacccctaaatccgctccctcctaacagcacggattctcttggggctcttcttcagggaagagtagggacgccgttccagccccccttcctatcgtgtccttgggttcgggtcactgcggcgacgacttgctcagactgtcccggcggccggagtgactttctcgcacccccttgcctgtcccacctcgctgaacaccatcccgccattagcgcatcggaaccccacacagttgcaactcccaaccccgaatctttgcagccgttcggccctgaaagatgccctatccatgagatgccttttcatctgcaaactctgcaaaatgtgtctcatgtttcgcaactctttttttccccctcgctcccgcctaccccgtcggcattttcttcttccaccagcttttactgaactttttggcactgctttggattggggtcaattgcagtccacgtaactggctgcagagaaatctaccgagcaaggaaaaggcacacacacacgtttgcaggggtgtctcggtttgcatttctgttggaatgatccgaactggactcacatcctgtatggtggatggactgtatattgagggttccattcttcgcgcagtttagacatctctgttttgattctttgttgttgtttttattttaaaaggcacaaactctagatattagttgaatgttgaggctttaactttttcggtgtctttctacaactgtgttctgtgactcaattgtatcgtgttaatatcagtgcagactgtctcctctacgtgaccgtataatgtttttctcttcttgtagtctctatggcgtgtctttatggtgtaataaggttctcacgggttcaatcttttgtgtttagagaggccacggttcagacaatggtatatatttttgttatcaggtgcatgtctgtctgatttctttttttttcctgttggactatgtttgtgaacataattgtcataagttatgtttcagatttttgaatttatttatatgtgttataatgaatgcttctatttaaaagggaaatatttctacatgtgcatatagttttccaagagtgtaccattaacttgattgttgataataaaaacaaaaagcaagtcta

SEQ ID NO: 21467 - DNA, 3216 bp, Homo sapiens
cccaggcccaccccacccagcacccctggcgcagggactgctggaacctggctgtgcgcgctgtcgctttaagacagactctgccggcgccgtccggagccttagaaaccggccccggatcgcgagccggagccggagccggagccggggccggccgggctgctgaggcccgagcggcaggagcgcagcgcggagcgctgagccaggcgcccagtcgcgagaagctgccgccgcctctgcccgcccggcgccgcagccccgggcggtccatggggcgggcacggcgtcgctgcaggcgccggcagccctggagggcagccgcttaggcgctgcgctcttgtccccgcaggtcgcagccagggcggcggggcgcgcccagccccggcccctggagcgcccgccgcggtccccacctccatggacgccttcaaggggggcatgagcctggagcggctgccggaggggctccggccgccgccgccgccaccccatgacatggggcccgccttccacctggcccggcccgccgacccccgcgagccgctcgagaactccgccagcgagtcgtctgacacggagctgccagagaaggagcgcggcggggaacccaaggggcccgaggacagtggtgcgggaggcacgggctgcggcggcgcagacgacccagccaagaagaagaagcagcggcggcaacgtacgcacttcacaagccagcagttgcaagagctagaggccacgttccagaggaaccgctaccccgacatgagcatgagggaggagatcgccgtgtggaccaacctcaccgagccgcgcgtgcgggtctggttcaagaaccggcgagccaagtggcgtaagcgcgagcgtaaccagcagctggacctgtgcaagggtggctacgtgccgcagttcagcggcctagtgcagccctacgaggacgtgtacgccgccggctactcctacaacaactgggccgccaagagcctggcgccagcgccgctctccaccaagagcttcaccttcttcaactccatgagcccgctgtcgtcgcagtccatgttctcagcacccagctccatctcctccatgaccatgccgtccagcatgggcccaggcgccgtgcctggcatgcccaactcgggcctcaacaacatcaacaacctcaccggctcctcgctcaactcggccatgtcgccgggcgcttgcccgtacggcactcccgcctcgccctacagcgtctaccgggacacgtgcaactcgagcctagccagcctgcggctcaagtccaaacagcactcgtcgtttggctacggcggcctgcagggcccggcctcgggcctcaacgcgtgccagtacaacagctgaccgccccgccgcaccacgcgggccggcggccggagcggggaagggcgcgggcgcgggcgcggaggacgcacgcggggccccggctcgcaagccccagctcaccgcgccgcggacctcacacctgcgcagccccctcctcccacttcccactccgggttggttttgtgtttgcttttccggaccccactctgccctccaaaaagacaaaaaaaaaaaaaaaaaaaaaaaagcaaaaagacgtcggagaaaagtgccgcgaaaaaatggatgagttgcaatttctctcgggatggcgcgggtggtgtgtgtgttcccacgggccccggaggcccactccgcggagggcacgcggcgcggtaggcgagcgccgaggcccagcggccgggggaggacgacctcgtatcccgcgtccccgccgcgctggatccggactgagtggccgggcctgcggactggatgtgcggggcctggacttgcctaggatttcccgaccccgtacaaaccaagttgccctctccgagctaggcccggccgagagcgccttagctcgagtcggatccgtgttggggcgggcgttgggtttggggggacggtgcccccagcccaggatcgggcactcagtggagccgcacacggccccggcgcgcctggtagagcctcgctggccccgcgccccggagccctatattaaggccacggagcgacagcgggcagtgcgggcctggcgggaggtgggggaggtccatctcagaacaccccagccttgagcttagctgcaggcccaggccctctgctctgctcccgggctaggaggtggccctctgtctgggcgaacagccccctcctcaccgcccgccgtgcaagagtcgagccggcagagcaaggggcgcggccccagggccctgcgcccactttgcacacccgctctccggcccgcgcccctgtttacagcgtccctgtgtatgttggactgactgtaataaatctgtctatatcgacttgtccatgtacgtctattaaaaccatagtccgagcgtgctaagcactgctgagccccgactgcttcattgggctgaggagggaggcggatagaaagggaactgtgggtagaaagggaaccgggccccttgggtaggagcagagcgccgaggcagcccccgccgaggtctgcctaccccgcttccccaccaccattcttgacctgctcagcctggctcccatgagggcaccgtcctgcgttgcgagcctgtccggtgcgcacccgctaagctgtgcctctcggcgttgtccgcgggacgccttagcgagaaccccctccctccgcggctgcgggactctacgggtttcttcccaggccgggtctgcggtgaccctcgaggccccagggtgctatggggcccttgcctgccaggagcgttcgggcaggggctgctgagagcctctttatgcctggggttgccttttcttctgtgggcccagcaacagcccctcttctctcctcggagccagggccaggctattccaggaggactgagggggctggatctatcagagtatagcgagggcctcccgctgcctttctccctaatgcccgcaacgtgccgagagcccaccgaggggcgtgcggctgtgcaggagaaagtgtccgtcacacaggactcacttctcacttccaatccatcccaacttgtggggactgctggccgcctccgccctcccctggcttttggaaactactgaacaagaccagcctgtaaactgcctgtaaaattctgcttcccttaagtaagtcatttctaatggcaaaacaaaatgtttgcagctgcagtgggggaggaaggaggggttgatatt

SEQ ID NO: 21468 - DNA, 666 bp, Homo sapiens
ccgctgggagctgccggaacgggccccgggctctgcccccgccccggcgctggctcgaaggcgcccgctcggtgcgatcctgttcggcaaacattcactcatcctgggctgttctcgccagggctggggacttcgaggcggccgagacgggagttgattctaggcgaaacaagtcatttgaggcctgaggtgtgcacgagccgcccgggactcgcaggccagatgcgtttcttttgtgaggccgagggagaactcggtcgcagccagggcggcggggcgcgcccagccccggcccctggagcgcccgccgcggtccccacctccatggacgccttcaaggggggcatgagcctggagcggctgccggaggggctccggccgccgccgccgccaccccatgacatggggcccgccttccacctggcccggcccgccgacccccgcgagccgctcgagaactccgccagcgagtcgtctgacacggagctgccagagaaggagcgcggcggggaacccaaggggcccgaggacagtggtgcgggaggcacgggctgcggcggcgcagacgacccagccaagaagaagaagcagcggcggcaacgtacgcacttcacaagccagcagttgcaagagctagaggccacgttccagaggaaccgctacccc

SEQ ID NO: 21469 - DNA, 1305 bp, Homo sapiens
ctggggacttcgaggcggccgagacgggagttgattctaggcgaaacaagtcatttgaggcctgaggtcgcagccagggcggcggggcgcgcccagccccggcccctggagcgcccgccgcggtccccacctccatggacgccttcaaggggggcatgagcctggagcggctgccggaggggctccggccgccgccgccgccaccccatgacatggggcccgccttccacctggcccggcccgccgacccccgcgagccgctcgagaactccgccagcgagtcgtctgacacggagctgccagagaaggagcgcggcggggaacccaaggggcccgaggacagtggtgcgggaggcacgggctgcggcggcgcagacgacccagccaagaagaagaagcagcggcggcaacgtacgcacttcacaagccagcagttgcaagagctagaggccacgttccagaggaaccgctaccccgacatgagcatgagggaggagatcgccgtgtggaccaacctcaccgagccgcgcgtgcgggtctggttcaagaaccggcgagccaagtggcgtaagcgcgagcgtaaccagcagctggacctgtgcaagggtggctacgtgccgcagttcagcggcctagtgcagccctacgaggacgtgtacgccgccggctactcctacaacaactgggccgccaagagcctggcgccagcgccgctctccaccaagagcttcaccttcttcaactccatgagcccgctgtcgtcgcagtccatgttctcagcacccagctccatctcctccatgaccatgccgtccagcatgggcccaggcgccgtgcctggcatgcccaactcgggcctcaacaacatcaacaacctcaccggctcctcgctcaactcggccatgtcgccgggcgcttgcccgtacggcactcccgcctcgccctacagcgtctaccgggacacgtgcaactcgagcctagccagcctgcggctcaagtccaaacagcactcgtcgtttggctacggcggcctgcagggcccggcctcgggcctcaacgcgtgccagtacaacagctgaccgccccgccgcaccacgcgggccggcggccggagcggggaagggcgcgggcgcgggcgcggaggacgcacgcggggccccggctcgcaagccccagctcaccgcgccgcggacctcacacctgcgcagccccctcctcccacttcccactccgggttggttttgtgtttgcttttccggaccccactctgccctccaaaaagacaaaaaaaaaaaaaaaaaaaaa

SEQ ID NO: 21470 - DNA, 587 bp, Homo sapiens
agttcccgggagaagaggctggagaaggaggggcaggcggcccctcgacgaggacaccgctgggagctgccggaacgggccccgggctctgcccccgccccggcgctggctcgaaggcgcccgctcggtcgcagccagggcggcggggcgcgcccagccccggcccctggagcgcccgccgcggtccccacctccatggacgccttcaaggggggcatgagcctggagcggctgccggaggggctccggccgccgccgccgccaccccatgacatggggcccgccttccacctggcccggcccgccgacccccgcgagccgctcgagaactccgccagcgagtcgtctgacacggagctgccagagaaggagcgcggcggggaacccaaggggcccgaggacagtggtgcgggaggcacgggctgcggcggcgcagacgacccagccaagaagaagaagcagcggcggcaacgtacgcacttcacaagccagcagttgcaagagctagaggccacgttccagaggaaccgctaccccgacatgagcatgagggaggagatcgccgtgtggaccaacctcaccgagcc

SEQ ID NO: 21471 - DNA, 2320 bp, Homo sapiens
aagatgttaggccaacagggaagcgcggagccgcagatctggtccgtcgctcgcctgggtgcctggagctgagctgcggcaaggcccggctcctgttcgaccgcccgaggggtgtgcgtgtgcgcgttgcggagggtgcgctcagagggccgcgtcgtggctgcagcggctgctgccgccgcaggggatctaatatcacctacctgtccctgtcactcttgacacttctctgtcagggctgccgcgtggggggggggcgggcagagcgcggtcggcgttagctttccttattggaggggttcttgggggagggagggagagaagaagggggtctttgcccactcttgtttcgctttggagcttggaagcctgctccctaaagacgctctgagtggtgcccttctgcccacatcccatgtcttcgtttgcccgctgactttccgtctccggactttttcgcttgagccttccggaggagacgggggcagcttggcttgagaactcggcgggggttgcgtcccctggctctccccgcagcggggaaactccgcgcctagagcgcgacccggagcgggcagcggcggctacgggggctcggcggggcagtagccaaggactagtagagcgtcgcgctccctcgtccatgaactgcatgaaaggcccgcttcacttggagcaccgagcagcggggaccaagctgtcggccgtctcctcatcttcctgtcaccatccccagccgttagccatggcttcggttctggctcccggtcagccccggtcgctggactcctccaagcacaggctggaggtgcacaccatctccgacacctccagcccggaggccgcagagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacaggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggctacgccagcgtgcagaacccggcctccaacctgagtgcttgccagtatgcagtggaccggcccgtgtgagccgcacccacagcgccgggatcctaggaccttgccggatggggcaactccgcccttgaaagactgggaattatgctagaaggtcgtgggcactaaagaaagggagagaaagagaagctatatagagaaaaggaaaccactgaatcaaagagagagctcctttgatttcaaagggatgtcctcagtgtctgacatctttcactacaagtatttctaacagttgcaaggacacatacacaaacaaatgtttgactggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgccacactgtatgtttctaacatattattattattataaaaaatgtgtgaatatcagttttagaatagtttctctggtggatgcaatgatgtttctgaaactgctatgtacaacctaccctgtgtataacatttcgtacaatattattgttttacttttcagcaaatatgaaacaaatgtgttttatttcatgggagtaaaatatactgcatacaaa

SEQ ID NO: 21472 - DNA, 3359 bp, Homo sapiens
tcagagggatcaatatacaggccctaccacggaaaggcggggaaaaggttcgaatagaaaactgctgcagaagggaagccactgagaggagcaaatgtggacttgagggaaactctctcccccacccccacttctatcccgtgcaatttaataccatcctcgccaggaaccttaacctcgtcattttaaaaaatgagatatccgtgacccagggtgaacttgttgaatgtaggtacagcagaggaaattctagactctatgagcgtctgagccttgtccagtgcaaacccttcgtgaacactgggtcagtgcgtggccgtgcccacctgtgcgccgacactctcagcatgcctggtccacccgccttgacctcgggcgcggtgtcccagctaagctgggcccagcgtcccggccttccccagctgacaagcctagctcgttcgctcccggctgtggccctcccaccctctcccactagctcactccattcttctagatttctcttcactcatcctctcccatccccaccgcgcccacctccactcccgccctctaccggtctctcactttcctccctccgcagtccctctttgctgtgacctctttcctcaactctgcaggcctgaaagaaggtcacacacgcacgctcacacccacactccacacgcctcgtcccaaacaaccccatgaacattgtcctttgttccgtctcttgggccactttccctgtcgcttcctcccagcccgtcctgatttgctccccaaaagtacgtttctgtctccccgctgccctggcgctccccctttgatttattagggctgccgggttggcgcagattgctttttcttctcttccatcccatcctcccttctggtcctcctttccacagtgggagtccgtgctcctgctcctcggttggctcctaagtgccccgccaggtcccctctcctttcgctctcccggctccggctcccgactcttcggcccgctggcatctgcttccctcccctgcctcgtttctcgtcgcccctgctcgctccccccggcgctcgcccgggcgctgtgctcgctcctggatcgccagccgcgcagccgggctcggccggccgcccgcgcgccactgtgcagtggagtttggtggaatctctgctgacgtcacgtcactccccacacggagtaggagcagagggaagagagagggatgagagggagggagaggagagagagtgcgagaccgagcgagaaagctggagaggagcagaaagaaactgccagtggcggctagatttcggaggccccagtgcacccgtggactccttcggaacttggcaccctcaggagccctgcagtcctctcaggcccggctttcgggcgcttgccgtgcagccggaggctcggctcgctggaaatcgccccgggaagcagtgggacgcggagacagcagctctctcccggtagccgaatcactaaatctggagccgccaaactgctacttctgggcccacgggcccacaaggatcgaatcggcagagtccccgcccgcgttctcgctagcgggtgggggaaccgcctggccgtccccaccctggatccccacgccacagcgccgggcagcccctcctgtaggcagcgaccttggccagaggctccccagggcccagctcccttcaggagaggccgagacgcagggaaacgataacggggaatggagaccaactgccgcaaactggtgtcggcgtgtgtgcaattaggcgtgcagccggcggccgttgaatgtctcttctccaaagactccgaaatcaaaaaggtcgagttcacggactctcctgagagccgaaaagaggcagccagcagcaagttcttcccgcggcagcatcctggcgccaatgagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacaggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggctacgccagcgtgcagaacccggcctccaacctgagtgcttgccagtatgcagtggaccggcccgtgtgagccgcacccacagcgccgggatcctaggaccttgccggatggggcaactccgcccttgaaagactgggaattatgctagaaggtcgtgggcactaaagaaagggagagaaagagaagctatatagagaaaaggaaaccactgaatcaaagagagagctcctttgatttcaaagggatgtcctcagtgtctgacatctttcactacaagtatttctaacagttgcaaggacacatacacaaacaaatgtttgactggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgccacactgtatgtttctaacatattattattattataaaaaatgtgtgaatatcagttttagaatagtttctctggtggatgcaatgatgtttctgaaactgctatgtacaacctaccctgtgtataacatttcgtacaatattattgttttacttttcagcaaatatgaaacaaatgtgttttatttcatgggagtaaaatatactgcatac

SEQ ID NO: 21473 - DNA, 2100 bp, Homo sapiens
tgggagtccgtgctcctgctcctcggttggctcctaagtgccccgccaggtcccctctcctttcgctctcccggctccggctcccgactcttcggcccgctggcatctgcttccctcccctgcctcgtttctcgtcgcccctgctcgctccccccggcgctcgcccgggcgctgtgctcgctcctggatcgccagccgcgcagccgggctcggccggccgcccgcgcgccactgtgcagtggagtttggtggaatctctgctgacgtcacgtcactccccacacggagtaggagcagagggaagagagagggatgagagggagggagaggagagagagtgcgagaccgagcgagaaagctggagaggagcagaaagaaactgccagtggcggctagatttcggaggccccagtgcacccgtggactccttcggaacttggcaccctcaggagccctgcagtcctctcaggcccggctttcgggcgcttgccgtgcagccggaggctcggctcgctggaaatcgccccgggaagcagtgggacgcggagacagcagctctctcccggtagccgataacggggaatggagaccaactgccgcaaactggtgtcggcgtgtgtgcaattagagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacaggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggctacgccagcgtgcagaacccggcctccaacctgagtgcttgccagtatgcagtggaccggcccgtgtgagccgcacccacagcgccgggatcctaggaccttgccggatggggcaactccgcccttgaaagactgggaattatgctagaaggtcgtgggcactaaagaaagggagagaaagagaagctatatagagaaaaggaaaccactgaatcaaagagagagctcctttgatttcaaagggatgtcctcagtgtctgacatctttcactacaagtatttctaacagttgcaaggacacatacacaaacaaatgtttgactggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgccacactgtatgtttctaacatattattattattataaaaaatgtgtgaatatcagttttagaatagtttctctggtggatgcaatgatgtttctgaaactgctatgtacaacctaccctgtgtataacatttcgtacaatattattgttttacttttcagcaaatatgaaacaaatgtgttttatttcatgggagtaaaatatactgcatacaaa

SEQ ID NO: 21474 - DNA, 1906 bp, Homo sapiens
agagagtgcgagaccgagcgagaaagctggagaggagcagaaagaaactgccagtggcggctagatttcggaggccccagtgcacccgtggactccttcggaacttggcaccctcaggagccctgcagtcctctcaggcccggctttcgggcgcttgccgtgcagccggaggctcggctcgctggaaatcgccccgggaagcagtgggacgcggagacagcagctctctcccggtagccgataacggggaatggagaccaactgccgcaaactggtgtcggcgtgtgtgcaattaggcgtgcagccggcggccgttgaatgtctcttctccaaagactccgaaatcaaaaaggtcgagttcacggactctcctgagagccgaaaagaggcagccagcagcaagttcttcccgcggcagcatcctggcgccaatgagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacaggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggctacgccagcgtgcagaacccggcctccaacctgagtgcttgccagtatgcagtggaccggcccgtgtgagccgcacccacagcgccgggatcctaggaccttgccggatggggcaactccgcccttgaaagactgggaattatgctagaaggtcgtgggcactaaagaaagggagagaaagagaagctatatagagaaaaggaaaccactgaatcaaagagagagctcctttgatttcaaagggatgtcctcagtgtctgacatctttcactacaagtatttctaacagttgcaaggacacatacacaaacaaatgtttgactggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgccacactgtatgtttctaacatattattattattataaaaaatgtgtgaatatcagttttagaatagtttctctggtggatgcaatgatgtttctgaaactgctatgtacaacctaccctgtgtataacatttcgtacaatattattgttttacttttcagcaaatatgaaacaaatgtgttttatttcatgggagtaaaatatactgcatacaaa

SEQ ID NO: 21475 - DNA, 1085 bp, Homo sapiens
gcagtctgtgtaagttttcatatctctgagtgtgtgcacacagtggagagggtggagcctgccatcctcaaatctgaaaagattgagagatttcagagggcccagatgtgccaaaggtcagagggatcaatatacaggccctaccacggaaaggcggggaaaaggttcgaatagaaaactgctgcagaagggaagccactgagagataacggggaatggagaccaactgccgcaaactggtgtcggcgtgtgtgcaattaggcgtgcagccggcggccgttgaatgtctcttctccaaagactccgaaatcaaaaaggtcgagttcacggactctcctgagagccgaaaagaggcagccagcagcaagttcttcccgcggcagcatcctggcgccaatgagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacaggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcag

SEQ ID NO: 21476 - DNA, 463 bp, Homo sapiens
gtgccaaaggtcagagggatcaatatacaggccctaccacggaaaggcggggaaaaggttcgaatagaaaactgctgcagaagggaagccactgagagataacggggaatggagaccaactgccgcaaactggtgtcggcgtgtgtgcaattagagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgc

SEQ ID NO: 21477 - DNA, 1391 bp, Homo sapiens
ggagcgcccgagcggagaggcggcccgggagcaggggggcggcccccactccggccgggtgcccggcccctggcccctgcctgccctctagatcgccgccgcagccgccgctactgggagtctgcctgttgcaggacgcactagccctccctccatggagttcggcctgctcagcgaggcagaggcccggagccctgccctgtcgctgtcagacgctggcactccgcacccccagctcccagagcacggctgcaagggccaggagcacagcgactcagaaaaggcctcggcttcgctgcccggcggctccccagaggacggttcgctgaaaaagaagcagcggcggcagcgcacgcacttcaccagccagcagctacaggagctagaggcgaccttccagaggaaccgctaccccgacatgagcacgcgcgaggagatcgccgtgtggaccaacctcaccgaggcccgcgtgcgggtgtggttcaagaaccggcgcgccaaatggcggaagcgcgagcgcagccagcaggccgagctatgcaaaggcagcttcgcggcgccgctcggggggctggtgccgccctacgaggaggtgtaccccggctactcgtacggcaactggccgcccaaggctcttgccccgccgctcgccgccaagacctttccattcgccttcaactcggtcaacgtggggcctctggcttcgcagcccgtcttctcgccacccagctccatcgccgcctccatggtgccctccgccgcggctgccccgggcaccgtgccagggcctggggccctgcagggcctgggcgggggcccccccgggctggctccggccgccgtgtcctccggggccgtgtcctgcccttatgcctcggccgccgccgccgccgcggctgccgcctcttccccctacgtctatcgggacccgtgtaactcgagcctggccagcctgcggctcaaagccaaacagcacgcctccttcagctaccccgctgtgcacgggccgcccccggcagccaaccttagtccgtgccagtacgccgtggaaaggcccgtatgagcggccccgcccgtagatcatccccgagggcgggggcaacgattcacagcctccgcggactggggtcattttgactggcttgctcccgccccagggtctgaaaggggtgtttgggcagctggggggcaccggctcaggagagggccttcccctcccagccctgaggggtggactaggccctacacacagaccgcgcccctgggactaaagccaggaacagggaccagctccccgggggccaactcacccttggcccatcccgccttctccaggcttcccctccctcgttttcaaagataaatgaaataaacgtgcgcggactgtcgaa

SEQ ID NO: 21478 - DNA, 1187 bp, Homo sapiens
tccatggagttcggcctgctcagcgaggcagaggcccggagccctgccctgtcgctgtcagacgctggcactccgcacccccagctcccagagcacggctgcaagggccaggagcacagcgactcagaaaaggcctcggcttcgctgcccggcggctccccagaggacggttcgctgaaaaagaagcagcggcggcagcgcacgcacttcaccagccagcagctacaggagctagaggcgaccttccagaggaaccgctaccccgacatgagcacgcgcgaggagatcgccgtgtggaccaacctcaccgaggcccgcgtgcgggtgtggttcaagaaccggcgcgccaaatggcggaagcgcgagcgcagccagcaggccgagctatgcaaaggcagcttcgcggcgccgctcggggggctggtgccgccctacgaggaggtgtaccccggctactcgtacggcaactggccgcccaaggctcttgccccgccgctcgccgccaagacctttccattcgccttcaactcggtcaacgtggggcctctggcttcgcagcccgtcttctcgccacccagctccatcgccgcctccatggtgccctccgccgcggctgccccgggcaccgtgccagggcctggggccctgcagggcctgggcgggggcccccccgggctggctccggccgccgtgtcctccggggccgtgtcctgcccttatgcctcggccgccgccgccgccgcggctgccgcctcttccccctacgtctatcgggacccgtgtaactcgagcctggccagcctgcggctcaaagccaaacagcacgcctccttcagctaccccgctgtgcacgggccgcccccggcagccaaccttagtccgtgccagtacgccgtggaaaggcccgtatgagcggccccgcccgtagatcatccccgagggcgggggcccagggtctgaaaggggtgtttgggcagctggggggcaccggctcaggagagggccttcccctcccagccctgaggggtggactaggccctacacacagaccgcgcccctgggactaaagccaggaacagggaccagctccccgggggccaactcacccttggcccatcccgccttctccaggcttcccctccctcgttttcaaagataaatgaaataaacgtgcgcggactgtcgaa

SEQ ID NO: 21479 - DNA, 1800 bp, Homo sapiens
gctggcaccttcctgagatatgcctgcttgcccccgatttttttctccttgcagtgagaacctcctcatgtggcatctttacttattctcttcttggaaaatccatgtgacctccccgcgcttaaagtgtttccacgttacaggcgacttaaaggcagccctggagcctgacgtataattcgagcgccgatgcagaaaggagtcaggtgtttttttttttttttttttggtttccggttctgtcacctccaggctgagccgggctggcggaagaggcacgtgcgctgctgaatggagctggtcgctggttgctacgagcaggtcctctttgggttcgctgtacacccggagcccgaggcttgcggcgaccacgagcaatggactcttgtggctgacttcactcaccatgctcacactgcctccttgtcagcagtagctgtaaatagtcgttttgtggtcactgggagcaaagatgaaacaattcacatttatgacatgaaaaagaagattgagcatggggctctagtgcatcacagtggtacaataacttgcctgaaattctatggcaacaggcatttaatcagtggagcggaagatggactcatctgtatctgggatgcaaagaaatgggaatgcctgaagtcaattaaagctcacaaaggacaggtgaccttcctttctattcacccatctggcaagttggccctgtcggttggtacagataaaactttaagaacgtggaatcttgtagaaggaagatcagcattcataaaaaatataaaacaaaatgctcacatagtagaatggtccccaagaggagagcagtatgtagttatcatacagaataaaatagacatctatcagcttgacactgcatccattagtggcaccatcacaaatgaaaagagaatttcctctgttaaatttctttcagagtctgtccttgcagtggctggagatgaagaagttataaggttttttgactgtgattcactagtgtgcctctgcgaatttaaagctcatgaaaacagggtaaaggacatgttcagttttgaaattccagagcatcatgttattgtttcagcatcgagtgatggtttcatcaaaatgtggaagcttaagcaggataagaaagttcccccatctttactctgtgaaataaacactaatgccaggctgacgtgtcttggagtgtggctagacaaagtggcagacatgaaagaaagccttcctccagctgcagagccttctcctgtaagtaaagaacagtccaaaattggcaaaaaggagcctggtgacacagtgcacaaagaagaaaagcggtcaaaacctaacacaaagaaacgcggtttaacaggtgacagtaagaaagcaacaaaagaaagtggcctgatatcaaccaagaagaggaaaatggtagaaatgttggaaaagaagaggaaaaagaagaaaataaaaacaatgcagtgaatcacagatgtctcctgaaagaactcttttagatgaaatcattctactcaaatgtaccttaattttttttttttccctgagtaaaagcaagaaatttcttcctttggaaaaaatatatatattaaaaaaccacttttagatggttttttttaaaaaaaaaaaaaaaactggtaaaattacttttggcagacagtgttttatgaattatgtatcatgttgatatataatatgttaatgtgtcatgtaatttttactttgtacaaagcaaataaagatctttctcaaaatatactgtaaaataatataaaatattgaacacattctttatca

SEQ ID NO: 21480 - DNA, 3637 bp, Homo sapiens
gccacaacctccattctcccagaaaagaagaaatgctcatctgaaattcatcacctctctggagtcttcaaactgaccaagcattgaaaagaacacagtttcagaaaacagtttccagtgcctctggccttcctactgaaagcagacacagagtgcatgaagaccgttcaaatatgtcagggacctcctcccatgagtccttctatgactccctctcagacatgcaggaagaaagcaagaatactgacttcttcccgggcctttctgctttcctcagccaggaagagataaacaagagtcttgacctggcccggagagccatagccgactccgaaacagaagattttgactcggaaaaggagatctcgcagattttcagtacttctcctgcaagcctctgtgaacatccttcccataaggagaccaaattgggtgaacacgcctcgaggagacctcaggataacaggtcaacacctgtccagcctctggcagagaaacaaactaagagtatctcttcacctgtttcaaagaggaaacctgccatgtcacccctgctcaccaggcccagctacatccggagcctccgaaaggctgaaaagcgtggtgcaaaaactcccagcacaaacgtaaagcccaaaacgccacatcaaagaaagggtggcccccagagccagctgtgtgacaaggcagctaatttaattgaggagctaacatccatatttaaagccgcaaagccaagaaacagaagcccaaatggggagtcctcgtcaccagacagtgggtacctgtctcctaaaaatcagccgtcagccctgctgagtgcctcagccagccagagccctatggaagaccaaggggagatggaaagagaggtcaagtcccctggggccaggcattgctaccaggacaaccaggacttggcagtgccacacaaccgcaagtctcacccacagccccacagcgccctccacttcccagctgcacctcgattcatccaaaagctgaggagccaagaagtagcagaagggagccgagtttatctggagtgtagagtcactggaaaccccactcctcgagtcagatggttctgtgaagggaaagaactgcacaacactcctgatattcaaatccactgtgagggaggggacctccataccctgatcatagcagaggcctttgaggacgacacaggtcgctacacctgtttggctacgaatcccagcggctcagacacaacatctgctgaggtgttcattgaaggtgccagttcaacagattctgacagtgaaagtttagctttcaaatcaagagctggagctatgccacaagctcaaaagaaaacaacttctgtttccttgacaataggatcatcatctccaaagacaggggtgaccacagctgtgattcaaccactgtctgtccctgtgcaacaggttcacagtccaacttcatatctctgccgacctgatggaaccactactgcctactttcctcctgtttttacaaaggaactgcaaaacacagccgtggcggaaggccaggtggtggttctggagtgccgggtccgtggggcaccccctctgcaggtccagtggtttcggcaagggagtgaaatccaagactctccagatttccgaattctacagaaaaaacctagatctacagctgaacctgaggagatttgcaccctagttatcgctgagactttccctgaagatgcagggatctttacatgttcagcaagaaatgattatggatcagcaaccagcactgcccagctggttgtcacctcagccaacactgaaaactgtagttacgagtcaatgggagaatccaacaatgaccacttccaacactttccacctccccctccaatcttggagacaagttccttggagttggcttcaaagaaaccatctgagatccagcaggtgaacaaccctgagttaggcctgagcagggcagcccttcaaatgcaattcaatgctgctgagagggaaacgaacggagtccatcccagccgtggagtaaatggactgattaacggcaaagctaacagtaataaatctcttccaacaccagctgtcctgctttcacccactaaggagccaccacctctgcttgccaaaccaaaactaggatttccaaagaaggccagtagaactgctagaatagcctccgatgaggaaattcaaggcacaaaggatgctgttattcaagacctggaacgaaaacttcgcttcaaggaggacctcctgaacaatggccagccgaggttaacatacgaagaaagaatggctcgtcgactgctaggtgctgacagtgcaactgtctttaatattcaggagccagaagaggaaacagctaatcaggacattggttctcctcatgcttctgtagggagtcctctggatggtcaaaaggaatacaaagtctccagctgtgaacagagactcatcagtgaaatagagtacaggctagaaaggtctcctgtggatgaatcaggtgatgaagttcagtatggagatgtgcctgtggaaaatggaatggcaccattctttgagatgaagctgaaacattacaagatctttgagggaatgccagtaactttcacatgtagagtggctggaaatccaaagccaaagatctattggtttaaagatgggaagcagatctctccaaagagtgatcactacaccattcaaagagatctcgatgggacctgctccctccataccacagcctccaccctagatgatgatgggaattatacaattatggctgcaaaccctcagggccgcatcagttgtactggacggctaatggtacaggctgtcaaccaaagaggtcgaagtccccggtctccctcaggccatcctcatgtcagaaggcctcgttctagatcaagggacagtggagacgaaaatgaaccaattcaggagcgattcttcagacctcacttcttgcaggctcctggagatctgactgttcaagaaggaaaactctgcagaatggactgcaaagtcagtgggttaccaaccccagatctaagctggcaactagatggaaagcccgtacgccctgacagtgctcacaagatgctggtgcgtgagaacggggtgcactctctgatcatagagccagtcacgtcacgtgatgccggcatctacacatgtatagctaccaaccgagcaggacagaactcattcagcctggagcttgtggttgctgctaaagaagcacacaaaccccctgtgtttattgagaagctccaaaacacaggagttgctgatgggtacccagtgcggctggaatgtcgtgtattgggagtgccaccacctcagatattttggaagaaagaaaatgaatcactcactcacagcactgaccgagtgagcatgcaccaggacaaccacggctacatctgcctgctcattcagggagccacaaaagaagatgctgggtggtatactgtgtcagccaagaatgaagcagggattgtgtcctgtactgccaggctggacgtttacatttctcgacattaatagtgaaccacaccaggagaacaaatacccaacccagtggcatcagcagtcacagagcaccaagccaaaaaaagtacggccctcagccagtc

SEQ ID NO: 21481 - DNA, 4379 bp, Homo sapiens
cctgagtcacccggcgggcgaggtataaagcccgatacctgccccgcgcccggtccgcggagcccgctgcagctcccgctcgctccggacgcggaatcgggcagcagcgggaggcggcccggagagccgagggaccctctgaagctccagcaactccagaaccaaatccgactggagcaggaggccggcgctcggcagcctccgccagccccgcgcagcgcgccgccctcgccccccttcccgccgccgcccgccttccccgagctcgcggcctgcacgccgcccgcgtccccggagcccatgagcgcgctggcctcccgctccgcccccgccatgcagtcctccggctccttcaactacgcgcgccccaagcagttcatcgccgcgcagaacctcgggcccgcgtcgggccacggcacgccggcctccagccccagctcgtccagcctcccgtcgcccatgtccccgacgccgaggcagttcggccgcgcccccgtgccgcccttcgcgcagcccttcggcgctgagcccgaggccccgtggggctcctcctcgccgtcgcccccgcccccgccacccccggtcttcagccccacggctgccttcccggtgcccgacgtgttcccactgccgccgccaccaccgccgctcccgagcccgggacaggcgtcccactgctcgtcgcctgccacccgcttcggccacagccagacgcccgcggccttcctcagcgctctgctgccctcgcagccgccgccggcggccgtcaacgccctggggctgcccaagggtgtcacccccgcaggatttccaaagaaggccagtagaactgctagaatagcctccgatgaggaaattcaaggcacaaaggatgctgttattcaagacctggaacgaaaacttcgcttcaaggaggacctcctgaacaatggccagccgaggttaacatacgaagaaagaatggctcgtcgactgctaggtgctgacagtgcaactgtctttaatattcaggagccagaagaggaaacagctaatcaggaatacaaagtctccagctgtgaacagagactcatcagtgaaatagagtacaggctagaaaggtctcctgtggatgaatcaggtgatgaagttcagtatggagatgtgcctgtggaaaatggaatggcaccattctttgagatgaagctgaaacattacaagatctttgagggaatgccagtaactttcacatgtagagtggctggaaatccaaagccaaagatctattggtttaaagatgggaagcagatctctccaaagagtgatcactacaccattcaaagagatctcgatgggacctgctccctccataccacagcctccaccctagatgatgatgggaattatacaattatggctgcaaaccctcagggccgcatcagttgtactggacggctaatggtacaggctgtcaaccaaagaggtcgaagtccccggtctccctcaggccatcctcatgtcagaaggcctcgttctagatcaagggacagtggagacgaaaatgaaccaattcaggagcgattcttcagacctcacttcttgcaggctcctggagatctgactgttcaagaaggaaaactctgcagaatggactgcaaagtcagtgggttaccaaccccagatctaagctggcaactagatggaaagcccgtacgccctgacagtgctcacaagatgctggtgcgtgagaacggggtgcactctctgatcatagagccagtcacgtcacgtgatgccggcatctacacatgtatagctaccaaccgagcaggacagaactcattcagcctggagcttgtggttgctgctaaagaagcacacaaaccccctgtgtttattgagaagctccaaaacacaggagttgctgatgggtacccagtgcggctggaatgtcgtgtattgggagtgccaccacctcagatattttggaagaaagaaaatgaatcactcactcacagcactgaccgagtgagcatgcaccaggacaaccacggctacatctgcctgctcattcagggagccacaaaagaagatgctgggtggtatactgtgtcagccaagaatgaagcagggattgtgtcctgtactgccaggctggacgtttacacccagtggcatcagcagtcacagagcaccaagccaaaaaaagtacggccctcagccagtcgctatgcagcactttcggaccagggactagacatcaaagcagcgttccaacctgaggccaacccatctcacctgacactgaatactgccttggtagaaagtgaggacctgtaatccagcattcttgttaaagctgaaacactgaaacagccattgccttgaccaacatattcctttgtcacattatgtaaaaggcagaaacatacctttgactataagaaattaaaaaaaaaacaccaaaataatatttttcttacttgatataccaaacttagtttaagtagataatgctaatacaaatatacacattgcacagaaaatacacatttactgtccaatttaaaactttggaattgctgtgattaaagtgatcaaaatgccaaaatactaaaggaaatcaattgttcacaggtaactacaatttgtattatctacaagtgcctttaaacacaagatataggtgctgtgtagcctgatagtgtgaaatgtttaatgagggagttgtaccacaaacagtactacaatgattctgaagcacagtgtattcagacagatacagtgaaccaagtgcaatatgtaaggatgaaagaagaagagatgacaaagaaatccaagtaaatgccttgtctttgcaaatgtttttatattaaatcataaggaaggaactacttgccttaaatgttaatatcaaaagagttttctaacaaggttaataccttagttcttaacattttttttctttatgtgtagtgttttcatgctaccttggtaggaaacttatttacaaaccatattaaaaggctaatttaaatataaataatataaagtgctctgaataaagcagaaatatattacagttcattccacagaaagcatccaaaccacccaaatgaccaaggcatatatagtatttggaggaatcaggggtttggaaggagtagggaggagaatgaaggaaaatgcaaccagcatgattatagtgtgttcatttagataaaagtagaaggcacaggagaggtagcaaaggccaggcttttctttggttttcttcaaacataggtgaaaaaaacactgccattcacaagtcaaggaacccagggccagctggaagtgtggagcacacatgctgtggagcacacatgctgtggagattgcagtgtgtctgaggtttgtgtagtagtggaagattttaggtatgtagagcaagttgaaaatggattgagactgcatggtggcataaatgagaaattgcctgtagcatctagtctacttgaaggaagtggagacataaggagagacaaaaacaggtttgtgccataaagtattttttcaaagacaccaagatgtggtaaatgaaaattattagttcacttccctgctgccatgaaactttgccttaagaaggtgctggattccaaggtttgtaaaggcatctcggtaaagactgctttttgaatgcatatgattttgcatcagctagactgagttgattctgaccagacttgatggttttaagtcggaaccgataaattttaaaaaggagaaaaaataatttgacctagtagtataaaacatgaggctttaatggtactttgctatgaaaagaaaacactgtattccttatgcaaaacacatgtatctttcattatttataagtggcctctcttagctcagttactcaattcatacgtagtattttttaaaataattttatatctgtgtaccaccccatatatttcatattactgtttcacatgtacagctttctacttctttgtaagaacaccaaccaaccaaggtttaagtgattaataggcttgagcaccgggtggcagatgttctatgcagtgtggttcaagtttctttgaccgcacttatatgcattgctaatatggaatttaagataccatacacagtctctcatggacctatctctattgtagaattatgacttatgtcttacttgccaaatttttctgaatgtgacctttttttgctgatttgctgggtttgggattaactagcattattttgccacctttatattgtatttataaaaaaaaaagtactatcaatcaatcatactactttggattgttgtgctggtgtaatgtggatttaacatcaataaatatttgacaaataatagttgcagttttgtgaagcaaaataaa

SEQ ID NO: 21482 - DNA, 2958 bp, Homo sapiens
attcgcgcgctggagaccggcggcctctcaccgagcctgagtcgtggccgctgcgccgccaggaggcttcccgggagccggcggggcccaggacctctcgagcgcagcaggcaaggggccggccttttggcagcgcggctgccagttaattttctccgttgcattctgcaaacgagatcgcattcagagcccagaagttgcaagctgggaataagcgagatctgaaagacccccaagaggagcttgtttgggagtgggggcagacggcgttttgcgcccaactgatggttctgtgaagggaaagaactgcacaacactcctgatattcaaatccactgtgagggaggggacctccataccctgatcatagcagaggcctttgaggacgacacaggtcgctacacctgtttggctacgaatcccagcggctcagacacaacatctgctgaggtgttcattgaaggtgccagttcaacagattctgacagtgaaagtttagctttcaaatcaagagctggagctatgccacaagctcaaaagaaaacaacttctgtttccttgacaataggatcatcatctccaaagacaggggtgaccacagctgtgattcaaccactgtctgtccctgtgcaacaggttcacagtccaacttcatatctctgccgacctgatggaaccactactgcctactttcctcctgtttttacaaaggaactgcaaaacacagccgtggcggaaggccaggtggtggttctggagtgccgggtccgtggggcaccccctctgcaggtccagtggtttcggcaagggagtgaaatccaagactctccagatttccgaattctacagaaaaaacctagatctacagctgaacctgaggagatttgcaccctagttatcgctgagactttccctgaagatgcagggatctttacatgttcagcaagaaatgattatggatcagcaaccagcactgcccagctggttgtcacctcagccaacactgaaaactgtagttacgagtcaatgggagaatccaacaatgaccacttccaacactttccacctccccctccaatcttggagacaagttccttggagttggcttcaaagaaaccatctgagatccagcaggtgaacaaccctgagttaggcctgagcagggcagcccttcaaatgcaattcaatgctgctgagagggaaacgaacggagtccatcccagccgtggagtaaatggactgattaacggcaaagctaacagtaataaatctcttccaacaccagctgtcctgctttcacccactaaggagccaccacctctgcttgccaaaccaaaactaggatttccaaagaaggccagtagaactgctagaatagcctccgatgaggaaattcaaggcacaaaggatgctgttattcaagacctggaacgaaaacttcgcttcaaggaggacctcctgaacaatggccagccgaggttaacatacgaagaaagaatggctcgtcgactgctaggtgctgacagtgcaactgtctttaatattcaggagccagaagaggaaacagctaatcaggaatacaaagtctccagctgtgaacagagactcatcagtgaaatagagtacaggctagaaaggtctcctgtggatgaatcaggtgatgaagttcagtatggagatgtgcctgtggaaaatggaatggcaccattctttgagatgaagctgaaacattacaagatctttgagggaatgccagtaactttcacatgtagagtggctggaaatccaaagccaaagatctattggtttaaagatgggaagcagatctctccaaagagtgatcactacaccattcaaagagatctcgatgggacctgctccctccataccacagcctccaccctagatgatgatgggaattatacaattatggctgcaaaccctcagggccgcatcagttgtactggacggctaatggtacaggctgtcaaccaaagaggtcgaagtccccggtctccctcaggccatcctcatgtcagaaggcctcgttctagatcaagggacagtggagacgaaaatgaaccaattcaggagcgattcttcagacctcacttcttgcaggctcctggagatctgactgttcaagaaggaaaactctgcagaatggactgcaaagtcagtgggttaccaaccccagatctaagctggcaactagatggaaagcccgtacgccctgacagtgctcacaagatgctggtgcgtgagaacggggtgcactctctgatcatagagccagtcacgtcacgtgatgccggcatctacacatgtatagctaccaaccgagcaggacagaactcattcagcctggagcttgtggttgctgctaaagaagcacacaaaccccctgtgtttattgagaagctccaaaacacaggagttgctgatgggtacccagtgcggctggaatgtcgtgtattgggagtgccaccacctcagatattttggaagaaagaaaatgaatcactcactcacagcactgaccgagtgagcatgcaccaggacaaccacggctacatctgcctgctcattcagggagccacaaaagaagatgctgggtggtatactgtgtcagccaagaatgaagcagggattgtgtcctgtactgccaggctggacgtttacacccagtggcatcagcagtcacagagcaccaagccaaaaaaagtacggccctcagccagtcgctatgcagcactttcggaccagggactagacatcaaagcagcgttccaacctgaggccaacccatctcacctgacactgaatactgccttggtagaaagtgaggacctgtaatccagcattcttgttaaagctgaaacactgaaacagccattgccttgaccaacatattcctttgtcacattatgtaaaaggcagaaacatacctttgactat

SEQ ID NO: 21483 - DNA, 5809 bp, Homo sapiens
gtgaccacggaccaggcagtctctaatgaataggcaaggccacaacctccattctcccagaaaagaagaaatgctcatctgaaattcatcacctctctggagtcttcaaactgaccaagcattgaaaagaacacagtttcagaaaacagtttccagtgcctctggccttcctactgaaagcagacacagagtgcatgaagaccgttcaaatatgtcagggacctcctcccatgagtccttctatgactccctctcagacatgcaggaagaaagcaagaatactgacttcttcccgggcctttctgctttcctcagccaggaagagataaacaagagtcttgacctggcccggagagccatagccgactccgaaacagaagattttgactcggaaaaggagatctcgcagattttcagtacttctcctgcaagcctctgtgaacatccttcccataaggagaccaaattgggtgaacacgcctcgaggagacctcaggataacaggtcaacacctgtccagcctctggcagagaaacaaactaagagtatctcttcacctgtttcaaagaggaaacctgccatgtcacccctgctcaccaggcccagctacatccggagcctccgaaaggctgaaaagcgtggtgcaaaaactcccagcacaaacgtaaagcccaaaacgccacatcaaagaaagggtggcccccagagccagctgtgtgacaaggcagctaatttaattgaggagctaacatccatatttaaagccgcaaagccaagaaacagaagcccaaatggggagtcctcgtcaccagacagtgggtacctgtctcctaaaaatcagccgtcagccctgctgagtgcctcagccagccagagccctatggaagaccaaggggagatggaaagagaggtcaagtcccctggggccaggcattgctaccaggacaaccaggacttggcagtgccacacaaccgcaagtctcacccacagccccacagcgccctccacttcccagctgcacctcgattcatccaaaagctgaggagccaagaagtagcagaagggagccgagtttatctggagtgtagagtcactggaaaccccactcctcgagtcagatggttctgtgaagggaaagaactgcacaacactcctgatattcaaatccactgtgagggaggggacctccataccctgatcatagcagaggcctttgaggacgacacaggtcgctacacctgtttggctacgaatcccagcggctcagacacaacatctgctgaggtgttcattgaaggtgccagttcaacagattctgacagtgaaagtttagctttcaaatcaagagctggagctatgccacaagctcaaaagaaaacaacttctgtttccttgacaataggatcatcatctccaaagacaggggtgaccacagctgtgattcaaccactgtctgtccctgtgcaacaggttcacagtccaacttcatatctctgccgacctgatggaaccactactgcctactttcctcctgtttttacaaaggaactgcaaaacacagccgtggcggaaggccaggtggtggttctggagtgccgggtccgtggggcaccccctctgcaggtccagtggtttcggcaagggagtgaaatccaagactctccagatttccgaattctacagaaaaaacctagatctacagctgaacctgaggagatttgcaccctagttatcgctgagactttccctgaagatgcagggatctttacatgttcagcaagaaatgattatggatcagcaaccagcactgcccagctggttgtcacctcagccaacactgaaaactgtagttacgagtcaatgggagaatccaacaatgaccacttccaacactttccacctccccctccaatcttggagacaagttccttggagttggcttcaaagaaaccatctgagatccagcaggtgaacaaccctgagttaggcctgagcagggcagcccttcaaatgcaattcaatgctgctgagagggaaacgaacggagtccatcccagccgtggagtaaatggactgattaacggcaaagctaacagtaataaatctcttccaacaccagctgtcctgctttcacccactaaggagccaccacctctgcttgccaaaccaaaactaggatttccaaagaaggccagtagaactgctagaatagcctccgatgaggaaattcaaggcacaaaggatgctgttattcaagacctggaacgaaaacttcgcttcaaggaggacctcctgaacaatggccagccgaggttaacatacgaagaaagaatggctcgtcgactgctaggtgctgacagtgcaactgtctttaatattcaggagccagaagaggaaacagctaatcaggaatacaaagtctccagctgtgaacagagactcatcagtgaaatagagtacaggctagaaaggtctcctgtggatgaatcaggtgatgaagttcagtatggagatgtgcctgtggaaaatggaatggcaccattctttgagatgaagctgaaacattacaagatctttgagggaatgccagtaactttcacatgtagagtggctggaaatccaaagccaaagatctattggtttaaagatgggaagcagatctctccaaagagtgatcactacaccattcaaagagatctcgatgggacctgctccctccataccacagcctccaccctagatgatgatgggaattatacaattatggctgcaaaccctcagggccgcatcagttgtactggacggctaatggtacaggctgtcaaccaaagaggtcgaagtccccggtctccctcaggccatcctcatgtcagaaggcctcgttctagatcaagggacagtggagacgaaaatgaaccaattcaggagcgattcttcagacctcacttcttgcaggctcctggagatctgactgttcaagaaggaaaactctgcagaatggactgcaaagtcagtgggttaccaaccccagatctaagctggcaactagatggaaagcccgtacgccctgacagtgctcacaagatgctggtgcgtgagaacggggtgcactctctgatcatagagccagtcacgtcacgtgatgccggcatctacacatgtatagctaccaaccgagcaggacagaactcattcagcctggagcttgtggttgctgctaaagaagcacacaaaccccctgtgtttattgagaagctccaaaacacaggagttgctgatgggtacccagtgcggctggaatgtcgtgtattgggagtgccaccacctcagatattttggaagaaagaaaatgaatcactcactcacagcactgaccgagtgagcatgcaccaggacaaccacggctacatctgcctgctcattcagggagccacaaaagaagatgctgggtggtatactgtgtcagccaagaatgaagcagggattgtgtcctgtactgccaggctggacgtttacatttctcgacattaatagtgaaccacaccaggagaacaaatacccaacccagtggcatcagcagtcacagagcaccaagccaaaaaaagtacggccctcagccagtcgctatgcagcactttcggaccagggactagacatcaaagcagcgttccaacctgaggccaacccatctcacctgacactgaatactgccttggtagaaagtgaggacctgtaatccagcattcttgttaaagctgaaacactgaaacagccattgccttgaccaacatattcctttgtcacattatgtaaaaggcagaaacatacctttgactataagaaattaaaaaaaaaacaccaaaataatatttttcttacttgatataccaaacttagtttaagtagataatgctaatacaaatatacacattgcacagaaaatacacatttactgtccaatttaaaactttggaattgctgtgattaaagtgatcaaaatgccaaaatactaaaggaaatcaattgttcacaggtaactacaatttgtattatctacaagtgcctttaaacacaagatataggtgctgtgtagcctgatagtgtgaaatgtttaatgagggagttgtaccacaaacagtactacaatgattctgaagcacagtgtattcagacagatacagtgaaccaagtgcaatatgtaaggatgaaagaagaagagatgacaaagaaatccaagtaaatgccttgtctttgcaaatgtttttatattaaatcataaggaaggaactacttgccttaaatgttaatatcaaaagagttttctaacaaggttaataccttagttcttaacattttttttctttatgtgtagtgttttcatgctaccttggtaggaaacttatttacaaaccatattaaaaggctaatttaaatataaataatataaagtgctctgaataaagcagaaatatattacagttcattccacagaaagcatccaaaccacccaaatgaccaaggcatatatagtatttggaggaatcaggggtttggaaggagtagggaggagaatgaaggaaaatgcaaccagcatgattatagtgtgttcatttagataaaagtagaaggcacaggagaggtagcaaaggccaggcttttctttggttttcttcaaacataggtgaaaaaaacactgccattcacaagtcaaggaacccagggccagctggaagtgtggagcacacatgctgtggagcacacatgctgtggagattgcagtgtgtctgaggtttgtgtagtagtggaagattttaggtatgtagagcaagttgaaaatggattgagactgcatggtggcataaatgagaaattgcctgtagcatctagtctacttgaaggaagtggagacataaggagagacaaaaacaggtttgtgccataaagtattttttcaaagacaccaagatgtggtaaatgaaaattattagttcacttccctgctgccatgaaactttgccttaagaaggtgctggattccaaggtttgtaaaggcatctcggtaaagactgctttttgaatgcatatgattttgcatcagctagactgagttgattctgaccagacttgatggttttaagtcggaaccgataaattttaaaaaggagaaaaaataatttgacctagtagtataaaacatgaggctttaatggtactttgctatgaaaagaaaacactgtattccttatgcaaaacacatgtatctttcattatttataagtggcctctcttagctcagttactcaattcatacgtagtattttttaaaataattttatatctgtgtaccaccccatatatttcatattactgtttcacatgtacagctttctacttctttgtaagaacaccaaccaaccaaggtttaagtgattaataggcttgagcaccgggtggcagatgttctatgcagtgtggttcaagtttctttgaccgcacttatatgcattgctaatatggaatttaagataccatacacagtctctcatggacctatctctattgtagaattatgacttatgtcttacttgccaaatttttctgaatgtgacctttttttgctgatttgctgggtttgggattaactagcattattttgccacctttatattgtatttataaaaaaaaaagtactatcaatcaatcatactactttggattgttgtgctggtgtaatgtggatttaacatcaataaatatttgacaaataatagttgcagttttgtgaagcaaaataaatattcagtttta

SEQ ID NO: 21484 - DNA, 2320 bp, Homo sapiens
aagaatactgacttcttcccgggcctttctgctttcctcagccaggaagagataaacaagagtcttgacctggcccggagagccatagccgactccgaaacagaagattttgactcggaaaaggagatctcgcagattttcagtacttctcctgcaagcctctgtgaacatccttcccataaggagaccaaattgggtgaacacgcctcgaggagacctcaggataacaggtcaacacctgtccagcctctggcagagaaacaaactaagagtatctcttcacctgtttcaaagaggaaacctgccatgtcacccctgctcaccaggcccagctacatccggagcctccgaaaggctgaaaagcgtggtgcaaaaactcccagcacaaacgtaaagcccaaaacgccacatcaaagaaagggtggcccccagagccagctgtgtgacaaggcagctaatttaattgaggagctaacatccatatttaaagccgcaaagccaagaaacagaagcccaaatggggagtcctcgtcaccagacagtgggtacctgtctcctaaaaatcagccgtcagccctgctgagtgcctcagccagccagagccctatggaagaccaaggggagatggaaagagaggtcaagtcccctggggccaggcattgctaccaggacaaccaggacttggcagtgccacacaaccgcaagtctcacccacagccccacagcgccctccacttcccagctgcacctcgattcatccaaaagctgaggagccaagaagtagcagaagggagccgagtttatctggagtgtagagtcactggaaaccccactcctcgagtcagatggttctgtgaagggaaagaactgcacaacactcctgatattcaaatccactgtgagggaggggacctccataccctgatcatagcagaggcctttgaggacgacacaggtcgctacacctgtttggctacgaatcccagcggctcagacacaacatctgctgaggtgttcattgaaggtgccagttcaacagattctgacagtgaaagtttagctttcaaatcaagagctggagctatgccacaagctcaaaagaaaacaacttctgtttccttgacaataggatcatcatctccaaagacaggggtgaccacagctgtgattcaaccactgtctgtccctgtgcaacaggttcacagtccaacttcatatctctgccgacctgatggaaccactactgcctactttcctcctgtttttacaaaggaactgcaaaacacagccgtggcggaaggccaggtggtggttctggagtgccgggtccgtggggcaccccctctgcaggtccagtggtttcggcaagggagtgaaatccaagactctccagatttccgaattctacagaaaaaacctagatctacagctgaacctgatgtcttatacgtctttgttcgagtgagatgccaccagatgaaaattcagtattacaacctggctcatctcatttcctcatggctttcttcatttttataatgtcagaaccatacaagctatgatgcttctttctctcaacaaaatgtgagcctcttgtcactgttggatgaacttttctttgagaagaaaagctgaggaacctgtgggacattgtattcaaattttatctagttaaaaaaaaattatctagcaaaaattgctgtgacatttcaatgcatgaggatcactaaaagaacatcctagtgtttattttttatttttctatttttgttctttaattctgtaatttttctaaatgttccacgtgaactatatacaggcatataccttatttatgcatggaagtattcctataaaatcatacacaatgaattctgctcaatcaactttgaaacacacaaaggaagcttgtaggaaaattggtcttactgagaattcctttagaaaatagtctttttacaaagcaagtgtttttttccttcatctaaatttcatgcatgcatttatttaaacataattatagggagcctaccatgtgtgagatgctaagaatatggccatgaacaaaaattgtttctgcactcagaggttatatttcagcgaaccagaaactaacaaactaattacacaataaattatttagcagggtgaggtggcacatagtcccagctacccaggaggctgaggcaggaggattgcttgagcccaggagttcaaggctgcagtgagctatgatcatgccacttcactccagcctgggcaacagtgaaacccctgtttctaaaaaaaagattttaaaaataaaataaaacaaaattgc

SEQ ID NO: 21485 - DNA, 6435 bp, Homo sapiens
gtgaccacggaccaggcagtctctaatgaataggcaaggccacaacctccattctcccagaaaagaagaaatgctcatctgaaattcatcacctctctggagtcttcaaactgaccaagcattgaaaagaacacagtttcagaaaacagtttccagtgcctctggccttcctactgaaagcagacacagagtgcatgaagaccgttcaaatatgtcagggacctcctcccatgagtccttctatgactccctctcagacatgcaggaagaaagcaagaatactgacttcttcccgggcctttctgctttcctcagccaggaagagataaacaagagtcttgacctggcccggagagccatagccgactccgaaacagaagattttgactcggaaaaggagatctcgcagattttcagtacttctcctgcaagcctctgtgaacatccttcccataaggagaccaaattgggtgaacacgcctcgaggagacctcaggataacaggtcaacacctgtccagcctctggcagagaaacaaactaagagtatctcttcacctgtttcaaagaggaaacctgccatgtcacccctgctcaccaggcccagctacatccggagcctccgaaaggctgaaaagcgtggtgcaaaaactcccagcacaaacgtaaagcccaaaacgccacatcaaagaaagggtggcccccagagccagctgtgtgacaaggcagctaatttaattgaggagctaacatccatatttaaagccgcaaagccaagaaacagaagcccaaatggggagtcctcgtcaccagacagtgggtacctgtctcctaaaaatcagccgtcagccctgctgagtgcctcagccagccagagccctatggaagaccaaggggagatggaaagagaggtcaagtcccctggggccaggcattgctaccaggacaaccaggacttggcagtgccacacaaccgcaagtctcacccacagccccacagcgccctccacttcccagctgcacctcgattcatccaaaagctgaggagccaagaagtagcagaagggagccgagtttatctggagtgtagagtcactggaaaccccactcctcgagtcagatggttctgtgaagggaaagaactgcacaacactcctgatattcaaatccactgtgagggaggggacctccataccctgatcatagcagaggcctttgaggacgacacaggtcgctacacctgtttggctacgaatcccagcggctcagacacaacatctgctgaggtgttcattgaaggtgccagttcaacagattctgacagtgaaagtttagctttcaaatcaagagctggagctatgccacaagctcaaaagaaaacaacttctgtttccttgacaataggatcatcatctccaaagacaggggtgaccacagctgtgattcaaccactgtctgtccctgtgcaacaggttcacagtccaacttcatatctctgccgacctgatggaaccactactgcctactttcctcctgtttttacaaaggaactgcaaaacacagccgtggcggaaggccaggtggtggttctggagtgccgggtccgtggggcaccccctctgcaggtccagtggtttcggcaagggagtgaaatccaagactctccagatttccgaattctacagaaaaaacctagatctacagctgaacctgaggagatttgcaccctagttatcgctgagactttccctgaagatgcagggatctttacatgttcagcaagaaatgattatggatcagcaaccagcactgcccagctggttgtcacctcagccaacactgaaaactgtagttacgagtcaatgggagaatccaacaatgaccacttccaacactttccacctccccctccaatcttggagacaagttccttggagttggcttcaaagaaaccatctgagatccagcaggtgaacaaccctgagttaggcctgagcagggcagcccttcaaatgcaattcaatgctgctgagagggaaacgaacggagtccatcccagccgtggagtaaatggactgattaacggcaaagctaacagtaataaatctcttccaacaccagctgtcctgctttcacccactaaggagccaccacctctgcttgccaaaccaaaactggaccctctgaagctccagcaactccagaaccaaatccgactggagcaggaggccggcgctcggcagcctccgccagccccgcgcagcgcgccgccctcgccccccttcccgccgccgcccgccttccccgagctcgcggcctgcacgccgcccgcgtccccggagcccatgagcgcgctggcctcccgctccgcccccgccatgcagtcctccggctccttcaactacgcgcgccccaagcagttcatcgccgcgcagaacctcgggcccgcgtcgggccacggcacgccggcctccagccccagctcgtccagcctcccgtcgcccatgtccccgacgccgaggcagttcggccgcgcccccgtgccgcccttcgcgcagcccttcggcgctgagcccgaggccccgtggggctcctcctcgccgtcgcccccgcccccgccacccccggtcttcagccccacggctgccttcccggtgcccgacgtgttcccactgccgccgccaccaccgccgctcccgagcccgggacaggcgtcccactgctcgtcgcctgccacccgcttcggccacagccagacgcccgcggccttcctcagcgctctgctgccctcgcagccgccgccggcggccgtcaacgccctggggctgcccaagggtgtcacccccgcaggatttccaaagaaggccagtagaactgctagaatagcctccgatgaggaaattcaaggcacaaaggatgctgttattcaagacctggaacgaaaacttcgcttcaaggaggacctcctgaacaatggccagccgaggttaacatacgaagaaagaatggctcgtcgactgctaggtgctgacagtgcaactgtctttaatattcaggagccagaagaggaaacagctaatcaggaatacaaagtctccagctgtgaacagagactcatcagtgaaatagagtacaggctagaaaggtctcctgtggatgaatcaggtgatgaagttcagtatggagatgtgcctgtggaaaatggaatggcaccattctttgagatgaagctgaaacattacaagatctttgagggaatgccagtaactttcacatgtagagtggctggaaatccaaagccaaagatctattggtttaaagatgggaagcagatctctccaaagagtgatcactacaccattcaaagagatctcgatgggacctgctccctccataccacagcctccaccctagatgatgatgggaattatacaattatggctgcaaaccctcagggccgcatcagttgtactggacggctaatggtacaggctgtcaaccaaagaggtcgaagtccccggtctccctcaggccatcctcatgtcagaaggcctcgttctagatcaagggacagtggagacgaaaatgaaccaattcaggagcgattcttcagacctcacttcttgcaggctcctggagatctgactgttcaagaaggaaaactctgcagaatggactgcaaagtcagtgggttaccaaccccagatctaagctggcaactagatggaaagcccgtacgccctgacagtgctcacaagatgctggtgcgtgagaacggggtgcactctctgatcatagagccagtcacgtcacgtgatgccggcatctacacatgtatagctaccaaccgagcaggacagaactcattcagcctggagcttgtggttgctgctaaagaagcacacaaaccccctgtgtttattgagaagctccaaaacacaggagttgctgatgggtacccagtgcggctggaatgtcgtgtattgggagtgccaccacctcagatattttggaagaaagaaaatgaatcactcactcacagcactgaccgagtgagcatgcaccaggacaaccacggctacatctgcctgctcattcagggagccacaaaagaagatgctgggtggtatactgtgtcagccaagaatgaagcagggattgtgtcctgtactgccaggctggacgtttacacccagtggcatcagcagtcacagagcaccaagccaaaaaaagtacggccctcagccagtcgctatgcagcactttcggaccagggactagacatcaaagcagcgttccaacctgaggccaacccatctcacctgacactgaatactgccttggtagaaagtgaggacctgtaatccagcattcttgttaaagctgaaacactgaaacagccattgccttgaccaacatattcctttgtcacattatgtaaaaggcagaaacatacctttgactataagaaattaaaaaaaaaacaccaaaataatatttttcttacttgatataccaaacttagtttaagtagataatgctaatacaaatatacacattgcacagaaaatacacatttactgtccaatttaaaactttggaattgctgtgattaaagtgatcaaaatgccaaaatactaaaggaaatcaattgttcacaggtaactacaatttgtattatctacaagtgcctttaaacacaagatataggtgctgtgtagcctgatagtgtgaaatgtttaatgagggagttgtaccacaaacagtactacaatgattctgaagcacagtgtattcagacagatacagtgaaccaagtgcaatatgtaaggatgaaagaagaagagatgacaaagaaatccaagtaaatgccttgtctttgcaaatgtttttatattaaatcataaggaaggaactacttgccttaaatgttaatatcaaaagagttttctaacaaggttaataccttagttcttaacattttttttctttatgtgtagtgttttcatgctaccttggtaggaaacttatttacaaaccatattaaaaggctaatttaaatataaataatataaagtgctctgaataaagcagaaatatattacagttcattccacagaaagcatccaaaccacccaaatgaccaaggcatatatagtatttggaggaatcaggggtttggaaggagtagggaggagaatgaaggaaaatgcaaccagcatgattatagtgtgttcatttagataaaagtagaaggcacaggagaggtagcaaaggccaggcttttctttggttttcttcaaacataggtgaaaaaaacactgccattcacaagtcaaggaacccagggccagctggaagtgtggagcacacatgctgtggagcacacatgctgtggagattgcagtgtgtctgaggtttgtgtagtagtggaagattttaggtatgtagagcaagttgaaaatggattgagactgcatggtggcataaatgagaaattgcctgtagcatctagtctacttgaaggaagtggagacataaggagagacaaaaacaggtttgtgccataaagtattttttcaaagacaccaagatgtggtaaatgaaaattattagttcacttccctgctgccatgaaactttgccttaagaaggtgctggattccaaggtttgtaaaggcatctcggtaaagactgctttttgaatgcatatgattttgcatcagctagactgagttgattctgaccagacttgatggttttaagtcggaaccgataaattttaaaaaggagaaaaaataatttgacctagtagtataaaacatgaggctttaatggtactttgctatgaaaagaaaacactgtattccttatgcaaaacacatgtatctttcattatttataagtggcctctcttagctcagttactcaattcatacgtagtattttttaaaataattttatatctgtgtaccaccccatatatttcatattactgtttcacatgtacagctttctacttctttgtaagaacaccaaccaaccaaggtttaagtgattaataggcttgagcaccgggtggcagatgttctatgcagtgtggttcaagtttctttgaccgcacttatatgcattgctaatatggaatttaagataccatacacagtctctcatggacctatctctattgtagaattatgacttatgtcttacttgccaaatttttctgaatgtgacctttttttgctgatttgctgggtttgggattaactagcattattttgccacctttatattgtatttataaaaaaaaaagtactatcaatcaatcatactactttggattgttgtgctggtgtaatgtggatttaacatcaataaatatttgacaaataatagttgcagttttgtgaagcaaaataaatattcagtttta

SEQ ID NO: 21486 - DNA, 628 bp, Homo sapiens
tggaaagcccgtacgccctgacagtgctcacaagatgctggtgcgtgagaacggggtgcactctctgatcatagagccagtcacgtcacgtgatgccggcatctacacatgtatagctaccaaccgagcaggacagaactcattcagcctggagcttgtggttgctgctaaagaagcacacaaaccccctgtgtttattgagaagctccaaaacacaggagttgctgatgggtacccagtgcggctggaatgtcgtgtattgggagtgccaccacctcagatattttggaagaaagaaaatgaatcactcactcacagcactgaccgagtgagcatgcaccaggacaaccacggctacatctgcctgctcattcagggagccacaaaagaagatgctgggtggtatactgtgtcagccaagaatgaagcagggattgtgtcctgtactgccaggctggacgtttacatttctcgacattaatagtgaaccacaccaggagaacaaatacccaagtatcattcaggaactttgaattattagcaaaatatgcatgttgatttctcttacattggctagttagttgtggcttccttactcaagcatccttaggagttaacagtaggcaaa

SEQ ID NO: 21487 - DNA, 2320 bp, Homo sapiens; identical to SEQ ID NO: 21484

SEQ ID NO: 21488 - DNA, 576 bp, Homo sapiens
agaaaagaagaaatgctcatctgaaattcatcacctctctggagtcttcaaactgaccaagcattgaaaagctctcacttcagagtccaagaaggacacatctaatcgctgtctaggccaagtgccaagacttgtgcccagtctccaagcggctgggaaagaaaatacttggagatttcacatcccattacaagtgagttcagtttctcactgagcctcagaatatgaggaattctccaaaatgaagacgtccagatgacagcaacaccaaacgtgaaaccatgataaatgtgtgcaccccctggattactgcacaagccttctcacggaccgccctactgtcagtcttgtcttcctctttccctacctctgtcccggatccagactgcaatcagttatctctcaaaaataacacagtttcagaaaacagtttccagtgcctctggccttcctactgaaagcagacacagagtgcatgaagaccgttcaaatatgtcagggacctcctcccatgagtccttctatgactccctctcagacatgcaggaagaaagcaagaatactgacttcttcccg

SEQ ID NO: 21489 - DNA, 3941 bp, Homo sapiens
acactgcgtccggggccagacgacgatatcagcgcggggtccccacaacgccatggggcagagccaactctcgagcgcgtgatcgaagcccgcagttttttcgcccccgtcacttccgggtgcgacaatctcttctgtccggccagccgctggagtcgttaggtgccgccttgcttctgacgagccacacgtttgcttcttccctgtgttcccagctggagggacatgagtgtccctgggccgtcgtctccggacggggccctgacacggccaccctactgcctggaggccggggagccgacgcctggtttaagtgacacttctccagatgaagggttaatagaggacttgactatagaagacaaagcagtggagcaactggcagaaggattgctttctcattatttgccagatctgcagagatcaaaacaagccctccaggaactcacacagaaccaagttgtattgttagacacactggaacaagagatttcaaaatttaaagaatgtcattctatgttggatattaatgctttgtttgctgaggctaaacactatcatgccaagttggtgaatataagaaaagagatgctgatgcttcatgaaaaaacatcaaagttaaaaaaaagagcacttaaactgcagcagaagaggcaaaaagaagagttggaaagggagcagcaacgagagaaggagtttgaaagagaaaagcagttaactgccagaccagccaaaaggatgtgaaaagttgtgtttgtgtgttttcttctcctgtcccatatttgggttatgatgactcaagtgtagactgaagttgaggtagtgccttatgccattatgtcatatgttgaaatccttattccggtattactgtgtctccatgccttttttccaagtagcagacgtcatgttgcatggtttttgatatttatatgtaagtttttcaaattttgcttaattttaaaatttattattttgatcttgaattatttataaactggaaagtggtttgattattgtgagtcaaaactctaagtggttaaaaattagtatgaattttttagcttcttaatgaatatggatttaaaactctccagttcttattttatgaaatgacttgcctttctggtaatacaatgctgattttttagtaattgccttttcattactttgttaagaagaaatgccagctgtttaatcacacctacccctggaaaagaggtaaaccttttgaacagttgaatttcatcagaagctctatagctttttggtgagaggaagtgatactctttattacaagaaacaaggaattaacaaaaataaggaacttgttgctacctttcttttctgttgaacattaaaaataatttggtttgtggactgggcatggtggcttatggaaaagaggtgagcctttgtgaagaacataatggaaaagtgcatgtacgggaaataacagcactttaggtgtagttcaggtgagcaagatgccagatagtttctactaaccatatactctttctgcttcttagcgtcgttgtcactgcttctgtggcttttgggttcaaagtagattatatatattcctaaagcttggtggaggtagtggagctatcacacactcaaatgagcttgtatatttataatacaatatagtattatagtaacagttatcatacactgagatatagtttctgtgcttgtaaaaaattcttgaagtgaggccgggtgcggtggctcatgcctgtaatcccaacgctttgggacgccgaggcgggtggatcatgaggtcaaaagattgagaccatcctggccaacatggtgaaaccccgtctctactagaaatacaaaaattagctgggtgtgggggcgtgcgcctgtagtcccagctacttgggaggctgaggcaggagaattgcttgaacccaggaggcagaggttgcagtaagccaagatcgtgccactgcactccagccttggtgacagagcaagactccgtctccaaaaaaaagaaaaaaaaatttcttgaagtggaatgatgtacaccaaatacccactttatagataattacagggatggtgaaaaattagtaaatagcttcacaaaagaggcagcgtgatacctttagtgttttctagaatttttttctggatattatatgtaagaatttattgtttgagggaaatacgaggtttcattgtttaaaatcaagagtgtattgtttactgttttacagtattatttaatatccaactggtctccaatctccattacatagggactgtacagagcctgtgaagatgtatgaatggtatcttttataatccacaatacatttctggtaagatggaatcactacctctgatcacatatcaggctaacgatagagaaagcattaggtttaagttgagggctaagaactggtttgtttaaaggtttaaattgttggaaaagagcatttgccttctttaatgaatgatggtctcacaattcagttgactttgacctaatatttaagaatataaatatattttatttgaaaggctgagtgttgccctcaaacacttgctaaaactgcctagggcaggattcattagggcttgcagacaatgtcacctaaattgctgaatgtactcattataatatgatatctgacaaaggtagtacagcgtttctgagtcatttgggaccaactgcagtggttgtttaaaatgctggttcctgcacacaattctctatctactgaagcacatctgttttctttgtttgttttgctttgctttttgtttttaaagtttcccccagtgattccagtgcacctgaaaagttgagaaccacaggcttagtggtacgttggggtttcccacgctaggctgcatagcattataacctgggaacgttaaaaaaaatacagacattcttgattcttagtgtagttatgatgtggatcctacgtattttttaaaaaactctccagataattttgatgtcacgagtcactagtatagactatctatctagtgagttgtattataagcgatgaaatactttaaaagctacccagtaactcttgggattaattttatgaaataaattctgagctgctgcttttgatatagtcagacttaagactgaaccccagtagacaggcaatagatatagaattctggttagctaattgaacttttgtgacctgtttaaaaacaaatcaaatttattgaacaaatgacaaggcacaaatactttcagaattgtatttcagttttgaagatttaaaaaaaatgtgaaaataaatatatattagtatcctttattttaaagtcaattgtaaaccagaagtactgttattttggtgattaaaatccaaaactttagctgtatttcagtaacaaaaacataccttactagactgtgatggctcacacctgtaatcccagtgctttgggaggctgaggtgggaagattctttgagcccaggagttcaaggctgcagtgaattctgatcgcaccactgaactccagcccgtatgacagagtgagaccctgtttctaaaaacaaaacaaacaaacaaacaaacaacgtatcttactgactaaactggaatggaaatcttataattagtgttgtatttttctgcaaaatagtgaattggtacttgggagacttctgttctttgttgaaaaaaattgcctttgttttgaaattatatcacctgtgttctgaactaaaatgatgggagttcattttgtatttactttgcagtaagtatcatgtaaatatgcaaatgttgaatgtaatatagattgtgtcctcattgagtttttgggtgatacagtttataaatataacaattatacaccctcatacattcgtctgattttgagcttgtaagatgagaactgctttttacacatttaataaaaaaaggtctctgaatta

SEQ ID NO: 21490 - DNA, 827 bp, Homo sapiens
gtgacacagcgaagatggcgtcgcccggctgcctgtggctcttggctgtggctctcctgccatggacctgcgcttctcgggcgctgcagcatctggacccgccggcgccgctgccgttggtgatctggcatgggatggggtctcgttatgttgcccaaactggtctcgaactcttggcctcaagcaatcctcctgcctcgtcttaccaaagcgctgggatgataggagacagctgttgcaatcccttaagcatgggtgctattaaaaaaatggtggagaagaaaatacctggaatttacgtcttatctttagagattgggaagaccctgatggaggacgtggagaacagcttcttcttgaatgtcaattcccaagtaacaacagtgtgtcaggcacttgctaaggatcctaaattgcagcaaggctacaatgctatgggattctcccagggaggccaatttctgagggcagtggctcagagatgcccttcacctcccatgatcaatctgatctcggttgggggacaacatcaaggtgtttttggactccctcgatgcccaggagagagctctcacatctgtgacttcatccgaaaaacactgaatgctggggcgtactccaaagttgttcaggaacgcctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggag

SEQ ID NO: 21491 - DNA, 2740 bp, Homo sapiens
atgtttcttgcaaaggcagtacagggcagtggtgaagagcaacgactttggaaccaccaatttgctatctctgtgaccttgggcaccttactcagtgccaattcgcagtgcctcagtgtcctcacctgtcagggggagaagtgcatacagcattgttatgaagagtgaattagttaaaggttgtaagaatagtgcctgatagcatctgatcagcactgaatatatgttagcaattattttgattcaccgcagagggcggtctacgagagcgcagagccccactcggccagcggggtctggcgggggacctgtcgcgctgaaagctccagggtagggccgacgcccatcaggctgggcatccgttcgggatgcgcaggttgcgatctgcaaccggcggcgccacgcccaggcgggcggagcgcggttcccggagtctcgcgcccgcggtcatgtgacacagcgaagatggcgtcgcccggctgcctgtggctcttggctgtggctctcctgccatggacctgcgcttctcgggcgctgcagcatctggacccgccggcgccgctgccgttggtgatctggcatgggatgggagacagctgttgcaatcccttaagcatgggtgctattaaaaaaatggtggagaagaaaatacctggaatttacgtcttatctttagagattgggaagaccctgatggaggacgtggagaacagcttcttcttgaatgtcaattcccaagtaacaacagtgtgtcaggcacttgctaaggatcctaaattgcagcaaggctacaatgctatgggattctcccagggaggccaatttctgagggcagtggctcagagatgcccttcacctcccatgatcaatctgatctcggttgggggacaacatcaaggtgtttttggactccctcgatgcccaggagagagctctcacatctgtgacttcatccgaaaaacactgaatgctggggcgtactccaaagttgttcaggaacgcctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggagtggtttggattttacagaagtggccaagccaaggaaaccattcccttacaggagacctccctgtacacacaggaccgcctggggctaaaggaaatggacaatgcaggacagctagtgtttctggctacagaaggggaccatcttcagttgtctgaagaatggttttatgcccacatcataccattccttggatgaaacccgtatagttcacaatagagctcagggagcccctaactcttccaaaccacatgggagacagtttccttcatgcccaagcctgagctcagatccagcttgcaactaatccttctatcatctaacatgccctacttggaaagatctaagatctgaatcttatcctttgccatcttctgttaccatatggtgttgaatgcaagtttaattaccatggagattgttttacaaacttttgatgtggtcaagttcagttttagaaaagggagtctgttccagatcagtgccagaactgtgcccaggcccaaaggagacaactaactaaagtagtgagatagattctaagggcaaacatttttccaagtcttgccatatttcaagcaaagaggtgcccaggcctgaggtactcacataaatgctttgttttgctggtgatttaaccagtgcttggaaaaatcttgcttggctatttctgcatcatttcttaaggctgccttcctctctcagtacgttgccctctgtgctatcatcttatcatcaattattagacaaatcccactggcctacagtcttgcttctgcagcacccactttgtctcctcaggtagtgatgaattagttgctgtcacaaaaggagggaagtagcacccaaattaagttgcttaagagaggaaatgtacatcttgtataacttagggagcgaagaaaatgtaggcgcgaaagtgaaaagtgaggcagctagttcttcctattccattctcgaccaacctgccctttcttaatatgactagtggtcttgatgctagagtcaacttactctgttgctggctttagcagagaataggaggaaccatatgaaaaagatcaggctttctgacttccatccccaaaacacatttaccagcatactccaaactgtttctgatgtgttccatgagaaaaggattgtttgctcaaaaagcttggaaaatactacacactccctttctccttctggagatcaacccacattagagtgtctaaggactcctgagaattcctgttacagtaaacaaaactaacgtaatctaccatttcctacactatttgagcatggaaatcatagtccccactctgtgaaaacttaacgctttttggaagacatttctgtagcatgtcagtttggagaaatgatgagctacgccttgatgaaagaaccgtgttggtgctgctaagtttagccattatggtttttcctttctctctcttaagccttattcttcaactaaaagatgaggattaagagcaagaagttgggggggatgtgaaaataattttatgaggttgtctaaaataaagagtagtttcttatcctt

SEQ ID NO: 21492 - DNA, 849 bp, Homo sapiens
gtgacacagcgaagatggcgtcgcccggctgcctgtggctcttggctgtggctctcctgccatggacctgcgcttctcgggcgctgcagcatctggacccgccggcgccgctgccgttggtgatctggcatgggatgggtgtttttggactccctcgatgcccaggagagagctctcacatctgtgacttcatccgaaaaacactgaatgctggggcgtactccaaagttgttcaggaacgcctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggagtggtttggattttacagaagtggccaagccaaggaaaccattcccttacaggagacctccctgtacacacaggaccgcctggggctaaaggaaatggacaatgcaggacagctagtgtttctggctacagaaggggaccatcttcagttgtctgaagaatggttttatgcccacatcataccattccttggatgaaacccgtatagttcacaatagagctcagggagcccctaactcttccaaaccacatgggagacagtttccttcatgcccaagcctgagctcagatccagcttgcaactaatccttctatcatctaacatgccctacttggaaagatctaagatctgaatcttatcctttgccatcttctgttaccatatggtgttgaatgcaagtttaattaccatggagattg

SEQ ID NO: 21493 - DNA, 1836 bp, Homo sapiens
agcgaagatggcgtcgcccggctgcctgtggctcttggctgtggctctcctgccatggacctgcgcttctcgggcgctgcagcatctggacccgccggcgccgctgccgttggtgatctggcatgggatgggagacagctgttgcaatcccttaagcatgggtgctattaaaaaaatggtggagaagaaaatacctggaatttacgtcttatctttagagattgggaagaccctgatggaggacgtggagaacagcttcttcttgaatgtcaattcccaagtaacaacagtgtgtcaggcacttgctaaggatcctaaattgcagcaaggctacaatgctatgggattctcccagggaggccaatttctgagggcagtggctcagagatgcccttcacctcccatgatcaatctgatctcggttgggggacaacatcaaggtgtttttggactccctcgatgcccaggagagagctctcacatctgtgacttcatccgaaaaacactgaatgctggggcgtactccaaagttgttcaggaacgcctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggagtggtttggattttacagaagtggccaagccaaggaaaccattcccttacaggagacctccctgtacacacaggaccgcctggggctaaaggaaatggacaatgcaggacagctagtgtttctggctacagaaggggaccatcttcagttgtctgaagaatggttttatgcccacatcataccattccttggatgaaacccgtatagttcacaatagagctcagggagcccctaactcttccaaaccacatgggagacagtttccttcatgcccaagcctgagctcagatccagcttgcaactaatccttctatcatctaacatgccctacttggaaagatctaagatctgaatcttatcctttgccatcttctgttaccatatggtgttgaatgcaagtttaattaccatggagattgttttacaaacttttgatgtggtcaagttcagttttagaaaagggagtctgttccagatcagtgccagaactgtgcccaggcccaaaggagacaactaactaaagtagtgagatagattctaagggcaaacatttttccaagtcttgccatatttcaagcaaagaggtagtgatgaattagttgctgtcacaaaaggagggaagtagcacccaaattaagttgcttaagagaggaaatgtacatcttgtataacttagggagcgaagaaaatgtaggcgcgaaagtgaaaagtgaggcagctagttcttcctattccattctcgaccaacctgccctttcttaatatgactagtggtcttgatgctagagtcaacttactctgttgctggctttagcagagaataggaggaaccatatgaaaaagatcaggctttctgacttccatccccaaaacacatttaccagcatactccaaactgtttctgatgtgttccatgagaaaaggattgtttgctcaaaaagcttggaaaatactacacactccctttctccttctggagatcaacccacattagagtgtctaaggactcctgagaattcctgttacagtaaacaaaactaacgtaatctaccatttcctacactatttgagcatggaaatcatagtccccactctgtgaaaact

SEQ ID NO: 21494 - DNA, 2202 bp, Homo sapiens
ggaagtggggagaatcaaggcggggaaatcggacttttgggtcgctgggggcaacgaagcctggagaggccttctttccattcccagaatatgtttgctgctttttcctctccccactggcctaaatggatcgctccgcctgtttcctccccagcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgcgggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctca

SEQ ID NO: 21495 - DNA, 1759 bp, Homo sapiens
ggagtagagtagggcaggagaaactgggccaggctgcacttagctcaaggggcctcgaggactctctgcgtctctggagacaagggcactacacgcacttcagaatgaagagttgcgggagcatgctggggctctgcgggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtg

SEQ ID NO: 21496 - DNA, 1945 bp, Homo sapiens
acggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggcgggagcatgctggggctctgcgggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtg

SEQ ID NO: 21497 - DNA, 1754 bp, Homo sapiens
tccgtcattcccctgcgctctctttcctcacccttccccccgccaccgtgggttccagacttgggataagtaaacagcgggtggagcgaggcctacggacccaggccaggcgggagcatgctggggctctgcgggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtg

SEQ ID NO: 21498 - DNA, 1759 bp, Homo sapiens
ggagtagagtagggcaggagaaactgggccaggctgcacttagctcaaggggcctcgaggactctctgcgtctctggagacaagggcactacacgcacttcagaatgaagagttgcgggagcatgctggggctctgggggcagcggctccccgcggcgtgggtcctgcttctgttgcctttcctgccgctgctgctgcttgcagcccccgcgccccaccgcgagtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtg

SEQ ID NO: 21499 - DNA, 1759 bp, Homo sapiens
ggagtagagtagggcaggagaaactgggccaggctgcacttagctcaaggggcctcgaggactctctgcgtctctggagacaagggcactacacgcacttcagaatgaagagttgcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtg

SEQ ID NO: 21500 - DNA, 2111 bp, Homo sapiens
tcgaggactctctgcgtctctggagacaagggcactacacgcacttcagaatgaagagttcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgcgggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtg

SEQ ID NO: 21501 - DNA, 1754 bp, Homo sapiens
tccgtcattcccctgcgctctctttcctcacccttccccccgccaccgtgggttccagacttgggataagtaaacagcgggtggagcgaggcctacggacccaggccaggcgggagcatgctggggctctgggggcagcggctccccgcggcgtgggtcctgcttctgttgcctttcctgccgctgctgctgcttgcagcccccgcgccccaccgcgagtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtg

SEQ ID NO: 21502 - DNA, 1945 bp, Homo sapiens
acggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggcgggagcatgctggggctctgggggcagcggctccccgcggcgtgggtcctgcttctgttgcctttcctgccgctgctgctgcttgcagcccccgcgccccaccgcgagtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtg

SEQ ID NO: 21503 - DNA, 2111 bp, Homo sapiens
tcgaggactctctgcgtctctggagacaagggcactacacgcacttcagaatgaagagttcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgagtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtg

SEQ ID NO: 21504 - DNA, 1754 bp, Homo sapiens
tccgtcattcccctgcgctctctttcctcacccttccccccgccaccgtgggttccagacttgggataagtaaacagcgggtggagcgaggcctacggacccaggccaggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtg

SEQ ID NO: 21505 - DNA, 1945 bp, Homo sapiens
acggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtg

SEQ ID NO: 21506 - DNA, 2111 bp, Homo sapiens
tcgaggactctctgcgtctctggagacaagggcactacacgcacttcagaatgaagagttcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtg

SEQ ID NO: 21507 - DNA, 1759 bp, Homo sapiens; identical to SEQ ID NO: 21499

SEQ ID NO: 21508 - DNA, 396 bp, Homo sapiens
cacggacctggtgtgggagcgagaggaggtggcttgattgccgggcgtctgttccgagggaggagggtgttgccatctccctcacatgcccttatcacccctttctcaggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagggggccttgtgtgccgggctctgctttctgtcatggatgatcacaacgtggattctttcatctccctctcctctccacagatgggacagtatggag

SEQ ID NO: 21509 - DNA, 954 bp, Homo sapiens
gactggtcgaaattacgcgggcatgagtcagcgcatccctacgcgccctccgccccttgagggtgggtcgcttatagggaggggagtagagtagggcaggagaaactgggccaggctgcacttagctcaaggggcctcgaggactctctgcgtctctggagacaagggcactacacgcacttcagaatgaagagttacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgcgggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatg

SEQ ID NO: 21510 - DNA, 1759 bp, Homo sapiens; identical to SEQ ID NO: 21499

SEQ ID NO: 21511 - DNA, 730 bp, Homo sapiens
gctattttgtgacacggacctggtgtgggagcgagaggaggtggcttgattgccgggcgtctgttccgagggaggagggtgttgccatctccctcacatgcccttatcacccctttctcaggcgggagcatgctggggctctgggggcagcggctccccgcggcgtgggtcctgcttctgttgcctttcctgccgctgctgctgcttgcagcccccgcgccccaccgcgagtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatgggg

SEQ ID NO: 21512 - DNA, 722 bp, Homo sapiens
acccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgagtcctacaagccggtcatcgtggtgcatgggctcttcgacagctcgtacagcttccgccacctgctggaatacatcaatgagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccag

SEQ ID NO: 21513 - DNA, 954 bp, Homo sapiens
gactggtcgaaattacgcgggcatgagtcagcgcatccctacgcgccctccgccccttgagggtgggtcgcttatagggaggggagtagagtagggcaggagaaactgggccaggctgcacttagctcaaggggcctcgaggactctctgcgtctctggagacaagggcactacacgcacttcagaatgaagagttacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatg

SEQ ID NO: 21514 - DNA, 722 bp, Homo sapiens
acccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccag

SEQ ID NO: 21515 - DNA, 954 bp, Homo sapiens; identical to SEQ ID NO: 21513

SEQ ID NO: 21516 - DNA, 1945 bp, Homo sapiens
acggatttgcgcgaccccaagcagcccgcccttccccctcccatccgtcattcccctgcgttctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtg

SEQ ID NO: 21517 - DNA, 2128 bp, Homo sapiens
acttagctcaaggggcctcgaggactctctgcgtctctggagacaagggcactacacgcacttcagaatgaagagttcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtg

SEQ ID NO: 21518 - DNA, 1759 bp, Homo sapiens; identical to SEQ ID NO: 21499

SEQ ID NO: 21519 - DNA, 396 bp, Homo sapiens; identical to SEQ ID NO: 21508

SEQ ID NO: 21520 - DNA, 1945 bp, Homo sapiens; identical to SEQ ID NO: 21505

SEQ ID NO: 21521 - DNA, 722 bp, Homo sapiens
acccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgcgggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccag

SEQ ID NO: 21522 - DNA, 1018 bp, Homo sapiens
acggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggcgggagcatgctggggctctgggggcagcggctccccgcggcgtgggtcctgcttctgttgcctttcctgccgctgctgctgcttgcagcccccgcgccccaccgcgagtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccag

SEQ ID NO: 21523 - DNA, 954 bp, Homo sapiens; identical to SEQ ID NO: 21513

SEQ ID NO: 21524 - DNA, 827 bp, Homo sapiens
tccgtcattcccctgcgctctctttcctcacccttccccccgccaccgtgggttccagacttgggataagtaaacagcgggtggagcgaggcctacggacccaggccaggcgggagcatgctggggctctgggggcagcggctccccgcggcgtgggtcctgcttctgttgcctttcctgccgctgctgctgcttgcagcccccgcgccccaccgcgagtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccag

SEQ ID NO: 21525 - DNA, 730 bp, Homo sapiens
gctattttgtgacacggacctggtgtgggagcgagaggaggtggcttgattgccgggcgtctgttccgagggaggagggtgttgccatctccctcacatgcccttatcacccctttctcaggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatgggg

SEQ ID NO: 21526 - DNA, 1754 bp, Homo sapiens
tccgtcattcccctgcgttctctttcctcacccttccccccgccaccgtgggttccagacttgggataagtaaacagcgggtggagcgaggcctacggacccaggccaggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtg

SEQ ID NO: 21527 - DNA, 730 bp, Homo sapiens; identical to SEQ ID NO: 21525

SEQ ID NO: 21528 - DNA, 832 bp, Homo sapiens
ggagtagagtagggcaggagaaactgggccaggctgcacttagctcaaggggcctcgaggactctctgcgtctctggagacaagggcactacacgcacttcagaatgaagagttgcgggagcatgctggggctctgggggcagcggctccccgcggcgtgggtcctgcttctgttgcctttcctgccgctgctgctgcttgcagcccccgcgccccaccgcgagtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccag

SEQ ID NO: 21529 - DNA, 1184 bp, Homo sapiens
tcgaggactctctgcgtctctggagacaagggcactacacgcacttcagaatgaagagttcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgagtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccag

SEQ ID NO: 21530 - DNA, 954 bp, Homo sapiens; identical to SEQ ID NO: 21513

SEQ ID NO: 21531 - DNA, 722 bp, Homo sapiens; identical to SEQ ID NO: 21514

SEQ ID NO: 21532 - DNA, 730 bp, Homo sapiens; identical to SEQ ID NO: 21511

SEQ ID NO: 21533 - DNA, 730 bp, Homo sapiens
gctattttgtgacacggacctggtgtgggagcgagaggaggtggcttgattgccgggcgtctgttccgagggaggagggtgttgccatctccctcacatgcccttatcacccctttctcaggcgggagcatgctggggctctgcgggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatgggg

SEQ ID NO: 21534 - DNA, 1051 bp, Homo sapiens
gttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgcgggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactgcctgtagggtccagcgtcaaagcgaatcatggggtccagggctgagctgtgcactctcttaggcggattctccttcctcctgctactgataccaggc

SEQ ID NO: 21535 - DNA, 722 bp, Homo sapiens; identical to SEQ ID NO: 21514

SEQ ID NO: 21536 - DNA, 1874 bp, Homo sapiens
tattccattgcccctcctgtcctgggtctgtgttgcggggaacgctcgcgcggttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtg

SEQ ID NO: 21537 - DNA, 2111 bp, Homo sapiens; identical to SEQ ID NO: 21506

SEQ ID NO: 21538 - DNA, 1945 bp, Homo sapiens; identical to SEQ ID NO: 21505

SEQ ID NO: 21539 - DNA, 396 bp, Homo sapiens
cacggacctggtgtgggagcgagaggaggtggcttgattgccgggcgtctgttccgagggaggagggtgttgccatctccctcacatgcccttatcacccctttctcaggcgggagcatgctggggctctgggggcagcggctccccgcggcgtgggtcctgcttctgttgcctttcctgccgctgctgctgcttgcagcccccgcgccccaccgcgagtcctacaagccggtcatcgtggtgcatgggctcttcgacagctcgtacagcttccgccacctgctggaatacatcaatgagggggccttgtgtgccgggctctgctttctgtcatggatgatcacaacgtggattctttcatctccctctcctctccacagatgggacagtatggag

SEQ ID NO: 21540 - DNA, 730 bp, Homo sapiens; identical to SEQ ID NO: 21525

SEQ ID NO: 21541 - DNA, 730 bp, Homo sapiens; identical to SEQ ID NO: 21525

SEQ ID NO: 21542 - DNA, 1754 bp, Homo sapiens; identical to SEQ ID NO: 21504

SEQ ID NO: 21543 - DNA, 1474 bp, Homo sapiens
ggaagtggggagaatcaaggcggggaaatcggacttttgggtcgctgggggcaacgaagcctggagaggccttctttccattcccagaatatgtttgctgctttttcctctccccactggcctaaatggatcgctccgcctgtttcctccccagcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgcgggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactgcctgccaggcccacccaccagtctgagctgcttctgctgaggctggtctgcttgaagcctcccaggagaaagaagccagcctgtagggtccagcgtcaaagcgaatcatggggtccagggctgagctgtgcactctcttag

SEQ ID NO: 21544 - DNA, 722 bp, Homo sapiens; identical to SEQ ID NO: 21512

SEQ ID NO: 21545 - DNA, 954 bp, Homo sapiens; identical to SEQ ID NO: 21513

SEQ ID NO: 21546 - DNA, 730 bp, Homo sapiens; identical to SEQ ID NO: 21525

SEQ ID NO: 21547 - DNA, 1754 bp, Homo sapiens; identical to SEQ ID NO: 21504

SEQ ID NO: 21548 - DNA, 2111 bp, Homo sapiens
tcgaggactctctgcgtctctggagacaagggcactacacgcacttcagaatgaagagttcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgttctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtg

SEQ ID NO: 21549 - DNA, 396 bp, Homo sapiens; identical to SEQ ID NO: 21508

SEQ ID NO: 21550 - DNA, 396 bp, Homo sapiens
cacggacctggtgtgggagcgagaggaggtggcttgattgccgggcgtctgttccgagggaggagggtgttgccatctccctcacatgcccttatcacccctttctcaggcgggagcatgctggggctctgcgggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagggggccttgtgtgccgggctctgctttctgtcatggatgatcacaacgtggattctttcatctccctctcctctccacagatgggacagtatggag

SEQ ID NO: 21551 - DNA, 1945 bp, Homo sapiens; identical to SEQ ID NO: 21505

SEQ ID NO: 21552 - DNA, 2111 bp, Homo sapiens; identical to SEQ ID NO: 21506

SEQ ID NO: 21553 - DNA, 954 bp, Homo sapiens
gactggtcgaaattacgcgggcatgagtcagcgcatccctacgcgccctccgccccttgagggtgggtcgcttatagggaggggagtagagtagggcaggagaaactgggccaggctgcacttagctcaaggggcctcgaggactctctgcgtctctggagacaagggcactacacgcacttcagaatgaagagttacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgagtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatg

SEQ ID NO: 21554 - DNA, 954 bp, Homo sapiens; identical to SEQ ID NO: 21553

SEQ ID NO: 21555 - DNA, 396 bp, Homo sapiens; identical to SEQ ID NO: 21539

SEQ ID NO: 21556 - DNA, 1278 bp, Homo sapiens
ggaagtggggagaatcaaggcggggaaatcggacttttgggtcgctgggggcaacgaagcctggagaggccttctttccattcccagaatatgtttgctgctttttcctctccccactggcctaaatggatcgctccgcctgtttcctccccagcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgagtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccag

SEQ ID NO: 21557 - DNA, 163 bp, Homo sapiens
accacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccag

SEQ ID NO: 21558 - DNA, 901 bp, Homo sapiens
agcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgagtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccag

SEQ ID NO: 21559 - DNA, 2382 bp, Homo sapiens
tttttttttttttttaaacaaaaacacagccagataatcattattcttcccttacgtccccccagcccccacctggggcagtcgctctcccggctgcgtcccttttcgtccatgtcctagcagagactacagagcagtacagaggctctcgctgaaaccagtcccaggctccacagagtcagatcacggcttcacaccagtcgttctggtcacttaggcgttcgcgtgagcgctcaaccccttaccgccacctcatcgtcactctacaccattctgagcgcaaaaatgttttgattgagacaaatttagaccaagcaatgaccttgtaaacagagagaggggctcagacatgctgagaaatccttatctctagagaaacgtctttaaatgctaagtaaaagccctagcaagtaaaagccctgaggcactagggtgtcggttaggggtcacaggcggagaggtggggcgcctgggggtttcggtagggagccacccacagataactcagacagccagattctgggggtcgttcaggttgaaagactggtcgaaattacgcgggcatgagtcagcgcatccctacgcgccctccgccccttgagggtgggtcgcttatagggaggggagtagagtagggcaggagaaactgggccaggctgcacttagctcaaggggcctcgaggactctctgcgtctctggagacaagggcactacacgcacttcagaatgaagagttgcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtg

SEQ ID NO: 21560 - DNA, 2202 bp, Homo sapiens
ggaagtggggagaatcaaggcggggaaatcggacttttgggtcgctgggggcaacgaagcctggagaggccttctttccattcccagaatatgtttgctgctttttcctctccccactggcctaaatggatcgctccgcctgtttcctccccagcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctca

SEQ ID NO: 21561 - DNA, 2202 bp, Homo sapiens; identical to SEQ ID NO: 21560

SEQ ID NO: 21562 - DNA, 1051 bp, Homo sapiens
gttgccagagaaagccccggacgtgacggatttgcgcgaccccaagcagcccgcccttccccctcccatccgtcattcccctgcgttctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactgcctgtagggtccagcgtcaaagcgaatcatggggtccagggctgagctgtgcactctcttaggcggattctccttcctcctgctactgataccaggc

SEQ ID NO: 21563 - DNA, 1754 bp, Homo sapiens
gagtagagtagggcaggagaaactgggccaggctgcacttagctcaaggggcctcgaggactctctgcgtctctggagacaagggcactacacgcacttcagaatgaagagttgcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctc

SEQ ID NO: 21564 - DNA, 1269 bp, Homo sapiens
gcttgaagcctcccaggagaaagaagccagcctgtagggtccagcgtcaaagcgaatcatggggtccagggctgagctgtgcactctcttaggcggattctccttcctcctgctactgataccaggcgagggggccaagggtggatccctcagagagagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaggcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtggacgtggatgaatgtaggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggcggaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccagataattaataaaaaccaaccacgcaaaactgg

SEQ ID NO: 21565 - DNA, 1474 bp, Homo sapiens
ggaagtggggagaatcaaggcggggaaatcggacttttgggtcgctgggggcaacgaagcctggagaggccttctttccattcccagaatatgtttgctgctttttcctctccccactggcctaaatggatcgctccgcctgtttcctccccagcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactgcctgccaggcccacccaccagtctgagctgcttctgctgaggctggtctgcttgaagcctcccaggagaaagaagccagcctgtagggtccagcgtcaaagcgaatcatggggtccagggctgagctgtgcactctcttag

SEQ ID NO: 21566 - DNA, 2202 bp, Homo sapiens
ggaagtggggagaatcaaggcggggaaatcggacttttgggtcgctgggggcaacgaagcctggagaggccttctttccattcccagaatatgtttgctgctttttcctctccccactggcctaaatggatcgctccgcctgtttcctccccagcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgagtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctca

SEQ ID NO: 21567 - DNA, 1051 bp, Homo sapiens
gttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactgcctgtagggtccagcgtcaaagcgaatcatggggtccagggctgagctgtgcactctcttaggcggattctccttcctcctgctactgataccaggc

SEQ ID NO: 21568 - DNA, 1277 bp, Homo sapiens; identical to SEQ ID NO: 9348

SEQ ID NO: 21569 - DNA, 1474 bp, Homo sapiens; identical to SEQ ID NO: 21565

SEQ ID NO: 21570 - DNA, 1051 bp, Homo sapiens; identical to SEQ ID NO: 21567

SEQ ID NO: 21571 - DNA, 1474 bp, Homo sapiens
ggaagtggggagaatcaaggcggggaaatcggactttcgggtcgctgggggcaacgaagcctggagaggccttctttccattcccagaatatgtttgctgctttttcctctccccactggcctaaatggatcgctccgcctgtttcctccccagcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgttctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactgcctgccaggcccacccaccagtctgagctgcttctgctgaggctggtctgcttgaagcctcccaggagaaagaagccagcctgtagggtccagcgtcaaagcgaatcatggggtccagggctgagctgtgcactctcttag

SEQ ID NO: 21572 - DNA, 1051 bp, Homo sapiens; identical to SEQ ID NO: 21567

SEQ ID NO: 21573 - DNA, 1269 bp, Homo sapiens
gcttgaagcctcccaggagaaagaagccagcctgtagggtccagcgtcaaagcgaatcatggggtccagggctgagctgtgcactctcttaggcggattctccttcctcctgctactgataccaggcgagggggccaagggtggatccctcagagagagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaggcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtggacgtggatgaatgtaggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggcagaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccagataattaataaaaaccaaccacgcaaaactgg

SEQ ID NO: 21574 - DNA, 1269 bp, Homo sapiens; identical to SEQ ID NO: 21564

SEQ ID NO: 21575 - DNA, 2202 bp, Homo sapiens; identical to SEQ ID NO: 21560

SEQ ID NO: 21576 - DNA, 1051 bp, Homo sapiens; identical to SEQ ID NO: 21567

SEQ ID NO: 21577 - DNA, 2202 bp, Homo sapiens; identical to SEQ ID NO: 21560

SEQ ID NO: 21578 - DNA, 1051 bp, Homo sapiens
gttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgagtcctacaagccggtcatcgtggtgcatgggctcttcgacagctcgtacagcttccgccacctgctggaatacatcaatgagggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactgcctgtagggtccagcgtcaaagcgaatcatggggtccagggctgagctgtgcactctcttaggcggattctccttcctcctgctactgataccaggc

SEQ ID NO: 21579 - DNA, 1474 bp, Homo sapiens; identical to SEQ ID NO: 21565

SEQ ID NO: 21580 - DNA, 1474 bp, Homo sapiens
ggaagtggggagaatcaaggcggggaaatcggacttttgggtcgctgggggcaacgaagcctggagaggccttctttccattcccagaatatgtttgctgctttttcctctccccactggcctaaatggatcgctccgcctgtttcctccccagcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgagtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactgcctgccaggcccacccaccagtctgagctgcttctgctgaggctggtctgcttgaagcctcccaggagaaagaagccagcctgtagggtccagcgtcaaagcgaatcatggggtccagggctgagctgtgcactctcttag

SEQ ID NO: 21581 - DNA, 1474 bp, Homo sapiens; identical to SEQ ID NO: 21565

SEQ ID NO: 21582 - DNA, 2202 bp, Homo sapiens
ggaagtggggagaatcaaggcggggaaatcggactttcgggtcgctgggggcaacgaagcctggagaggccttctttccattcccagaatatgtttgctgctttttcctctccccactggcctaaatggatcgctccgcctgtttcctccccagcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgttctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctca

SEQ ID NO: 21583 - DNA, 4537 bp, Homo sapiens
cttggcgccgtagtggttaggttgagccctaggcgtgggggagaactggggaaactggaatttcccgcggagctgacagcgcttgcgctccccctactcgttctaattccacgcgctccaaaatatccgccatggagaaatcttggccaggatgtccattctaggcccatcggtgctgtcttgctgaaggttgggtcaggcatctaaagggactgtggtaagggagggtgtgacacaggtgtaagctgccatcgtcatcatgaactttgagggtctggaccctggactggcagaatatgccccagccatgcattctgccctggaccctgtcttggatgcccacctgaacccaagtctgctacagaatgtggagctggacccagagggagtggccttggaggctcttcccgtccaggaatcagtgcacataatggaaggtgtctactctgaattgcacagcgtggtggctgaagtgggtgtacctgtttccgtctcccactttgacttgcacgaggagatgctgtgggtggggagccacgggggccatgccacttcattttttggcccagccttggagcgctactcatcctttcaagtcaatggcagtgatgatattcggcagatccagagcctggagaatggtatcctttttctcaccaagaacaacctcaagtatatggcccgtgggggcctcattatatttgattacctgctggatgagaatgaggatatgcacagtctcctactgactgacagcagcactctactcgttggtgggctgcagaatcacataatagagattgatcttaacactgtccaggagactcagaagtatgcagtagagacgcctggagtcaccatcatgagacagacaaatcgcttcttcttctgcggccacacgtctggcaaggtttccctgagagacctccgtacttttaaggtggaacatgagtttgatgccttctcaggaagtctgtcagactttgatgtgcatggcaacctgctagctgcctgtggcttctccagccgcctcactggcctggcctgcgaccgtttcctcaaggtgtatgatttgcgcatgatgcgtgccatcacaccacttcaagtacatgtggatcctgccttcttgcgcttcattcctacatatacttctcgtcttgctatcatctctcagtcagggcagtgccaattctgtgaacccacaggcctggccaacccagccgatatctttcatgtgaatcctgtggggcctctgctaatgacatttgatgtgtcagccagcaagcaggctctggcctttggggattctgagggctgtgtgcacctctggactgattccccggagccttccttcaacccctactcccgtgagactgagtttgctttgccgtgtctcgtggactcactgcctcctctggactggagccaggacctgctgcctctttccctcatccctgtcccactcaccactgacacacttctctctgattggcctgctgccaactctgctccagctcccaggcgagcaccacccgtggatgcagagattctgcgcaccatgaagaaggtgggcttcattggctatgcgcccaatccccgcaccaggctgcgcaatcagataccctacagactcaaggagtcagacagtgaatttgacagcttcagccaggtcactgagtcaccagtaggacgagaagaggaaccacatctccacatggtttctaagaaataccgcaaggtgaccatcaaatattccaagctagggctggaggactttgacttcaaacactacaataagaccttgtttgctggattagagccccacattcccaacgcctactgtaactgcatgatccaggtgctctatttcctggagcctgtacgctgtctaattcaaaaccacctttgccagaaggagttctgtctggcatgtgagctgggcttcctgtttcacatgttggacctctctcgtggtgacccttgccagggcaataattttcttcgggcattccgtactattcctgaggcctcagccctcggtctaatcctggctgactcagatgaggcctcaggcaagggcaatctggccaggctcattcagaggtggaatcgcttcattctcactcaactgcatcaagatatgcaggagctggaaataccacaggcttatcgaggtgctggaggcagcttttgctcatcgggggactctgttattgggcagctcttcagctgtgagatggagaactgcagcctctgccgctgtggcagtgagaccgtgcgagcctcatccactctgcttttcacactctcctaccctgatggtagcaaaagtgataaaactgggaagaactatgactttgctcaggtgctgaagcgaagcatctgcctggaccagaatacacaggcctggtgtgacacctgtgaaaagtaccagcccacgattcagacccgcaacatccgccatctgccagatattcttgtcatcaattgtgaggtgaacagctcaaaagaggctgatttctggagaatgcaggctgaggttgccttcaagatggcagtaaagaaacacggtggggaaatctccaagaacaaggaatttgctttggctgattggaaggaactagggagtccagagggtgtgctggtgtgtccctccattgaggagttgaagaacgtctggcttcctttctccattcgcatgaagatgaccaaaaacaaagggctggatgtttgcaattggactgatggggatgagatgcagtggggcccagccagggcagaggaggagcatggtgtctatgtgtatgacctgatggctactgtggtacacatcctggactcacgcacagggggcagcctggtggctcacatcaaagttggagagacctaccaccagcgcaaggagggcgttactcaccagcagtggtatctgttcaatgactttcttattgaacctattgataagcatgaagctgtgcagtttgacatgaattggaaagtacctgcaatcctttattatgtcaaacggaatctcaattccagatacaacctgaacatcaagaaccctattgaggcaagtgtcttgctggctgaagcctcgctggcacggaagcagcggaaaacacatactacctttattccactgatgctgaatgagatgccacagattggggacctggtgggtctggatgctgagtttgtcacccttaatgaggaggaagcagagttacgcagtgatggtaccaagtctaccattaaaccaagccagatgtcagtagccaggattacctgtgttcggggccagggacccaatgagggtatccccttcattgatgactacatctctacccaggagcaggtggtggattacttgactcaatactcgggtataaagcctggtgacctcgatgccaaaatttcctccaagcacctaacaactctcaagtctacctacttaaagcttcgttttctcattgacattggagtcaagtttgtgggtcatggcctgcagaaggacttccgggtcatcaacctgatggtgcccaaggaccaagtccttgacactgtctacctgttccatatgccccgaaaacgaatgatttccctgcgattccttgcttggtactttctggacctgaagattcaaggggaaacccatgacagtattgaggatgcccgcacagcccttcagctgtaccgaaagtatctggagctaagcaaaaatggcactgagcctgagtctttccacaaggtgctcaagggtctttatgagaagggcagaaagatggactggaaggtgcctgagcctgagggccaaacaagtcccaagaatgcagctgtcttctcctcagtgctggcgctctgactacccttcccaaagaaccacggccctctccctttactgttctatagccccagaactgggagatggcttcctaagttggctataccttgtccacttccagtactggacgtgctcagggtctagggtcacagatggtgctattaattgaactggaacacagcagaattgttgcaaaggttctaggagccagattcattccttcttcattctttgcaaaacagtggtacagacatggagtctagaattgacccagatggaaagtaattggtattcttaatatcctgggtgactaatatccaggcagagaagctcctggaaccataactgtaagttcctagctggctagggattgaagtcctggacagtgacagaggataccacagtagttcaagacttagcacaagtcaccaactgcttcagggatacctggaggggccagcaagtagagtgttggtggcccaagcaaaccagtgttgccaataccattgccaaaagggcctttggatcctggacaaagcttggctgccggcttcatttattcctgctgatggctgagaagcatctgtcttccatcccacttgcctgtcccaagttttgttccattttttaaaaatttgttgtaaactgcatgttttataaaataaaaataaaatatcgtttgttatttatctc

SEQ ID NO: 21584 - DNA, 5372 bp, Homo sapiens
agagaattctgggtaactagccgtttccgtcaccttcccctgcccccgccccaattgtgggtaactggccattattgttttcctctagagaatcctgggtagctattggagaggattctaggaaactgacttctcgttctccccaccgtccaatccacccgttttcacccccaattctgggagaaagcaccttaaatccctctacctaactccaacccccgcaattctcgctcccttcacctgatgattcagggctgaacaaggccaggatgtccattctaggcccatcggtgctgtcttgctgaaggttgggtcaggcatctaaagggactgtggtaagggagggtgtgacacaggtgtaagctgccatcgtcatcatgaactttgagggtctggaccctggactggcagaatatgccccagccatgcattctgccctggaccctgtcttggatgcccacctgaacccaagtctgctacagaatgtggagctggacccagagggagtggccttggaggctcttcccgtccaggaatcagtgcacataatggaaggtgtctactctgaattgcacagcgtggtggctgaagtgggtgtacctgtttccgtctcccactttgacttgcacgaggagatgctgtgggtggggagccacgggggccatgccacttcattttttggcccagccttggagcgctactcatcctttcaagtcaatggcagtgatgatattcggcagatccagagcctggagaatggtatcctttttctcaccaagaacaacctcaagtatatggcccgtgggggcctcattatatttgattacctgctggatgagaatgaggatatgcacagtctcctactgactgacagcagcactctactcgttggtgggctgcagaatcacataatagagattgatcttaacactgtccaggagactcagaagtatgcagtagagacgcctggagtcaccatcatgagacagacaaatcgcttcttcttctgcggccacacgtctggcaaggtttccctgagagacctccgtacttttaaggtggaacatgagtttgatgccttctcaggaagtctgtcagactttgatgtgcatggcaacctgctagctgcctgtggcttctccagccgcctcactggcctggcctgcgaccgtttcctcaaggtgtatgatttgcgcatgatgcgtgccatcacaccacttcaagtacatgtggatcctgccttcttgcgcttcattcctacatatacttctcgtcttgctatcatctctcagtcagggcagtgccaattctgtgaacccacaggcctggccaacccagccgatatctttcatgtgaatcctgtggggcctctgctaatgacatttgatgtgtcagccagcaagcaggctctggcctttggggattctgagggctgtgtgcacctctggactgattccccggagccttccttcaacccctactcccgtgagactgagtttgctttgccgtgtctcgtggactcactgcctcctctggactggagccaggacctgctgcctctttccctcatccctgtcccactcaccactgacacacttctctctgattggcctgctgccaactctgctccagctcccaggcgagcaccacccgtggatgcagagattctgcgcaccatgaagaaggtgggcttcattggctatgcgcccaatccccgcaccaggctgcgcaatcagataccctacagactcaaggagtcagacagtgaatttgacagcttcagccaggtcactgagtcaccagtaggacgagaagaggaaccacatctccacatggtttctaagaaataccgcaaggtgaccatcaaatattccaagctagggctggaggactttgacttcaaacactacaataagaccttgtttgctggattagagccccacattcccaacgcctactgtaactgcatgatccaggtgctctatttcctggagcctgtacgctgtctaattcaaaaccacctttgccagaaggagttctgtctggcatgtgagctgggcttcctgtttcacatgttggacctctctcgtggtgacccttgccagggcaataattttcttcgggcattccgtactattcctgaggcctcagccctcggtctaatcctggctgactcagatgaggcctcaggcaagggcaatctggccaggctcattcagaggtggaatcgcttcattctcactcaactgcatcaagatatgcaggagctggaaataccacaggcttatcgaggtgctggaggcagcagcttttgctcatcgggggactctgttattgggcagctcttcagctgtgagatggagaactgcagcctctgccgctgtggcagtgagaccgtgcgagcctcatccactctgcttttcacactctcctaccctgatggtagcaaaagtgataaaactgggaagaactatgactttgctcaggtgctgaagcgaagcatctgcctggaccagaatacacaggcctggtgtgacacctgtgaaaagtaccagcccacgattcagacccgcaacatccgccatctgccagatattcttgtcatcaattgtgaggtgaacagctcaaaagaggctgatttctggagaatgcaggctgaggttgccttcaagatggcagtaaagaaacacggtggggaaatctccaagaacaaggaatttgctttggctgattggaaggaactagggagtccagagggtgtgctggtgtgtccctccattgaggagttgaagaacgtctggcttcctttctccattcgcatgaagatgaccaaaaacaaagggctggatgtttgcaattggactgatggggatgagatgcagtggggcccagccagggcagaggaggagcatggtgtctatgtgtatgacctgatggctactgtggtacacatcctggactcacgcacagggggcagcctggtggctcacatcaaagttggagagacctaccaccagcgcaaggagggcgttactcaccagcagtggtatctgttcaatgactttcttattgaacctattgataagcatgaagctgtgcagtttgacatgaattggaaagtacctgcaatcctttattatgtcaaacggaatctcaattccagatacaacctgaacatcaagaaccctattgaggcaagtgtcttgctggctgaagcctcgctggcacggaagcagcggaaaacacatactacctttattccactgatgctgaatgagatgccacagattggggacctggtgggtctggatgctgagtttgtcacccttaatgaggaggaagcagagttacgcagtgatggtaccaagtctaccattaaaccaagccagatgtcagtagccaggattacctgtgttcggggccagggacccaatgagggtatccccttcattgatgactacatctctacccaggagcaggtggtggattacttgactcaatactcgggtataaagcctggtgacctcgatgccaaaatttcctccaagcacctaacaactctcaagtctacctacttaaagcttcgttttctcattgacattggagtcaagtttgtgggtcatggcctgcagaaggacttccgggtcatcaacctgatggtgcccaaggaccaagtccttgacactgtctacctgttccatatgccccgaaaacgaatgatttccctgcgattccttgcttggtactttctggacctgaagattcaaggggaaacccatgacagtattgaggatgcccgcacagcccttcagctgtaccgaaagtatctggagctaagcaaaaatggcactgagcctgagtctttccacaaggtgctcaagggtctttatgagaagggcagaaagatggactggaaggtgcctgagcctgagggccaaacaagtcccaagaatgcagctgtcttctcctcagtgctggcgctctgactacccttcccaaagaaccacggccctctccctttactgttctatagccccagaactgggagatggcttcctaagttggctataccttgtccacttccagtactggacgtgctcagggtctagggtcacagatggtgctattaattgaactggaacacagcagaattgttgcaaaggttctaggagccagattcattccttcttcattctttgcaaaacagtggtacagacatggagtctagaattgacccagatggaaagtaattggtattcttaatatcctgggtgactaatatccaggcagagaagctcctggaaccataactgtaagttcctagctggctagggattgaagtcctggacagtgacagaggataccacagtagttcaagacttagcacaagtcaccaactgcttcagggatacctggaggggccagcaagtagagtgttggtggcccaagcaaaccagtgttgccaataccattgccaaaagggcctttggatcctggacaaagcttggctgccggcttcatttattcctgctgatggctgagaagcatctgtcttccatcccacttgcctgtcccaagttttgttccattttttaaaaatttgttgtaaactgcatgttttataaaataaaaataaaatatcgtttgttatttatctcattagagaactgctagtgtgggttctctggcttcagtcttcctctccttcctttgaaggtaaaggtccggaatccaaagttatggatatgaaagggtataattaggccgggcgcggtggctcacttctgtaatcctagcactttgggaggcagaggtgggtggaacacgaggtcaggagttaaagaccagcctgaccaagatggtgaaaccccgtctctactaaaaatacaaaaattagctgggagtggtggatggcgactgtaaccctagctgaggcagaaaattgcttcaacccgggaggcggaggttgcagtgagccgagatcacgccactgtatgccagcctgggcgatagggcgagactccgtctcaaaaaaaggggaaaaaggtataatttatgccttttctgggcaatgctgggtctttgctatagctgcccagtaccctaagtcagactgaagatgtacagtatggtttccgttaattgtgtaagccgacaaactacaggtcccaggatagcttgagacttgtagttgctcacaaagatgggtccggtgctgcggtgcttcctgggagatgtagtttcctgtgtattgaaacctggactgctcgctggccggcagcgcaccgttttgaaggtcctagcccacctgggctggctcacgcgcacgactagccgctcccatacagcacgcccggactctgtcgtcgctt

SEQ ID NO: 21585 - DNA, 4576 bp, Homo sapiens
atgccccgagcccttcttgattggaagaagcgcctcggaccccggtccttggcgccgtagtggttaggttgagccctaggcgtgggggagaactggggaaactggaatttcccgcggagctgacagcgcttgcgctccccctactcgttctaattccacgcgctccaaaatatccgccatggagaaatcttggccaggatgtccattctaggcccatcggtgctgtcttgctgaaggttgggtcaggcatctaaagggactgtggtaagggagggtgtgacacaggtgtaagctgccatcgtcatcatgaactttgagggtctggaccctggactggcagaatatgccccagccatgcattctgccctggaccctgtcttggatgcccacctgaacccaagtctgctacagaatgtggagctggacccagagggagtggccttggaggctcttcccgtccaggaatcagtgcacataatggaaggtgtctactctgaattgcacagcgtggtggctgaagtgggtgtacctgtttccgtctcccactttgacttgcacgaggagatgctgtgggtggggagccacgggggccatgccacttcattttttggcccagccttggagcgctactcatcctttcaagtcaatggcagtgatgatattcggcagatccagagcctggagaatggtatcctttttctcaccaagaacaacctcaagtatatggcccgtgggggcctcattatatttgattacctgctggatgagaatgaggatatgcacagtctcctactgactgacagcagcactctactcgttggtgggctgcagaatcacataatagagattgatcttaacactgtccaggagactcagaagtatgcagtagagacgcctggagtcaccatcatgagacagacaaatcgcttcttcttctgcggccacacgtctggcaaggtttccctgagagacctccgtacttttaaggtggaacatgagtttgatgccttctcaggaagtctgtcagactttgatgtgcatggcaacctgctagctgcctgtggcttctccagccgcctcactggcctggcctgcgaccgtttcctcaaggtgtatgatttgcgcatgatgcgtgccatcacaccacttcaagtacatgtggatcctgccttcttgcgcttcattcctacatatacttctcgtcttgctatcatctctcagtcagggcagtgccaattctgtgaacccacaggcctggccaacccagccgatatctttcatgtgaatcctgtggggcctctgctaatgacatttgatgtgtcagccagcaagcaggctctggcctttggggattctgagggctgtgtgcacctctggactgattccccggagccttccttcaacccctactcccgtgagactgagtttgctttgccgtgtctcgtggactcactgcctcctctggactggagccaggacctgctgcctctttccctcatccctgtcccactcaccactgacacacttctctctgattggcctgctgccaactctgctccagctcccaggcgagcaccacccgtggatgcagagattctgcgcaccatgaagaaggtgggcttcattggctatgcgcccaatccccgcaccaggctgcgcaatcagataccctacagactcaaggagtcagacagtgaatttgacagcttcagccaggtcactgagtcaccagtaggacgagaagaggaaccacatctccacatggtttctaagaaataccgcaaggtgaccatcaaatattccaagctagggctggaggactttgacttcaaacactacaataagaccttgtttgctggattagagccccacattcccaacgcctactgtaactgcatgatccaggtgctctatttcctggagcctgtacgctgtctaattcaaaaccacctttgccagaaggagttctgtctggcatgtgagctgggcttcctgtttcacatgttggacctctctcgtggtgacccttgccagggcaataattttcttcgggcattccgtactattcctgaggcctcagccctcggtctaatcctggctgactcagatgaggcctcaggcaagggcaatctggccaggctcattcagaggtggaatcgcttcattctcactcaactgcatcaagatatgcaggagctggaaataccacaggcttatcgaggtgctggaggcagcagcttttgctcatcgggggactctgttattgggcagctcttcagctgtgagatggagaactgcagcctctgccgctgtggcagtgagaccgtgcgagcctcatccactctgcttttcacactctcctaccctgatgataaaactgggaagaactatgactttgctcaggtgctgaagcgaagcatctgcctggaccagaatacacaggcctggtgtgacacctgtgaaaagtaccagcccacgattcagacccgcaacatccgccatctgccagatattcttgtcatcaattgtgaggtgaacagctcaaaagaggctgatttctggagaatgcaggctgaggttgccttcaagatggcagtaaagaaacacggtggggaaatctccaagaacaaggaatttgctttggctgattggaaggaactagggagtccagagggtgtgctggtgtgtccctccattgaggagttgaagaacgtctggcttcctttctccattcgcatgaagatgaccaaaaacaaagggctggatgtttgcaattggactgatggggatgagatgcagtggggcccagccagggcagaggaggagcatggtgtctatgtgtatgacctgatggctactgtggtacacatcctggactcacgcacagggggcagcctggtggctcacatcaaagttggagagacctaccaccagcgcaaggagggcgttactcaccagcagtggtatctgttcaatgactttcttattgaacctattgataagcatgaagctgtgcagtttgacatgaattggaaagtacctgcaatcctttattatgtcaaacggaatctcaattccagatacaacctgaacatcaagaaccctattgaggcaagtgtcttgctggctgaagcctcgctggcacggaagcagcggaaaacacatactacctttattccactgatgctgaatgagatgccacagattggggacctggtgggtctggatgctgagtttgtcacccttaatgaggaggaagcagagttacgcagtgatggtaccaagtctaccattaaaccaagccagatgtcagtagccaggattacctgtgttcggggccagggacccaatgagggtatccccttcattgatgactacatctctacccaggagcaggtggtggattacttgactcaatactcgggtataaagcctggtgacctcgatgccaaaatttcctccaagcacctaacaactctcaagtctacctacttaaagcttcgttttctcattgacattggagtcaagtttgtgggtcatggcctgcagaaggacttccgggtcatcaacctgatggtgcccaaggaccaagtccttgacactgtctacctgttccatatgccccgaaaacgaatgatttccctgcgattccttgcttggtactttctggacctgaagattcaaggggaaacccatgacagtattgaggatgcccgcacagcccttcagctgtaccgaaagtatctggagctaagcaaaaatggcactgagcctgagtctttccacaaggtgctcaagggtctttatgagaagggcagaaagatggactggaaggtgcctgagcctgagggccaaacaagtcccaagaatgcagctgtcttctcctcagtgctggcgctctgactacccttcccaaagaaccacggccctctccctttactgttctatagccccagaactgggagatggcttcctaagttggctataccttgtccacttccagtactggacgtgctcagggtctagggtcacagatggtgctattaattgaactggaacacagcagaattgttgcaaaggttctaggagccagattcattccttcttcattctttgcaaaacagtggtacagacatggagtctagaattgacccagatggaaagtaattggtattcttaatatcctgggtgactaatatccaggcagagaagctcctggaaccataactgtaagttcctagctggctagggattgaagtcctggacagtgacagaggataccacagtagttcaagacttagcacaagtcaccaactgcttcagggatacctggaggggccagcaagtagagtgttggtggcccaagcaaaccagtgttgccaataccattgccaaaagggcctttggatcctggacaaagcttggctgccggcttcatttattcctgctgatggctgagaagcatctgtcttccatcccacttgcctgtcccaagttttgttccattttttaaaaatttgttgtaaactgcatgttttataaaataaaaataaaatatcgtttgttatttatctca

SEQ ID NO: 21586 - DNA, 4641 bp, Homo sapiens
ttctgggtaactagccgtttccgtcaccttcccctgcccccgccccaattgtgggtaactggccattattgttttcctctagagaatcctgggtagctattggagaggattctaggaaactgacttctcgttctccccaccgtccaatccacccgttttcacccccaattctgggagaaagcaccttaaatccctctacctaactccaacccccgcaattctcgctcccttcacctgatgattcagggctgaacaaggcaagatgtccattctaggcccatcggtgctgtcttgctgaaggttgggtcaggcatctaaagggactgtggtaagggagggtgtgacacaggtgtaagctgccatcgtcatcatgaactttgagggtctggaccctggactggcagaatatgccccagccatgcattctgccctggaccctgtcttggatgcccacctgaacccaagtctgctacagaatgtggagctggacccagagggagtggccttggaggctcttcccgtccaggaatcagtgcacataatggaaggtgtctactctgaattgcacagcgtggtggctgaagtgggtgtacctgtttccgtctcccactttgacttgcacgaggagatgctgtgggtggggagccacgggggccatgccacttcattttttggcccagccttggagcgctactcatcctttcaagtcaatggcagtgatgatattcggcagatccagagcctggagaatggtatcctttttctcaccaagaacaacctcaagtatatggcccgtgggggcctcattatatttgattacctgctggatgagaatgaggatatgcacagtctcctactgactgacagcagcactctactcgttggtgggctgcagaatcacataatagagattgatcttaacactgtccaggagactcagaagtatgcagtagagacgcctggagtcaccatcatgagacagacaaatcgcttcttcttctgcggccacacgtctggcaaggtttccctgagagacctccgtacttttaaggtggaacatgagtttgatgccttctcaggaagtctgtcagactttgatgtgcatggcaacctgctagctgcctgtggcttctccagccgcctcactggcctggcctgcgaccgtttcctcaaggtgtatgatttgcgcatgatgcgtgccatcacaccacttcaagtacatgtggatcctgccttcttgcgcttcattcctacatatacttctcgtcttgctatcatctctcagtcagggcagtgccaattctgtgaacccacaggcctggccaacccagccgatatctttcatgtgaatcctgtggggcctctgctaatgacatttgatgtgtcagccagcaagcaggctctggcctttggggattctgagggctgtgtgcacctctggactgattccccggagccttccttcaacccctactcccgtgagactgagtttgctttgccgtgtctcgtggactcactgcctcctctggactggagccaggacctgctgcctctttccctcatccctgtcccactcaccactgacacacttctctctgattggcctgctgccaactctgctccagctcccaggcgagcaccacccgtggatgcagagattctgcgcaccatgaagaaggtgggcttcattggctatgcgcccaatccccgcaccaggctgcgcaatcagataccctacagactcaaggagtcagacagtgaatttgacagcttcagccaggtcactgagtcaccagtaggacgagaagaggaaccacatctccacatggtttctaagaaataccgcaaggtgaccatcaaatattccaagctagggctggaggactttgacttcaaacactacaataagaccttgtttgctggattagagccccacattcccaacgcctactgtaactgcatgatccaggtgctctatttcctggagcctgtacgctgtctaattcaaaaccacctttgccagaaggagttctgtctggcatgtgagctgggcttcctgtttcacatgttggacctctctcgtggtgacccttgccagggcaataattttcttcgggcattccgtactattcctgaggcctcagccctcggtctaatcctggctgactcagatgaggcctcaggcaagggcaatctggccaggctcattcagaggtggaatcgcttcattctcactcaactgcatcaagatatgcaggagctggaaataccacaggcttatcgaggtgctggaggcagcagcttttgctcatcgggggactctgttattgggcagctcttcagctgtgagatggagaactgcagcctctgccgctgtggcagtgagaccgtgcgagcctcatccactctgcttttcacactctcctaccctgatggtagcaaaagtgataaaactgggaagaactatgactttgctcaggtgctgaagcgaagcatctgcctggaccagaatacacaggcctggtgtgacacctgtgaaaagtaccagcccacgattcagacccgcaacatccgccatctgccagatattcttgtcatcaattgtgaggtgaacagctcaaaagaggctgatttctggagaatgcaggctgaggttgccttcaagatggcagtaaagaaacacggtggggaaatctccaagaacaaggaatttgctttggctgattggaaggaactagggagtccagagggtgtgctggtgtgtccctccattgaggagttgaagaacgtctggcttcctttctccattcgcatgaagatgaccaaaaacaaagggctggatgtttgcaattggactgatggggatgagatgcagtggggcccagccagggcagaggaggagcatggtgtctatgtgtatgacctgatggctactgtggtacacatcctggactcacgcacagggggcagcctggtggctcacatcaaagttggagagacctaccaccagcgcaaggagggcgttactcaccagcagtggtatctgttcaatgactttcttattgaacctattgataagcatgaagctgtgcagtttgacatgaattggaaagtacctgcaatcctttattatgtcaaacggaatctcaattccagatacaacctgaacatcaagaaccctattgaggcaagtgtcttgctggctgaagcctcgctggcacggaagcagcggaaaacacatactacctttattccactgatgctgaatgagatgccacagattggggacctggtgggtctggatgctgagtttgtcacccttaatgaggaggaagcagagttacgcagtgatggtaccaagtctaccattaaaccaagccagatgtcagtagccaggattacctgtgttcggggccagggacccaatgagggtatccccttcattgatgactacatctctacccaggagcaggtggtggattacttgactcaatactcgggtataaagcctggtgacctcgatgccaaaatttcctccaagcacctaacaactctcaagtctacctacttaaagcttcgttttctcattgacattggagtcaagtttgtgggtcatggcctgcagaaggacttccgggtcatcaacctgatggtgcccaaggaccaagtccttgacactgtctacctgttccatatgccccgaaaacgaatgatttccctgcgattccttgcttggtactttctggacctgaagattcaaggggaaacccatgacagtattgaggatgcccgcacagcccttcagctgtaccgaaagtatctggagctaagcaaaaatggcactgagcctgagtctttccacaaggtgctcaagggtctttatgagaagggcagaaagatggactggaaggtgcctgagcctgagggccaaacaagtcccaagaatgcagctgtcttctcctcagtgctggcgctctgactacccttcccaaagaaccacggccctctccctttactgttctatagccccagaactgggagatggcttcctaagttggctataccttgtccacttccagtactggacgtgctcagggtctagggtcacagatggtgctattaattgaactggaacacagcagaattgttgcaaaggttctaggagccagattcattccttcttcattctttgcaaaacagtggtacagacatggagtctagaattgacccagatggaaagtaattggtattcttaatatcctgggtgactaatatccaggcagagaagctcctggaaccataactgtaagttcctagctggctagggattgaagtcctggacagtgacagaggataccacagtagttcaagacttagcacaagtcaccaactgcttcagggatacctggaggggccagcaagtagagtgttggtggcccaagcaaaccagtgttgccaataccattgccaaaagggcctttggatcctggacaaagcttggctgccggcttcatttattcctgctgatggctgagaagcatctgtcttccatcccacttgcctgtcccaagttttgttccattttttaaaaatttgttgtaaactgcatgttttataaaataaaaataaaatatcgtttgt

SEQ ID NO: 21587 - DNA, 1537 bp, Homo sapiens
cagccctccccagcgcagcgcgagcgcgggccagagcgcagcggccgcgggcactccagggaggcccgggggcgggcagcccggcggccgcctagctgcccccagccagggccccgggagggaggggctcggacgggccttagaaactcaccaagaactaacacgcgcagcccggcagtcccgctgcccactgcggcggcgagcatggacgcggtgttgctggagcacttccccgggggcctagacgcctttccttcttcgtacttcgacgaggacgacttcttcaccgaccagtcttcacgggaccccctggaggacggcgatgagctgctggcggacgagcaggccgaggtggagttccttagccaccagctccacgagtactgctaccgcgacggggcgtgcctgctgctgcagcccgcgcccccggccgccccgctagcgctcgccccgccgtcctcggggggcctcggtgagccagacgacggcggcggcggcggctactgctgcgagacgggggcgcccccaggcggcttcccctactcgcccggctcgccgccctcgtgcctggcctacccgtgcgccggggcggcagtactgtctcccggggcgcggctgcgcggcctgagcggagcggcggctgcggcggcgcggcgccggcggcgggtgcgctccgaggcggagctgcagcagctgcggcaggcggccaacgtgcgcgagcggcggcgcatgcagtccatcaacgacgccttcgaggggctgcgctcgcacatccccacgctgccctacgagaagcgcctctccaaggtggacacgctgcgcctggccatcggctacatcaacttcctcagcgagctcgtgcaggccgacctgcccttgcgcggcggtggcgcgggcggctgcggggggccgggcggcggcgggcgcctgggcggggacagcccgggcagccaggcccagaaggtcatcatctgccatcggggcacccggtccccctcccccagcgaccctgattatggcctccctcccctagcaggacactctctctcatggactgatgaaaaacaactcaaggaacaaaatattatccgaacagccaaagtctggaccccagaggaccccagaaaactcaacagcaaatcttccttcaacaacatagaaaacgaaccaccatttgagtttgtgtcctgagaagtcccagactcggctgaagatctgattatgtctctgtgcatattgtacatgtaaatatctataatgtaaatgtaatttaagaatcaaatttttcgaatggcaatcaactgtttattatttatctatttattatcctgttgagttgatgaaatagatgatttctttttaaatatataatttatataacttatcctgattttctgaaaatatgcaatagcctatgattttcctgaactctgtgttgttgggagaactctggccagaaaacgtcctgcttatttattgccagatatggtttatttctaagcgttgtcaataaatgctatttacaccttttcctgaa

SEQ ID NO: 21588 - DNA, 2501 bp, Homo sapiens
aaagcgagcaggggtggcgccgggagtgggaacgccacacagtgccaaatccccggctccagctcccgactcccggctcccggctcccggctcccggtgcccaatcccgggccgcagccatgaacggcgaggagcagtactacgcggccacgcagctttacaaggacccatgcgcgttccagcgaggcccggcgccggagttcagcgccagcccccctgcgtgcctgtacatgggccgccagcccccgccgccgccgccgcacccgttccctggcgccctgggcgcgctggagcagggcagccccccggacatctccccgtacgaggtgccccccctcgccgacgaccccgcggtggcgcaccttcaccaccacctcccggctcagctcgcgctcccccacccgcccgccgggcccttcccggagggagccgagccgggcgtcctggaggagcccaaccgcgtccagctgcctttcccatggatgaagtctaccaaagctcacgcgtggaaaggccagtgggcaggcggcgcctacgctgcggagccggaggagaacaagcggacgcgcacggcctacacgcgcgcacagctgctagagctggagaaggagttcctattcaacaagtacatctcacggccgcgccgggtggagctggctgtcatgttgaacttgaccgagagacacatcaagatctggttccaaaaccgccgcatgaagtggaaaaaggaggaggacaagaagcgcggcggcgggacagctgtcgggggtggcggggtcgcggagcctgagcaggactgcgccgtgacctccggcgaggagcttctggcgctgccgccgccgccgccccccggaggtgctgtgccgcccgctgcccccgttgccgcccgagagggccgcctgccgcctggccttagcgcgtcgccacagccctccagcgtcgcgcctcggcggccgcaggaaccacgatgagaggcaggagctgctcctggctgaggggcttcaaccactcgccgaggaggagcagagggcctaggaggaccccgggcgtggaccacccgccctggcagttgaatggggcggcaattgcggggcccaccttagaccgaaggggaaaacccgctctctcaggcgcatgtgccagttggggccccgcgggtagatgccggcaggccttccggaagaaaaagagccattggtttttgtagtattggggccctcttttagtgatactggattggcgttgtttgtggctgttgcgcacatccctgccctcctacagcactccaccttgggacctgtttagagaagccggctcttcaaagacaatggaaactgtaccatacacattggaaggctccctaacacacacagcggggaagctgggccgagtaccttaatctgccataaagccattcttactcgggcgacccctttaagtttagaaataattgaaaggaaatgtttgagttttcaaagatcccgtgaaattgatgccagtggaatacagtgagtcctcctcttcctcctcctcctcttccccctccccttcctcctcctcctcttcttttccctcctcttcctcttcctcctgctctcctttcctccccctcctcttttccctcctcttcctcttcctcctgctctcctttcctccccctcctctttctcctcctcctcctcttcttccccctcctctccctcctcctcttcttccccctcctctccctcctcctcttcttctccctcctcttcctcttcctcctcttccacgtgctctcctttcctccccctcctcttgctccccttcttccccgtcctcttcctcctcctcctcttcttctccctcctcttcctcctcctctttcttcctgacctctttctttctcctcctcctccttctacctccccttctcatccctcctcttcctcttctctagctgcacacttcactactgcacatcttataacttgcacccctttcttctgaggaagagaacatcttgcaaggcagggcgagcagcggcagggctggcttaggagcagtgcaagagtccctgtgctccagttccacactgctggcagggaaggcaaggggggacgggcctggatctgggggtgagggagaaagatggacccctgggtgaccactaaaccaaagatattcggaactttctatttaggatgtggacgtaattcctgttccgaggtagaggctgtgctgaagacaagcacagtggcctggtgcgccttggaaaccaacaactattcacgagccagtatgaccttcacatctttagaaattatgaaaacgtatgtgattggagggtttggaaaaccagttatcttatttaacattttaaaaattacctaacagttatttacaaacaggtctgtgcatcccaggtctgtcttcttttcaaggtctgggccttgtgctcgggttatgtttgtgggaaatgcttaataaatactgataatatgggaagagatgaaaactga

SEQ ID NO: 21589 - DNA, 1483 bp, Homo sapiens
gcgtgtggaacctgacggaactgccacgatgctgccactttggactctttcactgctgctgggagcagtagcaggaaaagaagtttgctacgaaagactcggctgcttcagtgatgactccccatggtcaggaattacggaaagacccctccatatattgccttggtctccaaaagatgtcaacacccgcttcctcctatatactaatgagaacccaaacaactttcaagaagttgccgcagattcatcaagcatcagtggctccaatttcaaaacaaatagaaaaactcgctttattattcatggattcatagacaagggagaagaaaactggctggccaatgtgtgcaagaatctgttcaaggtggaaagtgtgaactgtatctgtgtggactggaaaggtggctcccgaactggatacacacaagcctcgcagaacatcaggatcgtgggagcagaagtggcatattttgttgaatttcttcagtcggcgttcggttactcaccttccaatgtgcatgtcattggccacagcctgggtgcccacgctgctggggaggctggaaggagaaccaatgggaccattggacgcatcacagggttggacccagcagaaccttgctttcagggcacacctgaattagtccgattggaccccagcgatgccaaatttgtggatgtaattcacacggatggtgcccccatagtccccaatttggggtttggaatgagccaagtcgtgggccacctagatttctttccaaatggaggagtggaaatgcctggatgtaaaaagaacattctctctcagattgtggacatagacggaatctgggaagggactcgagactttgcggcctgtaatcacttaagaagctacaaatattacactgatagcatcgtcaaccctgatggctttgctggattcccctgtgcctcttacaacgtcttcactgcaaacaagtgtttcccttgtccaagtggaggctgcccacagatgggtcactatgctgatagatatcctgggaaaacaaatgatgtgggccagaaattttatctagacactggtgatgccagtaattttgcacgttggaggtataaggtatctgtcacactgtctggaaaaaaggttacaggacacatactagtttctttgttcggaaataaaggaaactctaagcagtatgaaattttcaagggcactctcaaaccagatagtactcattccaatgaatttgactcagatgtggatgttggggacttgcagatggttaaatttatttggtataacaatgtgatcaacccaactttacctagagtgggagcatccaagattatagtggagacaaatgttggaaaacagttcaacttctgtagtccagaaaccgtcagggaggaagttctgctcaccctcacaccgtgttaggagactactgttatttgaccaatgaattgacttctaataaaatctagtggtgatgca

SEQ ID NO: 21590 - DNA, 457 bp, Homo sapiens
ggcaggtgctcgcttggtctagtgcccatttactctggactccggatggctgccgcacgcctctgcctctccctgctgctcctgtccacctgcgtggctctgttactacagccactgctgggtgcccagggagccccactggagccagtgtacccaggggacaatgccacaccagagcagatggcccagtatgcagctgatctccgtagatacatcaacatgctgaccaggcctaggtatgggaaaagacacaaagaggacacgctggccttctcggagtgggggtccccgcatgctgctgtccccagggagctcagcccgctggacttataatgccaccttctgtctcctacgactccatgagcagcgccagcccagctctcccctctgcacccttggctctggccaaagcttgctccctgctcccacacaggctcaataaagcaagtcaaagcca

SEQ ID NO: 21591 - DNA, 1956 bp, Homo sapiens
gggcacaggagtgcggccgggggcggggccgagtgggccccggtacgaaccctccgggaagccgggcgcgctgcctgcccttggcccggggcgcagagcgtcacactggatctggggagcatcctacccccactgtggacctcagtctcctcacctgagacatgggcggccccatccgcaccctgtaagccgcaagccaaggagattcctggcccccatcctggattcacttaactacatctcctggtggaagggccctgggatctgcactttcaacatgcttctagaatgattctgatgtttactgaaggttgagaactgcaaccctgtgggattaataatgactagagaatctgagaggcgtcatccctcaagtgtatcacttagttcaagagtcctggaatcttttcacatccactatgaacacctctcacctcctggccttgctgctcccaaaatctccacaaggtgaaaacagaagcaaacccctgggcaccccatacaacttctctgaacattgccaggattccgtggacgtgatggtcttcatcgtcacttcctacagcattgagactgtcgtgggggtcctgggtaacctctgcctgatgtgtgtgactgtgaggcagaaggagaaagccaacgtgaccaacctgcttatcgccaacctggccttctctgacttcctcatgtgcctcctctgccagccgctgaccgccgtctacaccatcatggactactggatctttggagagaccctctgcaagatgtcggccttcatccagtgcatgtcggtgacggtctccatcctctcgctcgtcctcgtggccctggagaggcatcagctcatcatcaacccaacaggctggaagcccagcatctcacaggcctacctggggattgtgctcatctgggtcattgcctgtgtcctctccctgcccttcctggccaacagcatcctggagaatgtcttccacaagaaccactccaaggctctggagttcctggcggataaggtggtctgtaccgagtcctggccactggctcaccaccgcaccatctacaccaccttcctgctcctcttccagtactgcctcccactgggcttcatcctggtctgttatgcacgcatctaccggcgcctgcagaggcaggggcgcgtgtttcacaagggcacctacagcttgcgagctgggcacatgaagcaggtcaatgtggtgctggtggtgatggtggtggcctttgctgtgctctggctgcctctgcatgtgttcaacagcctggaagactggcaccatgaggccatccccatctgccacgggaacctcatcttcttagtgtgccacttgcttgccatggcctccacctgcgtcaacccattcatctatggctttctcaacaccaacttcaagaaggagatcaaggccctggtgctgacttgccagcagagcgcccccctggaggagtcggagcatctgcccctgtccacagtacatacggaagtctccaaagggtccctgaggctaagtggcaggtccaatcccatttaaccaggtctaggtcttctccctgccatgtcccttgccaggctcttccacttagctaagtgggcacactgcaagctggggtggcaccccagcattcctggctttctggggtccagataggctggcaagagctgtttttgcatccatttgcatcgtgaagactggcattttgatacttcagctgtttgttcctgggagaattctgagcacagattccagaggtcacagtaagccttgcagcttgagctgaaagatgccagagccggagatgtctgctggcagcaggcagggttcattctggtgacacagcaacagatgcctggcctgggaacccagggatttcacctccaccagtgagaccacggggccactgtggggtgagggaaggagcgcttggagtcagagctctaga

SEQ ID NO: 21592 - DNA, 1622 bp, Homo sapiens
ttaataatgactagagaatctgagaggcgtcatccctcaagtgtatcacttagttcaagagtcctggaatcttttcacatccactatgaacacctctcacctcctggccttgctgctcccaaaatctccacaaggtgaaaacagaagcaaacccctgggcaccccatacaacttctctgaacattgccaggattccgtggacgtgatggtcttcatcgtcacttcctacagcattgagactgtcgtgggggtcctgggtaacctctgcctgatgtgtgtgactgtgaggcagaaggagaaagccaacgtgaccaacctgcttatcgccaacctggccttctctgacttcctcatgtgcctcctctgccagccgctgaccgccgtctacaccatcatggactactggatctttggagagaccctctgcaagatgtcggccttcatccagtgcatgtcggtgacggtctccatcctctcgctcgtcctcgtggccctggagaggcatcagctcatcatcaacccaacaggctggaagcccagcatctcacaggcctacctggggattgtgctcatctgggtcattgcctgtgtcctctccctgcccttcctggccaacagcatcctggagaatgtcttccacaagaaccactccaaggctctggagttcctggcggataaggtggtctgtaccgagtcctggccactggctcaccaccgcaccatctacaccaccttcctgctcctcttccagtactgcctcccactgggcttcatcctggtctgttatgcacgcatctaccggcgcctgcagaggcaggggcgcgtgtttcacaagggcacctacagcttgcgagctgggcacatgaagcaggtcaatgtggtgctggtggtgatggtggtggcctttgctgtgctctggctgcctctgcatgtgttcaacagcctggaagactggcaccatgaggccatccccatctgccacgggaacctcatcttcttagtgtgccacttgcttgccatggcctccacctgcgtcaacccattcatctatggctttctcaacaccaacttcaagaaggagatcaaggccctggtgctgacttgccagcagagcgcccccctggaggagtcggagcatctgcccctgtccacagtacatacggaagtctccaaagggtccctgaggctaagtggcaggtccaatcccatttaaccaggtctaggtcttctccctgccatgtcccttgccaggctcttccacttagctaagtgggcacactgcaagctggggtggcaccccagcattcctggctttctggggtccagataggctggcaagagctgtttttgcatccatttgcatcgtgaagactggcattttgatacttcagctgtttgttcctgggagaattctgagcacagattccagaggtcacagtaagccttgcagcttgagctgaaagatgccagagccggagatgtctgctggcagcaggcagggttcattctggtgacacagcaacagatgcctggcctgggaacccagggatttcacctccaccagtgagaccacggggccactgtggggtgagggaaggagcgcttggagtcagagctctaga

SEQ ID NO: 21593 - DNA, 3367 bp, Homo sapiens
cctgacacctctgcaaataattgtcttcctcccgtattcctcctgaaacggttcgctcctttcgctgtctctcccagacccatctggttttcacatcgccatacaaagcccaacccgcccatctcctctctgcaagcccagagaacttgattccccatgttgaaactcgtcggtggcggtggcgggcaggactgggcatgctcagtggcggggaccagtctgggaggcgaggaagccgcgtttgaagtcgcgcggcctggggatcaggggaaggcgggcggcgggagccccggctgggggtgcgcggggatccccgattccgcgcccggggctggcgtgctccaggccggcgccgtggggccggcgcgcggggggcagggcgcagaggaggtgggggagtcggcaggaggaggggaggagcgccgggttcgccatccccaggcgccggctctgcggctgctgaatcggaagccgcagggaggatccggggaaataaagacgccggagaatgacctccagcgaggccgcctgagccggggcccgcgcacagccccgccagcccccggcatgggcgaccgcagcgggcagcaggagcgctcggtcccgcactctccaggggcccccgtgggcaccagcgccgccgctgtgaacgggctgctgcacaacggcttccatccgccgccagtccagccgccgcacgtctgcagccggggtccagtgggcggcagcgacgcggcgccccagcgcctcccgctcctgccggagctgcagccgcagccactgctccctcagcatgactccccggccaagaaatgccggctgcggaggaggatggactcggggagaaagaacaggccgccattcccatggtttggcatggacatcggtggaacgctggttaaattggtgtatttcgagccgaaggatattacagccgaagaggagcaagaggaagtggagaacctgaagagcatccggaagtatttgacttctaatactgcttatgggaaaactgggatccgagacgtccacctggaactgaaaaacctgaccatgtgtggacgcaaagggaacctgcacttcatccgctttcccagctgtgctatgcacaggttcattcagatgggcagcgagaagaacttctctagccttcacaccaccctctgtgccacaggaggcggggctttcaaattcgaagaggacttcagaatgattgctgacctgcagctgcataaactggatgaactggactgtctgattcagggcctgctttatgtcgactctgttggcttcaacggcaagccagaatgttactattttgaaaatcccacaaatcctgaattgtgtcaaaaaaagccgtactgccttgataacccataccctatgttgctggttaacatgggctcaggtgtcagcattctagccgtgtactccaaggacaactataaaagagttacagggaccagtcttggaggtggaacattcctaggcctatgttgcttgctgactggttgtgagacctttgaagaagctctggaaatggcagctaaaggcgacagcaccaatgttgataaactggtgaaggacatttacggaggagactatgaacgatttggccttcaaggatctgctgtagcatcaagctttggcaacatgatgagtaaagaaaagcgagattccatcagcaaggaagacctcgcccgggccacattggtcaccatcaccaacaacattggctccattgctcggatgtgcgcgttgaatgagaacatagacagagttgtgtttgttggaaattttctcagaatcaatatggtctccatgaagctgctggcatatgccatggatttttggtccaaaggacaactgaaagctctgtttttggaacatgagggttattttggagccgttggggcactgttggaactgttcaaaatgactgatgacaagtagagacgagcagtggaggaaacagcctcccaaaaggacagagaactaaaaaattgctgctggagaaggtgaaagtcgctttgggacggaagccaagccattatggcagatgaacctgctggatttgtaaataatttaaaatccttccagatgatcttttactcttaggttttgagctaatgattcaaaacgggggaatataaaaggttttttttctgtatactgtatttttttaaaaaaatggtgcagcgtggccaaacctaccaattgtatgcattaactttgaaaagttgtttgatgtttaagaaggacctgatatgtaagcgctggtcatttttcttctggggtttactgatcagtgtggtgattttaacttcatttagtaattactctaggagattttaccttgacttatatttttcatgacgtttcatgatttgctgttggtttcaaatgaaactacaaatctggcatgttttactgtgaacacttttgttatttgttttgtacccttttttgtcttgtttttctgttttagttgtcttctgaaaaaagagtcgttccctctgtttctgtcctcagatgatgtccctccccctacctgtaacctttctttgacataattgttcatatcaatgaaggtgctgaccagctcaatacaaagttaagcacaagatctaaagctcttgaaaatgcccgtgaagagaagactgaatgtgttaatgaatttaatgagtctggcaaaagttgcaaattatatgcaagtttgtcctatcgcttataaatgtagtgtttcattggatttattttatgctaggttatattaagttgaaatagtctgtgattaaatgtcctcatccatgcacagaatatgaatggcagcaaatctttgtgcaagaaatttgaaacttattgggaaaagcctcccagtagattaattgttcatatcaggagatttagggtaagtcatgggttgaggtgtcagatagtaatatctatttgttttgtacatgtatatatctaggaactttgtaacaacacatctttaataatgttaaaggttttttcatttttaatattttaaactaaaaactgtacttcaatctcagtttctaaaattaaaaataatttatactgatctatatattttttctttttgaaagatttcattaagactgatgggtaactttcaaatgagggtcatgtacaaatattgggatgcatgagatcccatgatcttgtgtattgagcttattgttgaaagggatttttgaaggacagaacaattactccatgatgaatcttcctttctctgccttctgagcaccgtctttaatttccatatcttcaagtcttgaagaagttgatgttaattgaagaattcacttgtctggttgaaataaagcctgtttctgtt

SEQ ID NO: 21594 - DNA, 2513 bp, Homo sapiens
cacaatctaaagcttgtatatataatggtagtttgtaaagtgtaccttccccacaggacgctgtgggatgtaaatttgtaggtcgagtttacagctggtttttcttgactgaagctcattcaactggttacttctttgtgggtgtctttaatgaagcttataaatggcaaaaagcaaacattcccatggtttggcatggacatcggtggaacgctggttaaattggtgtatttcgagccgaaggatattacagccgaagaggagcaagaggaagtggagaacctgaagagcatccggaagtatttgacttctaatactgcttatgggaaaactgggatccgagacgtccacctggaactgaaaaacctgaccatgtgtggacgcaaagggaacctgcacttcatccgctttcccagctgtgctatgcacaggttcattcagatgggcagcgagaagaacttctctagccttcacaccaccctctgtgccacaggaggcggggctttcaaattcgaagaggacttcagaatgattgctgacctgcagctgcataaactggatgaactggactgtctgattcagggcctgctttatgtcgactctgttggcttcaacggcaagccagaatgttactattttgaaaatcccacaaatcctgaattgtgtcaaaaaaagccgtactgccttgataacccataccctatgttgctggttaacatgggctcaggtgtcagcattctagccgtgtactccaaggacaactataaaagagttacagggaccagctttggcaacatgatgagtaaagaaaagcgagattccatcagcaaggaagacctcgcccgggccacattggtcaccatcaccaacaacattggctccattgctcggatgtgcgcgttgaatgagaacatagacagagttgtgtttgttggaaattttctcagaatcaatatggtctccatgaagctgctggcatatgccatggatttttggtccaaaggacaactgaaagctctgtttttggaacatgagggttattttggagccgttggggcactgttggaactgttcaaaatgactgatgacaagtagagacgagcagtggaggaaacagcctcccaaaaggacagagaactaaaaaattgctgctggagaaggtgaaagtcgctttgggacggaagccaagccattatggcagatgaacctgctggatttgtaaataatttaaaatccttccagatgatcttttactcttaggttttgagctaatgattcaaaacgggggaatataaaaggttttttttctgtatactgtatttttttaaaaaaatggtgcagcgtggccaaacctaccaattgtatgcattaactttgaaaagttgtttgatgtttaagaaggacctgatatgtaagcgctggtcatttttcttctggggtttactgatcagtgtggtgattttaacttcatttagtaattactctaggagattttaccttgacttatatttttcatgacgtttcatgatttgctgttggtttcaaatgaaactacaaatctggcatgttttactgtgaacacttttgttatttgttttgtacccttttttgtcttgtttttctgttttagttgtcttctgaaaaaagagtcgttccctctgtttctgtcctcagatgatgtccctccccctacctgtaacctttctttgacataattgttcatatcaatgaaggtgctgaccagctcaatacaaagttaagcacaagatctaaagctcttgaaaatgcccgtgaagagaagactgaatgtgttaatgaatttaatgagtctggcaaaagttgcaaattatatgcaagtttgtcctatcgcttataaatgtagtgtttcattggatttattttatgctaggttatattaagttgaaatagtctgtgattaaatgtcctcatccatgcacagaatatgaatggcagcaaatctttgtgcaagaaatttgaaacttattgggaaaagcctcccagtagattaattgttcatatcaggagatttagggtaagtcatgggttgaggtgtcagatagtaatatctatttgttttgtacatgtatatatctaggaactttgtaacaacacatctttaataatgttaaaggttttttcatttttaatattttaaactaaaaactgtacttcaatctcagtttctaaaattaaaaataatttatactgatctatatattttttctttttgaaagatttcattaagactgatgggtaactttcaaatgagggtcatgtacaaatattgggatgcatgagatcccatgatcttgtgtattgagcttattgttgaaagggatttttgaaggacagaacaattactccatgatgaatcttcctttctctgccttctgagcaccgtctttaatttccatatcttcaagtcttgaagaagttgatgttaattgaagaattcacttgtctggttgaaataaagcctgtttctgttgtga

SEQ ID NO: 21595 - DNA, 2703 bp, Homo sapiens
aagtgcattatttcacaatctaaagcttgtatatataatggtagtttgtaaagtgtaccttccccacaggacgctgtgggatgtaaatttgtaggtcgagtttacagctggtttttcttgactgaagctcattcaactggttacttctttgtgggtgtctttaatgaagcttataaatggcaaaaagcaaacattcccatggtttggcatggacatcggtggaacgctggttaaattggtgtatttcgagccgaaggatattacagccgaagaggagcaagaggaagtggagaacctgaagagcatccggaagtatttgacttctaatactgcttatgggaaaactgggatccgagacgtccacctggaactgaaaaacctgaccatgtgtggacgcaaagggaacctgcacttcatccgctttcccagctgtgctatgcacaggttcattcagatgggcagcgagaagaacttctctagccttcacaccaccctctgtgccacaggaggcggggctttcaaattcgaagaggacttcagaatgattgctgacctgcagctgcataaactggatgaactggactgtctgattcagggcctgctttatgtcgactctgttggcttcaacggcaagccagaatgttactattttgaaaatcccacaaatcctgaattgtgtcaaaaaaagccgtactgccttgataacccataccctatgttgctggttaacatgggctcaggtgtcagcattctagccgtgtactccaaggacaactataaaagagttacagggaccagtcttggaggtggaacattcctaggcctatgttgcttgctgactggttgtgagacctttgaagaagctctggaaatggcagctaaaggcgacagcaccaatgttgataaactggtgaaggacatttacggaggagactatgaacgatttggccttcaaggatctgctgtagcatcaagctttggcaacatgatgagtaaagaaaagcgagattccatcagcaaggaagacctcgcccgggccacattggtcaccatcaccaacaacattggctccattgctcggatgtgcgcgttgaatgagaacatagacagagttgtgtttgttggaaattttctcagaatcaatatggtctccatgaagctgctggcatatgccatggatttttggtccaaaggacaactgaaagctctgtttttggaacatgagggttattttggagccgttggggcactgttggaactgttcaaaatgactgatgacaagtagagacgagcagtggaggaaacagcctcccaaaaggacagagaactaaaaaattgctgctggagaaggtgaaagtcgctttgggacggaagccaagccattatggcagatgaacctgctggatttgtaaataatttaaaatccttccagatgatcttttactcttaggttttgagctaatgattcaaaacgggggaatataaaaggttttttttctgtatactgtatttttttaaaaaaatggtgcagcgtggccaaacctaccaattgtatgcattaactttgaaaagttgtttgatgtttaagaaggacctgatatgtaagcgctggtcatttttcttctggggtttactgatcagtgtggtgattttaacttcatttagtaattactctaggagattttaccttgacttatatttttcatgacgtttcatgatttgctgttggtttcaaatgaaactacaaatctggcatgttttactgtgaacacttttgttatttgttttgtacccttttttgtcttgtttttctgttttagttgtcttctgaaaaaagagtcgttccctctgtttctgtcctcagatgatgtccctccccctacctgtaacctttctttgacataattgttcatatcaatgaaggtgctgaccagctcaatacaaagttaagcacaagatctaaagctcttgaaaatgcccgtgaagagaagactgaatgtgttaatgaatttaatgagtctggcaaaagttgcaaattatatgcaagtttgtcctatcgcttataaatgtagtgtttcattggatttattttatgctaggttatattaagttgaaatagtctgtgattaaatgtcctcatccatgcacagaatatgaatggcagcaaatctttgtgcaagaaatttgaaacttattgggaaaagcctcccagtagattaattgttcatatcaggagatttagggtaagtcatgggttgaggtgtcagatagtaatatctatttgttttgtacatgtatatatctaggaactttgtaacaacacatctttaataatgttaaaggttttttcatttttaatattttaaactaaaaactgtacttcaatctcagtttctaaaattaaaaataatttatactgatctatatattttttctttttgaaagatttcattaagactgatgggtaactttcaaatgagggtcatgtacaaatattgggatgcatgagatcccatgatcttgtgtattgagcttattgttgaaagggatttttgaaggacagaacaattactccatgatgaatcttcctttctctgccttctgagcaccgtctttaatttccatatcttcaagtcttgaagaagttgatgttaattgaagaattcacttgtctggttgaaataaagcctgtttctgttgtga

SEQ ID NO: 21596 - DNA, 2800 bp, Homo sapiens
gccgaagtgcattatttcacaatctaaagcttgtatatataatggtagtttgtaaagtgtaccttccccacaggacgctgtgggatgtaaatttgtaggtcgagtttacagctggtttttcttgactgaagctcattcaactggttacttctttgtgggtgtctttaatgaagcttataaatggcaaaaagcaaacatgctcttttgcctttctgccatgggatgatgcagcaagaaggccttcaccagatgcagtccctcgatcttggacttctcagcctccagaactcattcccatggtttggcatggacatcggtggaacgctggttaaattggtgtatttcgagccgaaggatattacagccgaagaggagcaagaggaagtggagaacctgaagagcatccggaagtatttgacttctaatactgcttatgggaaaactgggatccgagacgtccacctggaactgaaaaacctgaccatgtgtggacgcaaagggaacctgcacttcatccgctttcccagctgtgctatgcacaggttcattcagatgggcagcgagaagaacttctctagccttcacaccaccctctgtgccacaggaggcggggctttcaaattcgaagaggacttcagaatgattgctgacctgcagctgcataaactggatgaactggactgtctgattcagggcctgctttatgtcgactctgttggcttcaacggcaagccagaatgttactattttgaaaatcccacaaatcctgaattgtgtcaaaaaaagccgtactgccttgataacccataccctatgttgctggttaacatgggctcaggtgtcagcattctagccgtgtactccaaggacaactataaaagagttacagggaccagtcttggaggtggaacattcctaggcctatgttgcttgctgactggttgtgagacctttgaagaagctctggaaatggcagctaaaggcgacagcaccaatgttgataaactggtgaaggacatttacggaggagactatgaacgatttggccttcaaggatctgctgtagcatcaagctttggcaacatgatgagtaaagaaaagcgagattccatcagcaaggaagacctcgcccgggccacattggtcaccatcaccaacaacattggctccattgctcggatgtgcgcgttgaatgagaacatagacagagttgtgtttgttggaaattttctcagaatcaatatggtctccatgaagctgctggcatatgccatggatttttggtccaaaggacaactgaaagctctgtttttggaacatgagggttattttggagccgttggggcactgttggaactgttcaaaatgactgatgacaagtagagacgagcagtggaggaaacagcctcccaaaaggacagagaactaaaaaattgctgctggagaaggtgaaagtcgctttgggacggaagccaagccattatggcagatgaacctgctggatttgtaaataatttaaaatccttccagatgatcttttactcttaggttttgagctaatgattcaaaacgggggaatataaaaggttttttttctgtatactgtatttttttaaaaaaatggtgcagcgtggccaaacctaccaattgtatgcattaactttgaaaagttgtttgatgtttaagaaggacctgatatgtaagcgctggtcatttttcttctggggtttactgatcagtgtggtgattttaacttcatttagtaattactctaggagattttaccttgacttatatttttcatgacgtttcatgatttgctgttggtttcaaatgaaactacaaatctggcatgttttactgtgaacacttttgttatttgttttgtacccttttttgtcttgtttttctgttttagttgtcttctgaaaaaagagtcgttccctctgtttctgtcctcagatgatgtccctccccctacctgtaacctttctttgacataattgttcatatcaatgaaggtgctgaccagctcaatacaaagttaagcacaagatctaaagctcttgaaaatgcccgtgaagagaagactgaatgtgttaatgaatttaatgagtctggcaaaagttgcaaattatatgcaagtttgtcctatcgcttataaatgtagtgtttcattggatttattttatgctaggttatattaagttgaaatagtctgtgattaaatgtcctcatccatgcacagaatatgaatggcagcaaatctttgtgcaagaaatttgaaacttattgggaaaagcctcccagtagattaattgttcatatcaggagatttagggtaagtcatgggttgaggtgtcagatagtaatatctatttgttttgtacatgtatatatctaggaactttgtaacaacacatctttaataatgttaaaggttttttcatttttaatattttaaactaaaaactgtacttcaatctcagtttctaaaattaaaaataatttatactgatctatatattttttctttttgaaagatttcattaagactgatgggtaactttcaaatgagggtcatgtacaaatattgggatgcatgagatcccatgatcttgtgtattgagcttattgttgaaagggatttttgaaggacagaacaattactccatgatgaatcttcctttctctgccttctgagcaccgtctttaatttccatatcttcaagtcttgaagaagttgatgttaattgaagaattcacttgtctggttgaaataaagcctgtttctgttgtg

SEQ ID NO: 21597 - DNA, 2780 bp, Homo sapiens
gaagtcgcgcggcctggggatcaggggaaggcgggcggcgggagccccggctgggggtgcgcggggggcagggcgcagaggaggtgggggagtcggcaggaggaggggaggagcgccgggttcgccatccccaggcgccggctctgcggctgctgaatcggaagccgcagggaggatccggggaaataaagacgccggagaatgacctccagcgaggccgcctgagccggggcccgcgcacagccccgccagcccccggcatgggcgaccgcagcgggcagcaggagcgctcggtcccgcactctccaggggcccccgtgggcaccagcgccgccgctgtgaacgggctgctgcacaacggcttccatccgccgccagtccagccgccgcacgtctgcagccggggtccagtgggcggcagcgacgcggcgccccagcgcctcccgctcctgccggagctgcagccgcagccactgctccctcagcatgactccccggccaagaaatgccggctgcggaggaggatggactcggggagaaagaacaggccgccattcccatggtttggcatggacatcggtggaacgctggttaaattggtgtatttcgagccgaaggatattacagccgaagaggagcaagaggaagtggagaacctgaagagcatccggaagtatttgacttctaatactgcttatgggaaaactgggatccgagacgtccacctggaactgaaaaacctgaccatgtgtggacgcaaagggaacctgcacttcatccgctttcccagctgtgctatgcacaggttcattcagatgggcagcgagaagaacttctctagccttcacaccaccctctgtgccacaggaggcggggctttcaaattcgaagaggacttcagaatgattgctgacctgcagctgcataaactggatgaactggactgtctgattcagggcctgctttatgtcgactctgttggcttcaacggcaagccagaatgttactattttgaaaatcccacaaatcctgaattgtgtcaaaaaaagccgtactgccttgataacccataccctatgttgctggttaacatgggctcaggtgtcagcattctagccgtgtactccaaggacaactataaaagagttacagggaccagtcttggaggtggaacattcctaggcctatgttgcttgctgactggttgtgagacctttgaagaagctctggaaatggcagctaaaggcgacagcaccaatgttgataaactggtgaaggacatttacggaggagactatgaacgatttggccttcaaggatctgctgtagcatcaagctttggcaacatgatgagtaaagaaaagcgagattccatcagcaaggaagacctcgcccgggccacattggtcaccatcaccaacaacattggctccattgctcggatgtgcgcgttgaatgagaacatagacagagttgtgtttgttggaaattttctcagaatcaatatggtctccatgaagctgctggcatatgccatggatttttggtccaaaggacaactgaaagctctgtttttggaacatgagggttattttggagccgttggggcactgttggaactgttcaaaatgactgatgacaagtagagacgagcagtggaggaaacagcctcccaaaaggacagagaactaaaaaattgctgctggagaaggtgaaagtcgctttgggacggaagccaagccattatggcagatgaacctgctggatttgtaaataatttaaaatccttccagatgatcttttactcttaggttttgagctaatgattcaaaacgggggaatataaaaggttttttttctgtatactgtatttttttaaaaaaatggtgcagcgtggccaaacctaccaattgtatgcattaactttgaaaagttgtttgatgtttaagaaggacctgatatgtaagcgctggtcatttttcttctggggtttactgatcagtgtggtgattttaacttcatttagtaattactctaggagattttaccttgacttatatttttcatgacgtttcatgatttgctgttggtttcaaatgaaactacaaatctggcatgttttactgtgaacacttttgttatttgttttgtacccttttttgtcttgtttttctgttttagttgtcttctgaaaaaagagtcgttccctctgtttctgtcctcagatgatgtccctccccctacctgtaacctttctttgacataattgttcatatcaatgaaggtgctgaccagctcaatacaaagttaagcacaagatctaaagctcttgaaaatgcccgtgaagagaagactgaatgtgttaatgaatttaatgagtctggcaaaagttgcaaattatatgcaagtttgtcctatcgcttataaatgtagtgtttcattggatttattttatgctaggttatattaagttgaaatagtctgtgattaaatgtcctcatccatgcacagaatatgaatggcagcaaatctttgtgcaagaaatttgaaacttattgggaaaagcctcccagtagattaattgttcatatcaggagatttagggtaagtcatgggttgaggtgtcagatagtaatatctatttgttttgtacatgtatatatctaggaactttgtaacaacacatctttaataatgttaaaggttttttcatttttaatattttaaactaaaaactgtacttcaatctcagtttctaaaattaaaaataatttatactg

SEQ ID NO: 21598 - DNA, 2280 bp, Homo sapiens
gggtggatgaggaggctcgggcccttccacccacgcgtccattgggcggcgccgccatcactctcttctgggctacaccgccttctcttcctccgcggaacccggatcccctcctccaccaccctctccccgccccgtcacgatagcctctcattggacggaggcacggtcaatcctcctcgagttagggagccgactggacgcgaggcctttgggccgtccccagcctcgtcggattggcttcctgcgcgttggcgcaacggaagaggcggccggccgagggcgcgcctctgctctggctggactgccgcggaggaggcgagaaggaatccgacgctggggggcttgctcgggcggcagcgactgctgctgcggatgggagggggccggctcggcgcgcccatggagcgccacggcagggcttccgccacctccgtctcgtcggctggggagcaggcggccggggaccccgaagggcggcggcaggagccactgcggcgccgggcgagcagcgcgtcggtgcccgcggtcggggcctcggctgagggcacgaggcgggatcgactgggctcttacagcggccccacctcggtctcccgccagcgcgtcgaaagcctgaggaaaaagcggccgctttttccatggtttggactggatatcggtggaactctggtcaagctggtatattttgaacccaaagacatcactgctgaagaagaagaggaagaagtggaaagtcttaaaagcattcggaagtacctgacctccaatgtggcttatgggtctacaggcattcgggacgtgcacctcgagctgaaggacctgactctgtgtggacgcaaaggcaatctgcactttatacgctttcccactcatgacatgcctgcttttattcaaatgggcagagataaaaacttctcgagtctccacactgtcttttgtgccactggaggtggagcgtacaaatttgagcaggattttctcacaataggtgatcttcagctttgcaaactggatgaactagattgcttgatcaaaggaattttatacattgactcagtcggattcaatggacggtcacagtgctattactttgaaaaccctgctgattctgaaaagtgtcagaagttaccatttgatttgaaaaatccgtatcctctgcttctggtgaacattggctcaggggttagcatcttagcagtatattccaaagataattacaaacgggtcacaggtactagtcttggaggaggaactttttttggtctctgctgtcttcttactggctgtaccacttttgaagaagctcttgaaatggcatctcgtggagatagcaccaaagtggataaactagtacgagatatttatggaggggactatgagaggtttggactgccaggctgggctgtggcttcaagctttggaaacatgatgagcaaggagaagcgagaggctgtcagtaaagaggacctggccagagcgactttgatcaccatcaccaacaacattggctcaatagcaagaatgtgtgcccttaatgaaaacattaaccaggtggtatttgttggaaatttcttgagaattaatacgatcgccatgcggcttttggcatatgctttggattattggtccaaggggcagttgaaagcacttttttcggaacacgagggttattttggagctgttggagcactccttgagctgttgaagatcccgtgatcattacctggggaggggttcctgaaaccttccacaatgggatctgtggactttcatttttttaagagacttactcaatttcatgactgtactacctgaaacaaagtgagaaaggacaggtgtatttttctaagtcatcaagataaatccttaagaattcagtctaaattagcaaccaggaaggaaaaatatattaaaaacaacaaaaaagtggcacatgtccaggcagtgtgaggatttgctgtatataagttgcctgctttgtatttttgaaatctctgcatcactcattggaagtgcttctgaagagagctgctctgtgttcagttgactggttttgtgtcctgtttgaacttgctgaatgtaaggcaggctactatgcgttataatctaatcacaatttgtcaatatggtcttggcaatcatctgtgcattactctggtttgcattaagcctgtgtgtgaacttactgtaaaacatgttttatttcaaggttctgcaaaattaattgggcaggttaattgtgtacctgaaacttaacaagcagtttttggaagggca

SEQ ID NO: 21599 - DNA, 1567 bp, Homo sapiens
agcggccgcgtaaatccggctggaggcctcgggtgctccgaaagcggtaccttcgggggcccccccgcacccattgtttttccatggtttggactggatatcggtggaactctggtcaagctggtatattttgaacccaaagacatcactgctgaagaagaagaggaagaagtggaaagtcttaaaagcattcggaagtacctgacctccaatgtggcttatgggtctacaggcattcgggacgtgcacctcgagctgaaggacctgactctgtgtggacgcaaaggcaatctgcactttatacgctttcccactcatgacatgcctgcttttattcaaatgggcagagataaaaacttctcgagtctccacactgtcttttgtgccactggaggtggagcgtacaaatttgagcaggattttctcacaataggtgatcttcagctttgcaaactggatgaactagattgcttgatcaaaggaattttatacattgactcagtcggattcaatggacggtcacagtgctattactttgaaaaccctgctgattctgaaaagtgtcagaagttaccatttgatttgaaaaatccgtatcctctgcttctggtgaacattggctcaggggttagcatcttagcagtatattccaaagataattacaaacgggtcacaggtactagtcttggaggaggaactttttttggtctctgctgtcttcttactggctgtaccacttttgaagaagctcttgaaatggcatctcgtggagatagcaccaaagtggataaactagtacgagatatttatggaggggactatgagaggtttggactgccaggctgggctgtggcttcaagctttggaaacatgatgagcaaggagaagcgagaggctgtcagtaaagaggacctggccagagcgactttgatcaccatcaccaacaacattggctcaatagcaagaatgtgtgcccttaatgaaaacattaaccaggtggtatttgttggaaatttcttgagaattaatacgatcgccatgcggcttttggcatatgctttggattattggtccaaggggcagttgaaagcacttttttcggaacacgagggttattttggagctgttggagcactccttgagctgttgaagatcccgtgatcattacctggggaggggttcctgaaaccttccacaatgggatctgtggactttcatttttttaagagacttactcaatttcatgactgtactacctgaaacaaagtgagaaaggacaggtgtatttttctaagtcatcaagataaatccttaagaattcagtctaaattagcaaccaggaaggaaaaatatattaaaaacaacaaaaaagtggcacatgtccaggcagtgtgaggatttgctgtatataagttgcctgctttgtatttttgaaatctctgcatcactcattggaagtgcttctgaagagagctgctctgtgttcagttgactggttttgtgtcctgtttgaacttgctgaatgtaaggcaggctactatgcgttataatctaatcacaatttgtc

SEQ ID NO: 21600 - DNA, 4815 bp, Homo sapiens
atgctgggggaggggctggcggcctcgacggcagctgcggaactaggccgagggacaaaggctaagtttttccatggtttggactggatatcggtggaactctggtcaagctggtatattttgaacccaaagacatcactgctgaagaagaagaggaagaagtggaaagtcttaaaagcattcggaagtacctgacctccaatgtggcttatgggtctacaggcattcgggacgtgcacctcgagctgaaggacctgactctgtgtggacgcaaaggcaatctgcactttatacgctttcccactcatgacatgcctgcttttattcaaatgggcagagataaaaacttctcgagtctccacactgtcttttgtgccactggaggtggagcgtacaaatttgagcaggattttctcacaataggtgatcttcagctttgcaaactggatgaactagattgcttgatcaaaggaattttatacattgactcagtcggattcaatggacggtcacagtgctattactttgaaaaccctgctgattctgaaaagtgtcagaagttaccatttgatttgaaaaatccgtatcctctgcttctggtgaacattggctcaggggttagcatcttagcagtatattccaaagataattacaaacgggtcacaggtactagtcttggaggaggaactttttttggtctctgctgtcttcttactggctgtaccacttttgaagaagctcttgaaatggcatctcgtggagatagcaccaaagtggataaactagtacgagatatttatggaggggactatgagaggtttggactgccaggctgggctgtggcttcaagctttggaaacatgatgagcaaggagaagcgagaggctgtcagtaaagaggacctggccagagcgactttgatcaccatcaccaacaacattggctcaatagcaagaatgtgtgcccttaatgaaaacattaaccaggtggtatttgttggaaatttcttgagaattaatacgatcgccatgcggcttttggcatatgctttggattattggtccaaggggcagttgaaagcacttttttcggaacacgagggttattttggagctgttggagcactccttgagctgttgaagatcccgtgatcattacctggggaggggttcctgaaaccttccacaatgggatctgtggactttcatttttttaagagacttactcaatttcatgactgtactacctgaaacaaagtgagaaaggacaggtgtatttttctaagtcatcaagataaatccttaagaattcagtctaaattagcaaccaggaaggaaaaatatattaaaaacaacaaaaaagtggcacatgtccaggcagtgtgaggatttgctgtatataagttgcctgctttgtatttttgaaatctctgcatcactcattggaagtgcttctgaagagagctgctctgtgttcagttgactggttttgtgtcctgtttgaacttgctgaatgtaaggcaggctactatgcgttataatctaatcacaatttgtcaatatggtcttggcaatcatctgtgcattactctggtttgcattaagcctgtgtgtgaacttactgtaaaacatgttttatttcaaggttctgcaaaattaattgggcaggttaattgtgtacctgaaacttaacaagcagtttttggaagggcagttccacgttactttacactaaatcctgggaatgaatgtctggagagacagggcttcttttcttggcagaatttccttgggtagtgggcggactgttctgatgcaagtgggtacactggcagaagcagcacaatctggaggactaacatgagtcagcagggccactagaattgacaccccctcaggggatcagggagaatctggtttttctttcaggctaagtagaaaaggaagaactgaagtgtctgtcaaagaactcatggggagtggggggtccttcagggcactgtggcacttgggaggtgagtctcagaagactgcctgaggagagtgccaggctgcaggtgctcttggtaggggctgaagcttttctttctgctttgcagaataatttcaaaagcctttcccaaggagagaatgcaccttttatatctgaggtcttaagtggtgcccatattgctgttgaaggcaaggatgggcctgtacaaagcagccttggaccaggagggaaaaccccaaggctctgcagcctccctgctcccctccgtttaaggctgtggtcagggagggatgggcagggtgccagccgcatggaggcagcagagacacccgtgttccagctggggcaaggggaactgatatgtgggctgtgggctgttccactaggcgtggccacctctgcacatgggccttggcacttaggaaatatgggtgctgctgcattgggaccttgtgtgggtgcagagcaggatggctgctgcgtggagggtaattttgtcccctggagagtgattggtgaccctcttccctgctgctgctgtttgcaggctcctggcctatactacctctgacgccctgatcctgagttcctctgccctcctctgctgccagcagcgctgttggtggcctcaccctcctccagtacccaggcaccaaagatggcaccaccatcctcctgcttgtaccacagggtgctgctccctgggccaactcctgtgaacttgctcacttcccatggagaccgaggccagggcctgcccctctgaggcccctgttttgtggtcctgctgcctctgctgtgctgcgttcaggaggttgtccactgctcgacgtgggtcaccatgcagcccttgctgttcccacaatttaacagaaaaggaaactgaacggatgagtaaggctgcccagggtcactcagctggaaaagagtagagctggactcaaacccgggactgtctgtctctggtgcctgagttgggaagacgctgttgatgtccccttctgcctcgctttgagcttcctcctccgtgggccctccccctactctagagaaactagtccattccctcatgttccaccttgtgctcagtaaaccctgtcactccacagcagggtttttgagacagtctcgctgtgtcacccaggtggagtgcagtggggcgatctcagctcactgcaacctctgccttccaggctcaagcaattctcctgccttagcctcctgcgtagctgagactacaggcatgtgccaccatggctggctaatttttatatttttagtagagatggggtttcaccatgatggccaggctggtctcgaactccagaccccaggtgatccgcctgccttggcctcccaaagtgctgggaatacaggtgtgagcccctgcgcccggctcacagcagggttcttgataggccaccagtgaatcccatgccaccgaatctggcattcatttcacagcctcatctcagttctcactcagcagagccctcttgcctgtcctgccacccaggctactaatgttctggttcattctctgctgacagttagctgtggctgtcctcagcctcagtcctgggtctccccaagcagtcattagcatcaccttgactgatttccagggaacacttcaaccaccccttacctctgagctccagccccgagacactgccttctctctgcatttgttgatctctgtgcagcagtgcccacatcctcatcccagcttactgccgtctcaccaccttcaggttgtgaggtgcccataaactctgctgttaccattgccacttccctgtcttagcagctgtccctttcagtctgccctccactagtggccatgaagggggctgtgaccgtggtccaggtgagaaaggaaggcctgaactaagatgggaggtgggtggccagaatggagaggggagaagtggatggccagaatggagagatgcttagagggctgtgttgggaagtggtgactggatacaggggagggaggagagatacaagagggcacctgggctcatttgtggactacgtgattttgagactccaaataagcactgggtatttgggttggagatacagagctgagaatgatatgcatgtaggtgggcaaagcaagggggatttcatgagttctaaggtagggtgagaaaaataaccgagagttgagcagtgacggaggaagctgcaaagaaaacgactgctcagggagaggctggccaggggcctgtggctcaggggactgagaagaggagctctctaggcatctgaattgaggttgcccacaattggttgcaagatcgtggctggccttgatggaagctgggaagccactcggtcctagtgaggggtggtgaggagagcagcaacggccacacaggaaggctttggacgttttttctcctgacactagttatttccaggcctgggatatagctaggggcttggggtgggggcaactctttgcagggtggtgtggcctgtggaggaaacaggctcagttccactactttggccaggtgcaatggctcatgcctgtaatcccagcactttggaaggccaaggcgggtggatcacctgaggtcaggagttcaagaccagcctggacaacatggtgaaaccccgtctctactgaaaatacaaaaataattagccgggaatggtggtgcgtgcctgtaatcccaggtactcgagaggctgaggcagacagttgcttgaacctgggaggcagaggttgctgcagtgagccgagattgctgcactgcactccagcctgggtgacagcaagactgtctcaaaaaaaaaaaaaaaaaa

SEQ ID NO: 21601 - DNA, 10506 bp, Homo sapiens
gcggcggcggcggcggtggcggcggctccggggaccggggccttttgtttggagcggctgcgggggggccccggagcggcgaggccggcggccttccccagcttgctcggtcccggccacccctcgcgggggtggggggccgccccctgggccgggcatctcctcaggcgccgccgccccgccctaggccggccccgcccggcctgaggggaggaaccggccgggcctcgccgcgcggcccagccacctccggagtcgccgcctctgctctcagtgccccggatcggaggccgtccatcgcccctcgggccgacgccatgaagatcaaagatgccaagaaaccctctttcccatggtttggcatggacattgggggaactctagtaaagctctcgtactttgaacctattgatatcacagcagaggaagagcaagaagaagttgagagtttaaaaagtattcggaaatatttgacttctaacgtggcatatggatccaccggcattcgggatgtacaccttgaactgaaagatttaacactttttggccgaagagggaacttgcactttatcaggtttccaacccaggacctgcctacttttatccaaatgggaagagataaaaacttctcaacattgcagacggtgctatgtgctacaggaggtggtgcttacaagtttgaaaaagattttcgcacaattggaaacctccacctgcacaaactggatgaacttgactgccttgtaaagggcttgctgtatatagactctgtcagtttcaatggacaagccgagtgctattattttgctaatgcctcagaacctgagcgatgccaaaagatgccttttaacctggatgatccctatccactgcttgtagtgaacattggctcaggagtcagtattttagcagtccattccaaagacaactataaacgagtgactgggacaagccttggagggggtacctttctgggtttatgcagtttattgactggctgtgaaagttttgaagaggctcttgaaatggcatccaaaggtgatagcacacaagctgacaagctggtccgtgatatttatggaggagattatgaaagatttggtttgccaggttgggctgtagcatctagttttgggaatatgatttataaggagaagcgagaatctgttagtaaagaagatctggcaagagctactttagttactatcaccaataacattggttctgtggcacgaatgtgtgctgttaatgagaaaataaacagagttgtctttgttggaaactttttacgtgtcaataccctctcaatgaaacttttggcatatgcactggattactggtcaaaaggtcaactaaaagcattgtttctagaacatgagggttactttggagcagttggtgcacttcttgggctgccaaatttcagctaaagcatcaggtctctctctctgctaataaatgtcatccaagaggaactaaaaccagaggcattattactgcattgtttgtcactgggaaccaaaggataaaagagtagcataagctgctgaatgttgccatattaaaggagagaacttggtaacgtgaagtatttctcattgaaatgctttcccttttgtatatagccagtgttaaatccttaaatgcaatacagcctctgattattgagcttcctcttaaaaagatttttttattttatgtagccaacattgcagtactgtatgctcaaacacaaatcttaaagtatcggaactgtttagcttatgaaaataatcgactctgaatatttgttacaagtctgttttatgtgttttgattactagtgagcagaaaataacataccctgtattcaaaattactgaaatggcaatcaaagatgatcatttttatgtgattttagaaatgttaaggcaatactactaattattgtaggtttttttaacgtatcacccaaagcatgtatgtgatctttccccattagtatctttttctcaaatgccataattaactgaaatactattattaaattttcatgagaattctaaaatgaatcctgggaaatgcacgtttggtgatgttgcactttctgtattttacaggaattagtcaatacatgttgaaatgtttaacattttaagattggaggcttaattactgggagtctgtctaatgaagtcctgggactattgtaatggaatatgatttgagttcactgtgctctttttgtttgtttgttttggtcatatatacattcagaacttttattttaaaacaaccacaataacattaataatagaaaattcatctgtaaatattcacagtctagtcactgaaaaatgggaaaacctctaccatgccttattattaccctttgctgtttgaggagccagaaatagaggtgcagttagaggacggtcactttttccaacaaaacccactccatagccatgtggatttttatccaaaggctcaacaaccagagggaatggtgagacctgataactaaaatactgttattggcaagggtttgaaatgtgtaagaacctaggagggaaaggaagattgagcaacataggaaaaggggaagagaggctgagtgtcaccaaggtccaaactccatttataaaaatactgcaaaaccaggagttgatggtagaaatgcatatgatccatggcaggagtaaatctctccacctcctctaactctctgaaaactctagagttggagcaagtcttccatttgcttcttatccccttaaaagaatgccttccacttcccaacagcccccatcaagggaccccaagaggccaccatgctcttatctcgcactttctttcctattccccttgcctgaatctggagtggggttgagccctctgccttcaaccttaagatttaggaagttctttccccaactgtctaacttggaaaggtagatgagtctgaattttgaagtaacgaatgcaaattccactcagcagaggcaatgttatttatgtacatagggatagtggaatgagttttaatagattctgtccaaaaggggtttgttcctcttatttcctctatgtaggaagttgtgtcttaggcaactttatcagtatcaatggaaaaatgataggcactacaatgaaatggcaggatgccaatatgagatatttcaggaataataagaaatacagtttgtttgtataaaataaactatctcaagaaagttttcaacgacagtgatagtgttcatttgtaagagagagttctagaacttcgatgtccagtgcagtagccactacccatatgtagctgttgagcatttgaaatatggttagtccaaattgagatgtgctctaaaggacaataaaaggttaaatatctcctaattttttgtattgattacatgttgaaatgttaacattggaaatattgggttaaagaaaaatacacaattaaaatgaatcttggccaggcgcagtggctcacgcctctaatcccagcactttgagaggccagggtgggcaggtcacctgaggtcaggagttcgagaccagcctggccagtgtggcaaaaccctgcctactaaaaatacaaaaattagccaggcatggtggtgcgcacctgtagtcccagctacttgggaggctgaggcaggagaattgcttgaacccaggaggaggaggctgcagtgagctgagattgtgccactgcactccagcctgggcgacagagtgagactctgtctcaaaaaaaagaatcatctgtttccaattatttttaaatgtgcttactagaaaagataaaatcacacatggtttacattttatttctattaagacagcaccgttaagaacatagagctttgaggaattgtggtattagaaccaaatctatttaccacagtgagcttacagggagttactcgagatcttaataaaaaattataatctttggcagccttcattatgattttgtgttcttattattccagtacctctagattacatatgggaaaagctaaagagccacagtggtgagatggttgctcactctagcaggtaatttcagtttgaaaggataaaatatatgaatcatagttcacattaaccaaagtacagtgatgaaataacttagactctgaccattccattttttcttaaagattgccctaaatctatagatgctaatacagtatttgccacaggtataaaacttgtagttactgtcattcaattaagattcttatctgtacagatatacaaatcagaaacttttaaaataaattgaactaatggaattttggctccaatatttagtcactacaatggaaatattaaagcaaggaacatgaagtcattgtagggttttaaaatggctactgactgacatgaattcagagtttcaaacagtctaaattctaaaaacttaactttacacgcttttcctcctaaataaccactctaataattcatacattcatatcttcaggtaaagaaaactgaattttaaacaattgaggctgggtgcagtggctcatgcctgtaatcgaatataaggacttgagtataaaatttgaaaactacatggggaaatgtctttatcatgcatctcttgatagtctactgaaaactattaagtaaacctgcggtctgtaaacaaaaaaacccatagtgatacttaccttgtgtaatgtaaacaattttttaagctctttaaagtacatctagatttactggtaatgtatagaagtcaattttatccccaagcatttctacttcctaaaccattagcaagagtctcaaaacaacttcactaaactattggacctccagtgttaacttgccaacataaaaatctgaaaaactttgtaatcactatcaaaaatacaaaagagagaataaattcccaggtaaaaggctttacaaattttggaactattatgcttttgtttactaaacactgatccttttagtaattctgcagtattgcctcagactcccacaaagtttcaaaatagctcatctattagattcctgtaacatttatttgggataaacgtggttttgttgccgttgttcataatagaataaaatatttagctttgatggttcagatgtaatacaaagaaataactaagtttgggcctgagataaatgtggtaaagcaagaatgcagagatgctgtaatgatgagtgagttttatagcattactgaggacctgaaaacttgctgccaaggacactttgaaggttttgttggctggaagaagtgtctctggaatcccactcctagctcttcttgaatatttgaaaagaattagataagggccatggggacccaggtcaccccacctcttcttttcagtttggctacaacattggagtcatcagtgctcctgagacagtcatacaggactttctcagttacactttgaaagagaggtcagaagactctccctctgaggttttgctcatgtccccctggcccttgtctgtggccatcttccccaatggtgatatgattggctcctttctgttgcactctttgtcaaccactttggcaggtgcagttcaatgcttatcataatttgttggctattactggttgccttatgggattctgcagacaagctgagttggttgaaatgctgatcctgggccactagattactggcttgtaatgcggactctgcacaagttttgtgcccatgtacattggagagatctcgcctactcccctttggggtacctttagtgctctcaaccagctggacgtcgttggtattctggagatccagatctttggtctggagttcatcttggggtctgaagagctatgcccagtgatactgggctttaccatccttccagctgtcctataaagtgtagcccttccattttgccctggaagtcgtaagtttttgctcattaacagaaaggaagagtactaatgagatccttcagcaattgtaggggactcaggatgtgtcccaggacatctaggagataagagtgctaggatgatacaagaaaagcaagtcactacactggcgctctttagagtacccagctaccaacaacccactgtcatttccatcatgctccagctctctcagtagctctctggaatcaatgttgtcttctattactcaatgagaatcttcaaggatgcaggtgttgagaagccaatctatagattagtgcaggagtggttaatattatcttcttgactgtagtctctctgtttgtggttgaaagggcaggaaggactttacatatgataggtcttgaggcatggcgttttgttctgtcctcatgattgtttctttgttattaaaggatgagtatggtgggatgagctttgtctgtagtggggctatcttggtctttgtggccttctctgaagttggaccagactccgttccctggaatactgtggccacactcttcagtttgcaatagcagtggctggttgctccaactggacctccaactttctagttggattgctcttcctgaacaattattatctagtttaagtgtgttgttgctttagggtcatggcatgcttatgtatttctgttaccatctgaccatggtactatgccaagttctcttaggggacctgaatctttccagtagaccacatttgagagagtatgagtcaactgggcatagttcccaacaacccaaaatacatacgtacttcactgaagcagatctcatgattccattgacttcatttctaaaattggactttgagcagccaatttctaaggattaaaaagaaactttaatgcattgtagacctctgtacacagaaaaatctttgtaacttttgggcttaattttcattcttaaaaaatctggtaactttttcaaatgcaaccactgtcagtttgctgtgaggctaggcaaacaacacaaggtatagaatttcccatcaccaccaccctgaccccgcgagaagattgccttttaattagagacttgtagaactagtgccttttaagttctacactcatcttttccaaagactattagtaaacttgccatgtaatttgacatggcagttccttgctcagctactctaaataaagttggaaattaggtggtctcttagtttgggtaaagtcagtactattgccagtaatatacatggtaattgaaagcccttaaagtggttcagattatttgccaaatattagactctataaaaatttctgaggttttttttcttttacctttgagtgtacatgtgattgctataatgtaaataccagtcccttaaagactgtttctataagcagaatgatgcagcacaaagtggaaaggttttcctcttattccagcagtattcttgccttcaaagagtagtccatcttgccttgatttttaaggttgttttcttggatggaaagcttaactggatagtaatttccatatgttctttataaccactctgtatattataagcaaagttttttcatattgtatctttttctgttgagcactttatgcattttagtctattgcatttgagaatgtagtttagaaattcactgtttaaagccatgtgaaaactgatagaggataatgaaaatgagtgtacattattttgaatttaacttaactgttttgtggtgggtgtgaacaaaacattagaaatatattatctttttgtgataatactctctgacctcacttaaagtgatctgccatgaggtatccatgatcaagtttatgtttattctaatacctaaggaattcagccaactttgtttctatcatcagataatctcagaaaatagtgtgttttatctatattactgcctcttttcaatatttaagagaataattgtcttctggtttctactgagcctagtaataatcactaaagacctaaaaaaggaattccttctgttaagagtatttggatagcccattcacgataatggtggtgtgaaaatcaatcatcccagcttttctgacatatctaaattttgaataattaatttccacttccaaaaaattcaaatgttttctcaaagcagtcactacttatttgcattattcctgcatattcagtgaatgtgaggtcatatttggtattgtattagaagtagtgttggtcactggtcttgcctctttgaacattatttttatttgtaaaatgagggagttggtttgttatgatgggaaatgagtcagttttcagggtcctgagaaaattgcttcattcatggctgtgtttgagataactaaagtaaattttttttcaggtatttggtgtcatgttttggagttaatatttagtgcttatataattttaagttattacataatttttattggtatatatttgataggtactaggtattggattctcaccaaaccagtagaatggtattctctcttaatatgtgattgcctgtaatggccaggtagatataccttaaagtaatatgaaaggttttatatgtatattaaaatgtttgtacttttaaatctgtaaaggttatctggaatttttactgtgttaacttcagaattatatgggcattatgactttttcattgtacaaaaaattattcataaatgttagaatacagatgttccttgacttacaatagggttatgttccagtagacccattgtaaattgaaaataccgtaagttgaaaatacatttaatacgcctaacctactgaacatcccagcttagcctagcctatcttaaatgtgttctgaacacttaacgttggcctttagctgggcaaaatcatctaatacaaaacctattttataatgaagtgtttaatatctcaaataagagtattgtaccacatatcgttatcccaggataatatcagagtacaaaatttgaagtacagtttttaactgaatgtgtattgcttttgccccattataaagttgaaaaaccataagtcaaaccattgttaagtcggactgtttgtgttacatatatttgggattttttagtggccctttttaaaaagctgtttcttatttctgatcattgtgagtggggatagatgtgggaagaaccatgtctctactaaaaatacaaaaaatagccaggcttgttggcacacacctatagtcccagctactcgggagaccgaggcaggagaatcacttgaaccgggaggcagagggcagatcatgccactgtattccagcctgggcaacagagtaagactctgtctcaaaaatgaatgaatgaatgaatgaacgaatgaatgtactatgagctgatactgggatttcaggtaccgcagtttgtgctgaatgatatgtttggggtaaatcagtttttttcttatagaatttcggcgtttttgctgcaactgccactaattttgcatttaaaagaacaaaagaggaatgtatttttcaaaggagtgaatgaggttaaaatcaagattttgaatggtataaatatgcaactaattcagttgtaggatattattaaattttttattgctaaatatgtttctttcatacgttgcagtgcttacagttccaacagctttccaagaaaacatttccatatttgtgttatttgtaaagtatacataaataatgtaaaataatttgggattatttcaactttacattgtatgtctgaatttcatcgatgttgtacctggctcagtcaatagttgtcacaggtattaagccattttggaatttgccacttttttctgggtaacctgttttagtttagtttacagcatttagaaacagaaggtaactttatagaagtaacaccaatatcctagtctgcttgccccgaatataactaatagtattaggatgtaagcaatattaagatggtttttattattttttatacactgtgtgcttttactttttatttaaactacagcaaaaaactgattttttaactaaaattgaatggcgtttatcttaatgaccagttattgaccaaagtgtactcagaagatgttattatgtcccaatctaaggaatcctttaatttggggattaattttacttacacatgccatttcagtttcagttgcctcattctattacatcattcttgtcaagtctaagctttatcatgtctgaattcttttaacactgaatctgtgatgtaaaaatgtatgatgtgccataaattttattcataataaactaagttatagcctattgtaatctgtaaaacatttcttgtaaattacctaatttattttttcatttatgtacagtatcttatgtaaatttgaaaaatgtttgccatggcgcattctgtaaacattcccgtattcttttccttaatgcttatttgcatgaaggtaacttgggttttgcttgtttgtattggataaccattaagccaacttcagtttctctgcctttttttctgtagtttaaccatttctaattttgttcatattctaaatagatgttagaatcatactttttattttctactttctaaataaattatctaagttgtttacta

SEQ ID NO: 21602 - DNA, 2649 bp, Homo sapiens
gggcactttcaaaatggcggagtgtggagcgagcggcagcgggagcagcggggacagtctggacaagagcatcacgctgccccccgacgagatcttccgcaacctggagaacgccaagcgcttcgccatcgacataggcgggtcgttaaccaagctggcctactattcaacggtacagcacaaagtcgccaaggtgcggtctttcgaccactccggaaaggacacagaacgtgaacatgagccgccctatgagatttcagttcaagaagagatcactgctcgactgcacttcattaagtttgagaatacctacatcgaagcctgcctggacttcatcaaagaccatctcgtcaacacagagaccaaggtcatccaggcgaccgggggcggggcctacaagttcaaagacctcatcgaagagaagctgcggctgaaagtcgacaaggaggacgtgatgacgtgcctgattaaggggtgcaacttcgtgctcaagaacatcccccatgaggccttcgtgtaccagaaggattccgaccctgagttccggttccagaccaaccacccccacattttcccctatcttcttgtcaatatcggctctggagtctccatcgtgaaggtggagacggaggacaggttcgagtgggtcggcggcagctccattggaggcggcaccttctgggggcttggcgctctgctcaccaaaacgaagaagtttgacgagctcctgcacctggcctcgaggggccagcacagcaatgtggacatgctggtgcgggacgtctacggcggcgcccaccagactctcgggctgagcgggaacctcatcgccagcagcttcgggaagtcggccaccgccgaccaagagttctccaaagaagacatggcgaagagcctgctgcacatgatcagcaacgacattgggcagctggcctgcctccacgcacggctgcacagcctggaccgcgtgtactttggaggcttctttatccggggccaccccgtgaccatgcgcaccatcacctatagcatcaacttcttctccaagggggaagtgcaggcgctgtttctgaggcacgaaggctacctgggagccatcggagcgttcctgaaaggagctgagcaggacaatcctaaccagtacagctggggagagaactatgcaggcagctccgggctgatgagtgcatcacccgagctcggcccggcgcagcgggcgcggagtggcacttttgacttgctggaaatggaccggctggagaggccactggttgacctgccgctcctcctggacccgccctcctacgtgcccgacacggtggacctcaccgatgacgctctggcccgaaaatactggctcacctgctttgaggaggccctggacggggtagtgaagcgcgcagtggcgagccagccagactctgtggatgcagccgagagggcggagaagttccggcagaagtactggaacaagcttcagaccctgaggcagcagcccttcgcctatgggaccctgaccgtgcgcagcctgctggacaccagggagcactgtctgaacgagttcaacttcccggatccctactccaaagtgaagcagcgggagaatggcgtggcgctgaggtgcttccccggggtcgtgcgctccctggacgcgctgggctgggaggaacggcagctggcgctggtgaaaggcctcctggcggggaatgtcttcgactggggggccaaagccgtgtctgctgtccttgaatccgacccctactttgggtttgaagaagcaaagaggaagttacaagaaagaccctggctcgtggattcctacagcgagtggcttcagagattaaaggggccccctcataaatgtgccttaattttcgcagataacagtggaatagacatcattttgggagtcttcccctttgtcagggagctactccttagagggacagaggtcatcctggcgtgcaactcaggccccgccctgaacgacgtgacccacagcgagtccctcatcgtggcagagcgtattgcgggcatggaccctgtcgtgcactctgcgctccaggaagagaggctgctgctggtgcagacgggctccagctccccgtgcctcgacctcagccgcctggataaggggctggccgcactggtgcgggagcgtggcgcggatctggtggtcatcgagggcatgggccgtgctgtccacacaaactaccacgcagccctgcgctgcgagagcctcaagctggccgtcatcaagaacgcgtggctggccgagcggctgggcggccggctcttcagcgtcatcttcaagtacgaggtcccagccgagtgaggcgctgcagctgccggactcttctgcttgtcacttgtcaggaatgtgtttttaccaccacagggaaactgcgttcaaatcaacgtatttatatggtactgctgtgacgcggcacatacaccccagccgcacagatgcgtgtgacccagaggcgagacgcagctttgtcctgggagacgttcatattggaatctatttaactgctaaagaaccttttatatatatatatatataaatagagagatctatacaggtatgtctgacgggacgcagcaccgtgggcacgcaccaaatagagtttttaaaagaggccg

SEQ ID NO: 21603 - DNA, 3129 bp, Homo sapiens
gtgttgctcctcccctggcagccgtgaggggggttagatctcagccggagccggagctgggcctagctgtcccacgggccaccactacctcctttggttcgggagaaagctacgaccaagtacgcccagctcgggccttagaacttctgaacgggcagtgcgggtaggccctgcttagcccttcccggaggacacctgaccaaaagaggaagatagtcttgggacccttgcatggtgtttcaaagggtggtgaagaactaaggtagaagaatacatgttcacttccagtgaacaagagcatgttcccaaactcaattttgggtcgcccacccttcactccaaatcatcaacaacataataacttctttaccctgtcacctactgtttattcacaccagcagcttatagatgcacaattcaactttcagaatgcagacttgtctagagctgtgtcattacagcagctgacatatggaaatgtcagtccaatacagacctcagcttccccattatttcgaggaaggaagagattaagcgatgaaaaaaaccttcctcttgacggtaaacggcaacgtttccattcaccccaccaagagccaactgtagttaaccagatagtgcctttatcaggtgaacgaagatactcaatgccaccattgtttcatacacattatgtaccagatatagtcagatgtgttccaccttttcgagaaattgcatttttagaacctagagaaatcacactgcctgaggccaaagataagttgagtcagcagatactggagttatttgaaacatgtcagcagcaaataagtgatttaaagaagaaagaactctgtcgaacacagctgcagagagaaattcagctgttatttccacaaagcagactttttttggttgggtcctctttaaatggatttggtacccggagcagtgatggtgatttatgcctagttgttaaggaagaaccatgtttttttcaggtaaatcagaagactgaagcacggcatatactcaccttagtccataaacacttctgtactagactttcgggctacattgagagacctcagctgattcgagcaaaagtgccaattgtgaagttcagggataaagtcagttgtgtggagtttgacttgaatgtaaacaatattgttggaataagaaacacattccttctcagaacttatgcataccttgaaaatcgagttcgtccgttagtgctggtgattaagaagtgggcaagtcaccatcagataaatgatgccagtcgtggtactttaagcagctatagtcttgtattgatggttttgcactatttacaaaccctacctgaacccatccttccatccctccaaaaaatttacccagagtcttttagtcctgctatacagctgcaccttgtacatcaagctccatgtaatgttcctccttacctctcaaagaatgaatcaaaccttggggacctcttactgggctttcttaaatattatgctacagaatttgactggaatagtcaaatgatttcagttcgtgaagccaaagccattccaaggcctgatggtattgaatggagaaataaatacatctgtgtagaagaaccttttgatggaacaaatacagccagagcagtgcacgaaaagcagaaatttgatatgatcaaggatcaatttttaaagtcatggcacagattgaaaaacaagagagatttgaacagtatactacctgtaagagctgctgtcctgaaaagataactggcctctatttcttaataaattcttccaagaaataaagaacaatagtttcatcataatacattatgtttacctccatcatagttgcttttttcatagttcttgttttcatgttttatttttaaaaagacatataaagattgcatattttattatgacatttcctaataaacccctttgatttaaaaatgtatttttaaaaatgtttacattgatgatgagtaatattgcatgtgttttcaggtgatcagataaaatatattttgggaaattaactgaacaaataaaaagtttttgatataacttcaattaattgtaccacatgctaatcctgaagagatgtgtagaattttggaaagggtctaattcatacatgcttaaagtataacctacgttagatagtttgttgtcaaagtctgttctagtaaagtgaagattcaagtcagttgttcagttacttgaagcaaaacgaaatctttcatttcagtcaaatcactgcagtcatgaaatactgaacaattgccttaagtctttgcttgactcactgggatagactgaggctttgggtgtgtctgtattagcatttcattagtacttcacatgcttttgatgtactcttgagattgctttaaattttgtattgaaacaacaatacattttgcactgtagtaatgggagcactaactcttacaacagttagtgaatcgttttaaagaatcagttcagtgtagacattttgaaaagattgtttcctgtgctttacgatagcttagtgcaatgtgcacttctgttttacttgccattttcctgctctgttttctctgtgacatgaagcaacagaaactgagatcaaagttaagattatatcctgtttgtagtatcagatatttttctgtgtacaattataggattgtaatctaaactggaatttttaggcagtaagtcaccacaaaatgttttagataagacacaataaaattattataaataaaagcttaatgtttgtaaaaaatctcttttttagtatttcttttttcacatgaaagaagtggtggctgctaaaaaaaaagctacagtgtttattaagggtctttttgatttatgtaaatatttgtaaattggtcagtgcctgtaaatttaaatataaaaagtaaccttgaaaacagttttaactttttcaaaagaactatgtccaacattttttagacctgctgtagtacagttttgtacctctaacgtattttttttttgcagaccaaatgctaaaacttttgcttttctttgacttgtaaaaggtgcacattttcattttcttccttaagttcaaatttttgtatgatgtcaaatgcaataaaatttatatatggacattgtt

SEQ ID NO: 21604 - DNA, 3223 bp, Homo sapiens
ctattctcatccggggtcacgtcggtcttccgggtgtctttgacagggttttctacgccgctttttcggcgactttttgctcttccgctttttgccaccgcccccaaccttctatatccttgcagcccctaccttttcttgtgttgctcctcccctggcagccgtgaggggggttagatctcagccggagccggagctgggcctagctgtcccacgggccaccactacctcctttggttcgggagaaagctacgaccaagtacgcccagctcgggccttagaacttctgaacgggcagtgcgggaccaaaagaggaagatagtcttgggacccttgcatggtgtttcaaagggtggtgaagaactaaggtagaagaatacatgttcacttccagtgaacaagagcatgttcccaaactcaattttgggtcgcccacccttcactccaaatcatcaacaacataataacttctttaccctgtcacctactgtttattcacaccagcagcttatagatgcacaattcaactttcagaatgcagacttgtctagagctgtgtcattacagcagctgacatatggaaatgtcagtccaatacagacctcagcttccccattatttcgaggaaggaagagattaagcgatgaaaaaaaccttcctcttgacggtaaacggcaacgtttccattcaccccaccaagagccaactgtagttaaccagatagtgcctttatcaggtgaacgaagatactcaatgccaccattgtttcatacacattatgtaccagatatagtcagatgtgttccaccttttcgagaaattgcatttttagaacctagagaaatcacactgcctgaggccaaagataagttgagtcagcagatactggagttatttgaaacatgtcagcagcaaataagtgatttaaagaagaaagaactctgtcgaacacagctgcagagagaaattcagctgttatttccacaaagcagactttttttggttgggtcctctttaaatggatttggtacccggagcagtgatggtgatttatgcctagttgttaaggaagaaccagtaaatcagaagactgaagcacggcatatactcaccttagtccataaacacttctgtactagactttcgggctacattgagagacctcagctgattcgagcaaaagtgccaattgtgaagttcagggataaagtcagttgtgtggagtttgacttgaatgtaaacaatattgttggaataagaaacacattccttctcagaacttatgcataccttgaaaatcgagttcgtccgttagtgctggtgattaagaagtgggcaagtcaccatcagataaatgatgccagtcgtggtactttaagcagctatagtcttgtattgatggttttgcactatttacaaaccctacctgaacccatccttccatccctccaaaaaatttacccagagtcttttagtcctgctatacagctgcaccttgtacatcaagctccatgtaatgttcctccttacctctcaaagaatgaatcaaaccttggggacctcttactgggctttcttaaatattatgctacagaatttgactggaatagtcaaatgatttcagttcgtgaagccaaagccattccaaggcctgatggtattgaatggagaaataaatacatctgtgtagaagaaccttttgatggaacaaatacagccagagcagtgcacgaaaagcagaaatttgatatgatcaaggatcaatttttaaagtcatggcacagattgaaaaacaagagagatttgaacagtatactacctgtaagagctgctgtcctgaaaagataactggcctctatttcttaataaattcttccaagaaataaagaacaatagtttcatcataatacattatgtttacctccatcatagttgcttttttcatagttcttgttttcatgttttatttttaaaaagacatataaagattgcatattttattatgacatttcctaataaacccctttgatttaaaaatgtatttttaaaaatgtttacattgatgatgagtaatattgcatgtgttttcaggtgatcagataaaatatattttgggaaattaactgaacaaataaaaagtttttgatataacttcaattaattgtaccacatgctaatcctgaagagatgtgtagaattttggaaagggtctaattcatacatgcttaaagtataacctacgttagatagtttgttgtcaaagtctgttctagtaaagtgaagattcaagtcagttgttcagttacttgaagcaaaacgaaatctttcatttcagtcaaatcactgcagtcatgaaatactgaacaattgccttaagtctttgcttgactcactgggatagactgaggctttgggtgtgtctgtattagcatttcattagtacttcacatgcttttgatgtactcttgagattgctttaaattttgtattgaaacaacaatacattttgcactgtagtaatgggagcactaactcttacaacagttagtgaatcgttttaaagaatcagttcagtgtagacattttgaaaagattgtttcctgtgctttacgatagcttagtgcaatgtgcacttctgttttacttgccattttcctgctctgttttctctgtgacatgaagcaacagaaactgagatcaaagttaagattatatcctgtttgtagtatcagatatttttctgtgtacaattataggattgtaatctaaactggaatttttaggcagtaagtcaccacaaaatgttttagataagacacaataaaattattataaataaaagcttaatgtttgtaaaaaatctcttttttagtatttcttttttcacatgaaagaagtggtggctgctaaaaaaaaagctacagtgtttattaagggtctttttgatttatgtaaatatttgtaaattggtcagtgcctgtaaatttaaatataaaaagtaaccttgaaaacagttttaactttttcaaaagaactatgtccaacattttttagacctgctgtagtacagttttgtacctctaacgtattttttttttgcagaccaaatgctaaaacttttgcttttctttgacttgtaaaaggtgcacattttcattttcttccttaagttcaaatttttgtatgatgtcaaatgcaataaaatttatatatggacattgtt

SEQ ID NO: 21605 - DNA, 2204 bp, Homo sapiens
ctacgccgctttttcggcgactttttgctcttccgctttttgccaccgcccccaaccttctatatccttgcagcccctaccttttcttgtgttgctcctcccctggcagccgtgaggggggttagatctcagccggagccggagctgggcctagctgtcccacgggccaccactacctcctttggttcgggagaaagctacgaccaagtacgcccagctcgggccttagaacttctgaacgggcagtgcgggaccaaaagaggaagatagtcttgggacccttgcatggtgtttcaaagggtggtgaagaactaaggggctccagagcttgatatatttctgggaatttggaatatgctaaactagatttctgccctagactaaacatctggctgtggactcaatgtagaagaatacatgttcacttccagtgaacaagagcatgttcccaaactcaattttgggtcgcccacccttcactccaaatcatcaacaacataataacttctttaccctgtcacctactgtttattcacaccagcagcttatagatgcacaattcaactttcagaatgcagacttgtctagagctgtgtcattacagcagctgacatatggaaatgtcagtccaatacagacctcagcttccccattatttcgaggaaggaagagattaagcgatgaaaaaaaccttcctcttgacggtaaacggcaacgtttccattcaccccaccaagagccaactgtagttaaccagatagtgcctttatcaggtgaacgaagatactcaatgccaccattgtttcatacacattatgtaccagatatagtcagatgtgttccaccttttcgagaaattgcatttttagaacctagagaaatcacactgcctgaggccaaagataagttgagtcagcagatactggagttatttgaaacatgtcagcagcaaataagtgatttaaagaagaaagaactctgtcgaacacagctgcagagagaaattcagctgttatttccacaaagcagactttttttggttgggtcctctttaaatggatttggtacccggagcagtgatggtgatttatgcctagttgttaaggaagaaccatgtttttttcaggtaaatcagaagactgaagcacggcatatactcaccttagtccataaacacttctgtactagactttcgggctacattgagagacctcagctgattcgagcaaaagtgccaattgtgaagttcagggataaagtcagttgtgtggagtttgacttgaatgtaaacaatattgttggaataagaaacacattccttctcagaacttatgcataccttgaaaatcgagttcgtccgttagtgctggtgattaagaagtgggcaagtcaccatcagataaatgatgccagtcgtggtactttaagcagctatagtcttgtattgatggttttgcactatttacaaaccctacctgaacccatccttccatccctccaaaaaatttacccagagtcttttagtcctgctatacagctgcaccttgtacatcaagctccatgtaatgttcctccttacctctcaaagaatgaatcaaaccttggggacctcttactgggctttcttaaatattatgctacagaatttgactggaatagtcaaatgatttcagttcgtgaagccaaagccattccaaggcctgatggtattgaatggagaaataaatacatctgtgtagaagaaccttttgatggaacaaatacagccagagcagtgcacgaaaagcagaaatttgatatgatcaaggatcaatttttaaagtcatggcacagattgaaaaacaagagagatttgaacagtatactacctgtaagagctgctgtcctgaaaagataactggcctctatttcttaataaattcttccaagaaataaagaacaatagtttcatcataatacattatgtttacctccatcatagttgcttttttcatagttcttgttttcatgttttatttttaaaaagacatataaagattgcatattttattatgacatttcctaataaacccctttgatttaaaaatgtatttttaaaaatgtttacattgatgatgagtaatattgcatgtgttttcaggtgatcagataaaatatattttgggaaattaactgaacaaataaaaagtttttgatataacttc

SEQ ID NO: 21606 - DNA, 3523 bp, Homo sapiens
cgctccccgctgcctattctcatccggggtcacgtcggtcttccgggtgtctttgacagggttttctacgccgctttttcggcgactttttgctcttccgctttttgccaccgcccccaaccttctatatccttgcagcccctaccttttcttgtgttgctcctcccctggcagccgtgaggggggttagatctcagccggagccggagctgggcctagctgtcccacgggccaccactacctcctttggttcgggagaaagctacgaccaagtacgcccagctcgggccttagaacttctgaacgggcagtgcgggtaggccctgcttagcccttcccggaggacacctgtgagtttagggggtttcggagaggaacgcagcagtgtaggcccaggtcggcggcggggcacgggaaacttttccgaaacggtagcgttttgttttgcgtgggaggttccagcagtatctcttggttattccaaatttatgggcggcatctgggctgctgtacattttgaagaatcttaggaccgcttactttgcttactcgttttctattcctcgcgtactgcctcgtccaccactccaggaccaaaagaggaagatagtcttgggacccttgcatggtgtttcaaagggtggtgaagaactaaggtagaagaatacatgttcacttccagtgaacaagagcatgttcccaaactcaattttgggtcgcccacccttcactccaaatcatcaacaacataataacttctttaccctgtcacctactgtttattcacaccagcagcttatagatgcacaattcaactttcagaatgcagacttgtctagagctgtgtcattacagcagctgacatatggaaatgtcagtccaatacagacctcagcttccccattatttcgaggaaggaagagattaagcgatgaaaaaaaccttcctcttgacggtaaacggcaacgtttccattcaccccaccaagagccaactgtagttaaccagatagtgcctttatcaggtgaacgaagatactcaatgccaccattgtttcatacacattatgtaccagatatagtcagatgtgttccaccttttcgagaaattgcatttttagaacctagagaaatcacactgcctgaggccaaagataagttgagtcagcagatactggagttatttgaaacatgtcagcagcaaataagtgatttaaagaagaaagaactctgtcgaacacagctgcagagagaaattcagctgttatttccacaaagcagactttttttggttgggtcctctttaaatggatttggtacccggagcagtgatggtgatttatgcctagttgttaaggaagaaccatgtttttttcaggtaaatcagaagactgaagcacggcatatactcaccttagtccataaacacttctgtactagactttcgggctacattgagagacctcagctgattcgagcaaaagtgccaattgtgaagttcagggataaagtcagttgtgtggagtttgacttgaatgtaaacaatattgttggaataagaaacacattccttctcagaacttatgcataccttgaaaatcgagttcgtccgttagtgctggtgattaagaagtgggcaagtcaccatcagataaatgatgccagtcgtggtactttaagcagctatagtcttgtattgatggttttgcactatttacaaaccctacctgaacccatccttccatccctccaaaaaatttacccagagtcttttagtcctgctatacagctgcaccttgtacatcaagctccatgtaatgttcctccttacctctcaaagaatgaatcaaaccttggggacctcttactgggctttcttaaatattatgctacagaatttgactggaatagtcaaatgatttcagttcgtgaagccaaagccattccaaggcctgatggtattgaatggagaaataaatacatctgtgtagaagaaccttttgatggaacaaatacagccagagcagtgcacgaaaagcagaaatttgatatgatcaaggatcaatttttaaagtcatggcacagattgaaaaacaagagagatttgaacagtatactacctgtaagagctgctgtcctgaaaagataactggcctctatttcttaataaattcttccaagaaataaagaacaatagtttcatcataatacattatgtttacctccatcatagttgcttttttcatagttcttgttttcatgttttatttttaaaaagacatataaagattgcatattttattatgacatttcctaataaacccctttgatttaaaaatgtatttttaaaaatgtttacattgatgatgagtaatattgcatgtgttttcaggtgatcagataaaatatattttgggaaattaactgaacaaataaaaagtttttgatataacttcaattaattgtaccacatgctaatcctgaagagatgtgtagaattttggaaagggtctaattcatacatgcttaaagtataacctacgttagatagtttgttgtcaaagtctgttctagtaaagtgaagattcaagtcagttgttcagttacttgaagcaaaacgaaatctttcatttcagtcaaatcactgcagtcatgaaatactgaacaattgccttaagtctttgcttgactcactgggatagactgaggctttgggtgtgtctgtattagcatttcattagtacttcacatgcttttgatgtactcttgagattgctttaaattttgtattgaaacaacaatacattttgcactgtagtaatgggagcactaactcttacaacagttagtgaatcgttttaaagaatcagttcagtgtagacattttgaaaagattgtttcctgtgctttacgatagcttagtgcaatgtgcacttctgttttacttgccattttcctgctctgttttctctgtgacatgaagcaacagaaactgagatcaaagttaagattatatcctgtttgtagtatcagatatttttctgtgtacaattataggattgtaatctaaactggaatttttaggcagtaagtcaccacaaaatgttttagataagacacaataaaattattataaataaaagcttaatgtttgtaaaaaatctcttttttagtatttcttttttcacatgaaagaagtggtggctgctaaaaaaaaagctacagtgtttattaagggtctttttgatttatgtaaatatttgtaaattggtcagtgcctgtaaatttaaatataaaaagtaaccttgaaaacagttttaactttttcaaaagaactatgtccaacattttttagacctgctgtagtacagttttgtacctctaacgtattttttttttgcagaccaaatgctaaaacttttgcttttctttgacttgtaaaaggtgcacattttcattttcttccttaagttcaaatttttgtatgatgtcaaatgcaataaaatttatatatggacattgtt

SEQ ID NO: 21607 - DNA, 2103 bp, Homo sapiens
attggtgaggcaaggaggaggcggagtgactcggcggccattagctgtgtgtagttgcccgggactaggagcttaagtgaagaggtacgccttgttcggtggaaatcagccgtagccatgagtttctgccggggctagccctagagtacggagcaggcggacttttcggttccccgccccgccaggtggcggggcctactaggcctccgggcatccccggtctcaagtaggcctcatctgccggcaagggcgcccgaaacgcgggaggcgccatgtcgctggttgcttacgccagcagcgatgagagcgagccggatgaggctgagcccgagccggaggaagaggaggcggtggctcctacatctgggcccgctttagggggcttgttcgcttctctccctgcgcccaagggtccggccttgctgcctccgccccctcagatgctggcgccagcctttcccccgccgctgttgcttcccccacccaccggagaccccaggcttcagcctcctccccccttgcccttcggcctgggaggcttccccccacctccaggcgtgagcccggctgaagcggcgggagttggggagggactgggattggggttgccctcgccccgaggccctggcctcaatctgccccctccaattggcggtgccggtcccccgctggggcttcccaagccaaagaagaggaaagagcccgtgaagatcgcggcgccggagttgcataagggagattcagattctgaggaagatgaacccacaaagaagaaaactatccttcagggatccagtgaggggactggtttgtctgccttgcttccccaacctaaaaacctgactgtgaaagagactaacaggttgctcctgccccatgccttctcccgcaaaccctcggatggctcccctgatactaagccctccagactggcttctaagaccaagacttcctctcttgcccctgttgtgggcaccacaaccaccactccgtcgccctctgctatcaaggctgctgccaagagtgctgccctgcaggtgacaaagcagatcacgcaggaagaagacgacagtgatgaggaagtagcccccgaaaactttttctccctccctgaaaaggctgagccacctggagttgagccatacccttaccccatccccactgtccctgaagagctgcctccaggcacggaaccagagccggctttccaggacgatgcagccaatgccccccttgaattcaagatggcagcaggttcaagtggggccccttggatgcctaagcctggggacgactacagctacaatcagttttccacatatggcgatgccaatgccgctggtgcttattatcaggattattacagtggtggctactatcctgcacaggacccggccctggtccccccccaggaaattgccccagatgcctccttcatcgatgacgaagcatttaagcggctgcagggcaagaggaaccgagggagagaagaaatcaactttgtggagatcaaaggtgatgaccagctcagtggggcccagcaatggatgactaagtcattgacagaagagaaaaccatgaagtcattcagcaaaaagaaaggtgagcagccaacaggccagcagcggcggaaacaccagatcacatatcttattcatcaggccaaggagcgggagctggaactgaagaacacctggtcagagaacaagctcagccgccgtcagacccaagccaaatatggattctagggctctggaactgattgctcccaggatctcctgccagcccagctggcctggcccccagcttcacctctgggaccccagctgctctaagcccaggatctctttccccaaggacccagccctcgcctctgcgagaatgaacatatttgatagatttttcttaacaagttagaaaattcagctcctttctgtcctggagctagcaaagacttgtgtgatgcctccgaaggggctctgagttctggggtgggagttttgctctctgtcaggtgtgataaaatgttgaaccctccccaccaccacttttttttttttaaaccagggatgtctgttgaaataaaacattcagtctgacaaa

SEQ ID NO: 21608 - DNA, 1948 bp, Homo sapiens
ttgcccgggactaggagcttaagtgaagaggtacgccttgttcggtggaaatcagccgtagccatgagtttctgccggggctagccctagagtacggagcaggcggacttttcggttccccgccccgccaggtggcggggcctactaggcctccgggcatccccggtctcaagtaggcctcatctgccggcaagggcgcccgaaacgcgggaggcgccatgtcgctggttgcttacgccagcagcgatgagagcgagccggatgaggctgagcccgagccggaggaagaggaggcggtggctcctacatctgggcccgctttagggggcttgttcgcttctctccctgcgcccaagggtccggccttgctgcctccgccccctcagatgctggcgccagcctttcccccgccgctgttgcttcccccacccaccggagaccccaggcttcagcctcctccccccttgcccttcggcctgggaggcttccccccacctccaggcgtgagcccggctgaagcggcgggagttggggagggactgggattggggttgccctcgccccgaggccctggcctcaatctgccccctccaattggcggtgccggtcccccgctggggcttcccaagccaaagaagaggaaagagcccgtgaagatcgcggcgccggagttgcataagggagattcagattctgaggaagatgaacccacaaagaagaaaactatccttcagggatccagtgaggggactggtttgtctgccttgcttccccaacctaaaaacctgactgtgaaagagactaacaggttgctcctgccccatgccttctcccgcaaaccctcggatggctcccctgatactaagccctccagactggcttctaagaccaagacttcctctcttgcccctgttgtgggcaccacaaccaccactccgtcgccctctgctatcaaggctgctgccaagagtgctgccctgcaggtgacaaagcagatcacgcaggaagaagacgacagtgatgaggaagtagcccccgaaaactttttctccctccctgaaaaggctgagccacctggagttgagccatacccttaccccatccccactgtccctgaagagctgcctccaggcacggaaccagagccggctttccaggacgatgcagccaatgccccccttgaattcaagatggcagcaggttcaagtggggccccttggatgcctaagcctggggacgactacagctacaatcagttttccacatatggcgatgccaatgccgctggtgcttattatcagtttaagcggctgcagggcaagaggaaccgagggagagaagaaatcaactttgtggagatcaaaggtgatgaccagctcagtggggcccagcaatggatgactaagtcattgacagaagagaaaaccatgaagtcattcagcaaaaagaaaggtgagcagccaacaggccagcagcggcggaaacaccagatcacatatcttattcatcaggccaaggagcgggagctggaactgaagaacacctggtcagagaacaagctcagccgccgtcagacccaagccaaatatggattctagggctctggaactgattgctcccaggatctcctgccagcccagctggcctggcccccagcttcacctctgggaccccagctgctctaagcccaggatctctttccccaaggacccagccctcgcctctgcgagaatgaacatatttgatagatttttcttaacaagttagaaaattcagctcctttctgtcctggagctagcaaagacttgtgtgatgcctccgaaggggctctgagttctggggtgggagttttgctctctgtcaggtgtgataaaatgttgaaccctccccaccaccacttttttttttttaaaccagggatgtctgttgaaataaaacattcagtctg

SEQ ID NO: 21609 - DNA, 2140 bp, Homo sapiens
ttgcccgggactaggagcttaagtgaagaggtacgccttgttcggtggaaatcagccgtagccatgagtttctgccggggctagccctagagtacggagcaggcggacttttcggttccccgccccgccaggtggcggggcctactaggcctccgggcatccccggtctcaagtaggcctcatctgccggcaagggcgcccgaaacgcgggaggcgccatgtcgctggttgcttacgccagcagcgatgagagcgagccggatgaggctgagcccgagccggaggaagaggaggcggtggctcctacatctgggcccgctttagggggcttgttcgcttctctccctgcgcccaagggtccggccttgctgcctccgccccctcagatgctggcgccagcctttcccccgccgctgttgcttcccccacccaccggagaccccaggcttcagcctcctccccccttgcccttcggcctgggaggcttccccccacctccaggcgtgagcccggctgaagcggcgggagttggggagggactgggattggggttgccctcgccccgaggccctggcctcaatctgccccctccaattggcggtgccggtcccccgctggggcttcccaagccaaagaagaggaaagagcccgtgaagatcgcggcgccggagttgcataagggagattcagattctgaggaagatgaacccacaaagaagaaaactatccttcagggatccagtgaggggactggtttgtctgccttgcttccccaacctaaaaacctgactgtgaaagagactaacaggttgctcctgccccatgccttctcccgcaaaccctcggatggctcccctgatactaagccctccagactggcttctaagaccaagacttcctctcttgcccctgttgtgggcaccacaaccaccactccgtcgccctctgctatcaaggctgctgccaagagtgctgccctgcaggtgacaaagcagatcacgcaggaagaagacgacagtgatgaggaagtagcccccgaaaactttttctccctccctgaaaaggctgagccacctggagttgagccatacccttaccccatccccactgtccctgaagagctgcctccaggcacggaaccagagccggctttccaggacgatgcagccaatgccccccttgaattcaagatggcagcaggttcaagtggggccccttggatgcctaagcctggggacgactacagctacaatcagttttccacatatggcgatgccaatgccgctggtgcttattatcagggtctgcagcaacatctgggccactcgcctctaaggggaatcatgagattcctgaactcaaaatctggtaaacgaacctgctttgttcccagctttgattattacagtggtggctactatcctgcacaggacccggccctggtccccccccaggaaattgccccagatgcctccttcatcgatgacgaagcatttaagcggctgcagggcaagaggaaccgagggagagaagaaatcaactttgtggagatcaaaggtgatgaccagctcagtggggcccagcaatggatgactaagtcattgacagaagagaaaaccatgaagtcattcagcaaaaagaaaggtgagcagccaacaggccagcagcggcggaaacaccagatcacatatcttattcatcaggccaaggagcgggagctggaactgaagaacacctggtcagagaacaagctcagccgccgtcagacccaagccaaatatggattctagggctctggaactgattgctcccaggatctcctgccagcccagctggcctggcccccagcttcacctctgggaccccagctgctctaagcccaggatctctttccccaaggacccagccctcgcctctgcgagaatgaacatatttgatagatttttcttaacaagttagaaaattcagctcctttctgtcctggagctagcaaagacttgtgtgatgcctccgaaggggctctgagttctggggtgggagttttgctctctgtcaggtgtgataaaatgttgaaccctccccaccaccacttttttttttttaaaccagggatgtctgttgaaataaaacattcagtctg

SEQ ID NO: 21610 - DNA, 3518 bp, Homo sapiens
cccagcggccccgagcgagcgccagcgccacacagccccgggcagccgccggcgagcgcgccgcgacgccgaacaggtggccggaggctgcgggcgccgcggcggggagaggcgaggcaagccccgggcgaagcgaggcgaggcgagggcggccgggccgggcatgcgagctgagcggccccccggcgtcgccgccgcctgcccgcgcccctagccgcccgcgcgcccgagtccccagcggctcctccgcgcccagcgtcctcggtcccggcctcggctgctccggctgcgctcggcgaggggcgcgggcccgcccgcggcggcggcggcatgaaagtgaccgtgtgcttcggacggacccgggtggtcgtgccgtgcggggacggccacatgaaagttttcagcctcatccagcaggcggtgacccgctaccggaaggccatcgccaaggatccaaactactggatacaggtgcatcgcttggaacatggagatggaggaatactagaccttgatgacattctttgtgatgtagcagacgataaagacagactggtagcagtgtttgatgagcaggatccacatcacggaggtgatggcaccagtgccagttccacgggtacccagagcccagagatatttggtagtgagcttggcaccaacaatgtctcagcctttcagccttaccaagcaacaagtgaaattgaggtcacaccttcagtccttcgagcaaatatgcctcttcatgttcgacgcagtagtgacccagctctaattggcctctccacttctgtcagtgatagtaatttttcctctgaagagccttcaaggaaaaatcccacacgctggtcaacaacagctggcttcctcaagcagaacactgctgggagtcctaaaacctgcgacaggaagaaagatgaaaactacagaagcctcccgcgggatactagtaactggtctaaccaatttcagagagacaatgctcgctcgtctctgagtgccagtcacccaatggtgggcaagtggctggagaaacaagaacaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaatgcagagccaagccagatgcagattccaaaagaaacgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagagtatgtcagaaaaacgcacaaagcaattttcagatgccagtcaattggatttcgttaaaacacgaaaatcaaaaagcatggatttaggtatagctgacgagactaaactcaatacagtggatgaccagaaagcaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcagccttgccaaactgaagcccgagaagagatgaacaacaaagcgattcaaaacatgtcttgaacagcacatattgcacagttgttgttttttttaaacaaacaataaatttacttttaatgaatt

SEQ ID NO: 21611 - DNA, 5894 bp, Homo sapiens
gcggccccgagcgagcgccagcgccacacagccccgggcagccgccggcgagcgcgccgcgacgccgaacaggtggccggaggctgcgggcgccgcggcggggagaggcgaggcaagccccgggcgaagcgaggcgaggcgagggcggccgggccgggcatgcgagctgagcggccccccggcgtcgccgccgcctgcccgcgcccctagccgcccgcgcgcccgagtccccagcggctcctccgcgcccagcgtcctcggtcccggcctcggctgctccggctgcgctcggcgaggggcgcgggcccgcccgcggcggcggcggcatgaaagtgaccgtgtgcttcggacggacccgggtggtcgtgccgtgcggggacggccacatgaaagttttcagcctcatccagcaggcggtgacccgctaccggaaggccatcgccaaggatccaaactactggatacaggtgcatcgcttggaacatggagatggaggaatactagaccttgatgacattctttgtgatgtagcagacgataaagacagactggtagcagtgtttgatgagcaggatccacatcacggaggtgatggcaccagtgccagttccacgggtacccagagcccagagatatttggtagtgagcttggcaccaacaatgtctcagcctttcagccttaccaagcaacaagtgaaattgaggtcacaccttcagtccttcgagcaaatatgcctcttcatgttcgacgcagtagtgacccagctctaattggcctctccacttctgtcagtgatagtaatttttcctctgaagagccttcaaggaaaaatcccacacgctggtcaacaacagctggcttcctcaagcagaacactgctgggagtcctaaaacctgcgacaggaagaaagatgaaaactacagaagcctcccgcgggatactagtaactggtctaaccaatttcagagagacaatgctcgctcgtctctgagtgccagtcacccaatggtgggcaagtggctggagaaacaagaacaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaatgcagagccaagccagatgcagattccaaaagaaacgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtgagtcaggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagagtatgtcagaaaaacgcacaaagcaattttcagatgccagtcaattggatttcgttaaaacacgaaaatcaaaaagcatggatttaggtatagctgacgagactaaactcaatacagtggatgaccagaaagcaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcaggattcaagccaaaactcgagaatttagggaacgacaagctcgagagcgtgactatgctgaaattcaagattttcatcggacatttggctgtgatgatgagttaatgtatgggggagtttcttcttatgaaggttccatggctctcaacgctagacctcagagcccacgagaagggcatatgatggatgctttgtatgcccaagtcaagaagccgcggaattccaaaccctcacctgtagacagtaacagatcaactcctagcaatcatgatcggatacagcgtctgaggcaagaatttcagcaagcaaagcaagatgaagatgtagaagatcgtcggcggacctatagttttgagcaaccctggccgaacgcacggccggcgacgcagagcgggcgacactcggtgtccgtggaggtgcagatgcagcggcagcggcaggaggagcgcgagagctcccagcaggcccagcgccagtacagctctctgcctcggcaaagcaggaaaaatgccagctcggtctcccaggactcttgggagcagaactactcccctggggaaggcttccagagtgccaaagagaaccccaggtactccagctaccaaggctccaggaacggctacctgggaggacatggcttcaacgccagggtcatgctggaaactcaggagctccttcgccaggaacagaggcggaaggagcagcagatgaagaagcagcctccttccgaggggcccagcaactatgactcgtataagaaagtccaggaccccagttacgcccctcccaaggggcccttccggcaagatgtgcccccctccccttctcaggttgcgaggctgaacagacttcagactcctgagaaagggaggcccttctattcctgagcacgcaaataacggatgcttcatgtcgcgcaataaaagacattttcctatgaagacttgtattttgggagtttttttaaaacctcgatggtactatggagtatttctgttgttggtatcagtgcctttaagcggtgtaggcaaagaaatggaaggccttaatgtctttgccactatgtctcaagtgtctgtttcatggaaggatttcccaccctgtgacaatcatctgtttgaggtgttcatatgctctgcgcctctccacagtaccaggaatctcggccctactcatgagttgtccgcggcttggttgtaacatccctgcaccacttgcagtgacaaattcacctgaagtggaggatgacgtgcggccctgtttctccctctaagttctcttagctatgggatgacatcttagtctctggtggaggaaaagtgggcgacatacaccaaaaattggggctttctggtacttcacagcacagccatttgtcgtactttgtcatcactgtggttttctctttcctttctcagctctttgtgacgggagagtcggtcatcctattacagaagctaagccatagtccaacattgtttggtcaccatgggggtccttttgtaactgccttatgactcaacattaccaataaagtgatgatcctggtctgcgtttatacatacgcttgttcggtcctgttcctgacacgtgggttgagtcaccacagctctgtgtggggaacgtgggagacaggagtggctcctgccgggggaagctgggcctgccattggccctgtgtctatcatgaggggagagctaagaaagaaattctcctaggaagagctcatggcccagtacatcctagtaattattttaattagtttttgttctgacagcttgtcaggaagggcacagaatgggacagagataaaccagacagtcattttgatctgctctctacggtttttcaagtcagaggcaattgatgcttgtctaatgcatccacacactgcatgtctgactggcgatgccgcgctcctaagtagttctgccatgaaacataaaagacaaaggaaaagccgttacacatcacacagagaacattttcgggtcccacagcggtggtggcaggaagctcactctcgcgtcagtattagagtgtgtgtgtgggtctcggggatctcggtggctcccatcttccttcattgttctgaacatcctgtattgtaaaccatggctggggtgctaaagtgcctgtgaatcccgatgtggaaaaagctggaggtgaaagctcagcataccatgtatttactttaaaaacagaaaaaaagacatgtatggatatgtctattttttttttattggcacattgtatttttgtgttgacttgtttttagaaatgatgtgtccacacacgtacccgtgtctcttctgcatttctgtgtcatggttctgtttcttaatcacgtgcggcggtgtctaagtggtgttaccagtgtacgcgcagtgaccttggatgacagtggctctttctcacagcctcccctgagctgtgagaaacagctttctctgtacatatgcaactcctaataaaaggcatatttcttcctgtt

SEQ ID NO: 21612 - DNA, 5867 bp, Homo sapiens
gcggccccgagcgagcgccagcgccacacagccccgggcagccgccggcgagcgcgccgcgacgccgaacaggtggccggaggctgcgggcgccgcggcggggagaggcgaggcaagccccgggcgaagcgaggcgaggcgagggcggccgggccgggcatgcgagctgagcggccccccggcgtcgccgccgcctgcccgcgcccctagccgcccgcgcgcccgagtccccagcggctcctccgcgcccagcgtcctcggtcccggcctcggctgctccggctgcgctcggcgaggggcgcgggcccgcccgcggcggcggcggcatgaaagtgaccgtgtgcttcggacggacccgggtggtcgtgccgtgcggggacggccacatgaaagttttcagcctcatccagcaggcggtgacccgctaccggaaggccatcgccaaggatccaaactactggatacaggtgcatcgcttggaacatggagatggaggaatactagaccttgatgacattctttgtgatgtagcagacgataaagacagactggtagcagtgtttgatgagcaggatccacatcacggaggtgatggcaccagtgccagttccacgggtacccagagcccagagatatttggtagtgagcttggcaccaacaatgtctcagcctttcagccttaccaagcaacaagtgaaattgaggtcacaccttcagtccttcgagcaaatatgcctcttcatgttcgacgcagtagtgacccagctctaattggcctctccacttctgtcagtgatagtaatttttcctctgaagagccttcaaggaaaaatcccacacgctggtcaacaacagctggcttcctcaagcagaacactgctgggagtcctaaaacctgcgacaggaagaaagatgaaaactacagaagcctcccgcgggatactagtaactggtctaaccaatttcagagagacaatgctcgctcgtctctgagtgccagtcacccaatggtgggcaagtggctggagaaacaagaacaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagatagctgacgagactaaactcaatacagtggatgaccagaaagcaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcaggtttggcaaacatcgaaaagatgacaagattgagaaaacgggtaaaataaaaatacaggaatcctttacatcagaagaggagaggatacgaatgaagcaggagcaggagaggattcaagccaaaactcgagaatttagggaacgacaagctcgagagcgtgactatgctgaaattcaagattttcatcggacatttggctgtgatgatgagttaatgtatgggggagtttcttcttatgaaggttccatggctctcaacgctagacctcagagcccacgagaagggcatatgatggatgctttgtatgcccaagtcaagaagccgcggaattccaaaccctcacctgtagacagtaacagatcaactcctagcaatcatgatcggatacagcgtctgaggcaagaatttcagcaagcaaagcaagatgaagatgtagaagatcgtcggcggacctatagttttgagcaaccctggccgaacgcacggccggcgacgcagagcgggcgacactcggtgtccgtggaggtgcagatgcagcggcagcggcaggaggagcgcgagagctcccagcaggcccagcgccagtacagctctctgcctcggcaaagcaggaaaaatgccagctcggtctcccaggactcttgggagcagaactactcccctggggaaggcttccagagtgccaaagagaaccccaggtactccagctaccaaggctccaggaacggctacctgggaggacatggcttcaacgccagggtcatgctggaaactcaggagctccttcgccaggaacagaggcggaaggagcagcagatgaagaagcagcctccttccgaggggcccagcaactatgactcgtataagaaagtccaggaccccagttacgcccctcccaaggggcccttccggcaagatgtgcccccctccccttctcaggttgcgaggctgaacagacttcagactcctgagaaagggaggcccttctattcctgagcacgcaaataacggatgcttcatgtcgcgcaataaaagacattttcctatgaagacttgtattttgggagtttttttaaaacctcgatggtactatggagtatttctgttgttggtatcagtgcctttaagcggtgtaggcaaagaaatggaaggccttaatgtctttgccactatgtctcaagtgtctgtttcatggaaggatttcccaccctgtgacaatcatctgtttgaggtgttcatatgctctgcgcctctccacagtaccaggaatctcggccctactcatgagttgtccgcggcttggttgtaacatccctgcaccacttgcagtgacaaattcacctgaagtggaggatgacgtgcggccctgtttctccctctaagttctcttagctatgggatgacatcttagtctctggtggaggaaaagtgggcgacatacaccaaaaattggggctttctggtacttcacagcacagccatttgtcgtactttgtcatcactgtggttttctctttcctttctcagctctttgtgacgggagagtcggtcatcctattacagaagctaagccatagtccaacattgtttggtcaccatgggggtccttttgtaactgccttatgactcaacattaccaataaagtgatgatcctggtctgcgtttatacatacgcttgttcggtcctgttcctgacacgtgggttgagtcaccacagctctgtgtggggaacgtgggagacaggagtggctcctgccgggggaagctgggcctgccattggccctgtgtctatcatgaggggagagctaagaaagaaattctcctaggaagagctcatggcccagtacatcctagtaattattttaattagtttttgttctgacagcttgtcaggaagggcacagaatgggacagagataaaccagacagtcattttgatctgctctctacggtttttcaagtcagaggcaattgatgcttgtctaatgcatccacacactgcatgtctgactggcgatgccgcgctcctaagtagttctgccatgaaacataaaagacaaaggaaaagccgttacacatcacacagagaacattttcgggtcccacagcggtggtggcaggaagctcactctcgcgtcagtattagagtgtgtgtgtgggtctcggggatctcggtggctcccatcttccttcattgttctgaacatcctgtattgtaaaccatggctggggtgctaaagtgcctgtgaatcccgatgtggaaaaagctggaggtgaaagctcagcataccatgtatttactttaaaaacagaaaaaaagacatgtatggatatgtctattttttttttattggcacattgtatttttgtgttgacttgtttttagaaatgatgtgtccacacacgtacccgtgtctcttctgcatttctgtgtcatggttctgtttcttaatcacgtgcggcggtgtctaagtggtgttaccagtgtacgcgcagtgaccttggatgacagtggctctttctcacagcctcccctgagctgtgagaaacagctttctctgtacatatgcaactcctaataaaaggcatatttcttcctgtt

SEQ ID NO: 21613 - DNA, 799 bp, Homo sapiens
gcagagccaagccagatgcagattccaaaagaaacgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggaacataggacttgccatactgaatcagaccattggtccaccagttcctgtaacctgcgtcctgcctccaatccctgatgcttcagaggaaggcgaaaaactaaaactaaaactcaaaccaaaaaaatccctaaattcagctagtgaccttttgaaatgctgtatatatgagttgaagagtcattcattttcttcctagtctgttgccccgattttgttagctacagcttcattagtcctcttcggtttgca

SEQ ID NO: 21614 - DNA, 3420 bp, Homo sapiens
gcggccccgagcgagcgccagcgccacacagccccgggcagccgccggcgagcgcgccgcgacgccgaacaggtggccggaggctgcgggcgccgcggcggggagaggcgaggcaagccccgggcgaagcgaggcgaggcgagggcggccgggccgggcatgcgagctgagcggccccccggcgtcgccgccgcctgcccgcgcccctagccgcccgcgcgcccgagtccccagcggctcctccgcgcccagcgtcctcggtcccggcctcggctgctccggctgcgctcggcgaggggcgcgggcccgcccgcggcggcggcggcatgaaagtgaccgtgtgcttcggacggacccgggtggtcgtgccgtgcggggacggccacatgaaagttttcagcctcatccagcaggcggtgacccgctaccggaaggccatcgccaaggatccaaactactggatacaggtgcatcgcttggaacatggagatggaggaatactagaccttgatgacattctttgtgatgtagcagacgataaagacagactggtagcagtgtttgatgagcaggatccacatcacggaggtgatggcaccagtgccagttccacgggtacccagagcccagagatatttggtagtgagcttggcaccaacaatgtctcagcctttcagccttaccaagcaacaagtgaaattgaggtcacaccttcagtccttcgagcaaatatgcctcttcatgttcgacgcagtagtgacccagctctaattggcctctccacttctgtcagtgatagtaatttttcctctgaagagccttcaaggaaaaatcccacacgctggtcaacaacagctggcttcctcaagcagaacactgctgggagtcctaaaacctgcgacaggaagaaagatgaaaactacagaagcctcccgcgggatactagtaactggtctaaccaatttcagagagacaatgctcgctcgtctctgagtgccagtcacccaatggtgggcaagtggctggagaaacaagaacaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaatgcagagccaagccagatgcagattccaaaagaaacgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagatagctgacgagactaaactcaatacagtggatgaccagaaagcaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcagccttgccaaactgaagcccgagaagagatgaacaacaaagcgattcaaaacatgtcttgaacagcacatattgcacagttgttgttttttttaaacaaacaataaatttacttttaatg

SEQ ID NO: 21615 - DNA, 3389 bp, Homo sapiens
gcggccccgagcgagcgccagcgccacacagccccgggcagccgccggcgagcgcgccgcgacgccgaacaggtggccggaggctgcgggcgccgcggcggggagaggcgaggcaagccccgggcgaagcgaggcgaggcgagggcggccgggccgggcatgcgagctgagcggccccccggcgtcgccgccgcctgcccgcgcccctagccgcccgcgcgcccgagtccccagcggctcctccgcgcccagcgtcctcggtcccggcctcggctgctccggctgcgctcggcgaggggcgcgggcccgcccgcggcggcggcggcatgaaagtgaccgtgtgcttcggacggacccgggtggtcgtgccgtgcggggacggccacatgaaagttttcagcctcatccagcaggcggtgacccgctaccggaaggccatcgccaaggatccaaactactggatacaggtgcatcgcttggaacatggagatggaggaatactagaccttgatgacattctttgtgatgtagcagacgataaagacagactggtagcagtgtttgatgagcaggatccacatcacggaggtgatggcaccagtgccagttccacgggtacccagagcccagagatatttggtagtgagcttggcaccaacaatgtctcagcctttcagccttaccaagcaacaagtgaaattgaggtcacaccttcagtccttcgagcaaatatgcctcttcatgttcgacgcagtagtgacccagctctaattggcctctccacttctgtcagtgatagtaatttttcctctgaagagccttcaaggaaaaatcccacacgctggtcaacaacagctggcttcctcaagcagaacactgctgggagtcctaaaacctgcgacaggaagaaagatgaaaactacagaagcctcccgcgggatactagtaactggtctaaccaatttcagagagacaatgctcgctcgtctctgagtgccagtcacccaatggtgggcaagtggctggagaaacaagaacaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagatagctgacgagactaaactcaatacagtggatgaccagaaagcaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcagccttgccaaactgaagcccgagaagagatgaacaacaaagcgattcaaaacatgtcttgaacagcacatattgcacagttgttgttttttttaaacaaacaataaatttacttttaatgaattctta

SEQ ID NO: 21616 - DNA, 5996 bp, Homo sapiens
gcggccccgagcgagcgccagcgccacacagccccgggcagccgccggcgagcgcgccgcgacgccgaacaggtggccggaggctgcgggcgccgcggcggggagaggcgaggcaagccccgggcgaagcgaggcgaggcgagggcggccgggccgggcatgcgagctgagcggccccccggcgtcgccgccgcctgcccgcgcccctagccgcccgcgcgcccgagtccccagcggctcctccgcgcccagcgtcctcggtcccggcctcggctgctccggctgcgctcggcgaggggcgcgggcccgcccgcggcggcggcggcatgaaagtgaccgtgtgcttcggacggacccgggtggtcgtgccgtgcggggacggccacatgaaagttttcagcctcatccagcaggcggtgacccgctaccggaaggccatcgccaaggatccaaactactggatacaggtgcatcgcttggaacatggagatggaggaatactagaccttgatgacattctttgtgatgtagcagacgataaagacagactggtagcagtgtttgatgagcaggatccacatcacggaggtgatggcaccagtgccagttccacgggtacccagagcccagagatatttggtagtgagcttggcaccaacaatgtctcagcctttcagccttaccaagcaacaagtgaaattgaggtcacaccttcagtccttcgagcaaatatgcctcttcatgttcgacgcagtagtgacccagctctaattggcctctccacttctgtcagtgatagtaatttttcctctgaagagccttcaaggaaaaatcccacacgctggtcaacaacagctggcttcctcaagcagaacactgctgggagtcctaaaacctgcgacaggaagaaagatgaaaactacagaagcctcccgcgggatactagtaactggtctaaccaatttcagagagacaatgctcgctcgtctctgagtgccagtcacccaatggtgggcaagtggctggagaaacaagaacaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaatgcagagccaagccagatgcagattccaaaagaaacgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagagtatgtcagaaaaacgcacaaagcaattttcagatgccagtcaattggatttcgttaaaacacgaaaatcaaaaagcatggatttaggtatagctgacgagactaaactcaatacagtggatgaccagaaagcaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcaggtttggcaaacatcgaaaagatgacaagattgagaaaacgggtaaaataaaaatacaggaatcctttacatcagaagaggagaggatacgaatgaagcaggagcaggagaggattcaagccaaaactcgagaatttagggaacgacaagctcgagagcgtgactatgctgaaattcaagattttcatcggacatttggctgtgatgatgagttaatgtatgggggagtttcttcttatgaaggttccatggctctcaacgctagacctcagagcccacgagaagggcatatgatggatgctttgtatgcccaagtcaagaagccgcggaattccaaaccctcacctgtagacagtaacagatcaactcctagcaatcatgatcggatacagcgtctgaggcaagaatttcagcaagcaaagcaagatgaagatgtagaagatcgtcggcggacctatagttttgagcaaccctggccgaacgcacggccggcgacgcagagcgggcgacactcggtgtccgtggaggtgcagatgcagcggcagcggcaggaggagcgcgagagctcccagcaggcccagcgccagtacagctctctgcctcggcaaagcaggaaaaatgccagctcggtctcccaggactcttgggagcagaactactcccctggggaaggcttccagagtgccaaagagaaccccaggtactccagctaccaaggctccaggaacggctacctgggaggacatggcttcaacgccagggtcatgctggaaactcaggagctccttcgccaggaacagaggcggaaggagcagcagatgaagaagcagcctccttccgaggggcccagcaactatgactcgtataagaaagtccaggaccccagttacgcccctcccaaggggcccttccggcaagatgtgcccccctccccttctcaggttgcgaggctgaacagacttcagactcctgagaaagggaggcccttctattcctgagcacgcaaataacggatgcttcatgtcgcgcaataaaagacattttcctatgaagacttgtattttgggagtttttttaaaacctcgatggtactatggagtatttctgttgttggtatcagtgcctttaagcggtgtaggcaaagaaatggaaggccttaatgtctttgccactatgtctcaagtgtctgtttcatggaaggatttcccaccctgtgacaatcatctgtttgaggtgttcatatgctctgcgcctctccacagtaccaggaatctcggccctactcatgagttgtccgcggcttggttgtaacatccctgcaccacttgcagtgacaaattcacctgaagtggaggatgacgtgcggccctgtttctccctctaagttctcttagctatgggatgacatcttagtctctggtggaggaaaagtgggcgacatacaccaaaaattggggctttctggtacttcacagcacagccatttgtcgtactttgtcatcactgtggttttctctttcctttctcagctctttgtgacgggagagtcggtcatcctattacagaagctaagccatagtccaacattgtttggtcaccatgggggtccttttgtaactgccttatgactcaacattaccaataaagtgatgatcctggtctgcgtttatacatacgcttgttcggtcctgttcctgacacgtgggttgagtcaccacagctctgtgtggggaacgtgggagacaggagtggctcctgccgggggaagctgggcctgccattggccctgtgtctatcatgaggggagagctaagaaagaaattctcctaggaagagctcatggcccagtacatcctagtaattattttaattagtttttgttctgacagcttgtcaggaagggcacagaatgggacagagataaaccagacagtcattttgatctgctctctacggtttttcaagtcagaggcaattgatgcttgtctaatgcatccacacactgcatgtctgactggcgatgccgcgctcctaagtagttctgccatgaaacataaaagacaaaggaaaagccgttacacatcacacagagaacattttcgggtcccacagcggtggtggcaggaagctcactctcgcgtcagtattagagtgtgtgtgtgggtctcggggatctcggtggctcccatcttccttcattgttctgaacatcctgtattgtaaaccatggctggggtgctaaagtgcctgtgaatcccgatgtggaaaaagctggaggtgaaagctcagcataccatgtatttactttaaaaacagaaaaaaagacatgtatggatatgtctattttttttttattggcacattgtatttttgtgttgacttgtttttagaaatgatgtgtccacacacgtacccgtgtctcttctgcatttctgtgtcatggttctgtttcttaatcacgtgcggcggtgtctaagtggtgttaccagtgtacgcgcagtgaccttggatgacagtggctctttctcacagcctcccctgagctgtgagaaacagctttctctgtacatatgcaactcctaataaaaggcatatttcttcctgtt

SEQ ID NO: 21617 - DNA, 6005 bp, Homo sapiens
gcggccccgagcgagcgccagcgccacacagccccgggcagccgccggcgagcgcgccgcgacgccgaacaggtggccggaggctgcgggcgccgcggcggggagaggcgaggcaagccccgggcgaagcgaggcgaggcgagggcggccgggccgggcatgcgagctgagcggccccccggcgtcgccgccgcctgcccgcgcccctagccgcccgcgcgcccgagtccccagcggctcctccgcgcccagcgtcctcggtcccggcctcggctgctccggctgcgctcggcgaggggcgcgggcccgcccgcggcggcggcggcatgaaagtgaccgtgtgcttcggacggacccgggtggtcgtgccgtgcggggacggccacatgaaagttttcagcctcatccagcaggcggtgacccgctaccggaaggccatcgccaaggatccaaactactggatacaggtgcatcgcttggaacatggagatggaggaatactagaccttgatgacattctttgtgatgtagcagacgataaagacagactggtagcagtgtttgatgagcaggatccacatcacggaggtgatggcaccagtgccagttccacgggtacccagagcccagagatatttggtagtgagcttggcaccaacaatgtctcagcctttcagccttaccaagcaacaagtgaaattgaggtcacaccttcagtccttcgagcaaatatgcctcttcatgttcgacgcagtagtgacccagctctaattggcctctccacttctgtcagtgatagtaatttttcctctgaagagccttcaaggaaaaatcccacacgctggtcaacaacagctggcttcctcaagcagaacactgctgggagtcctaaaacctgcgacaggaagaaagatgaaaactacagaagcctcccgcgggatactagtaactggtctaaccaatttcagagagacaatgctcgctcgtctctgagtgccagtcacccaatggtgggcaagtggctggagaaacaagaacaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaatgcagagccaagccagatgcagattccaaaagaaacgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtgagtcaggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagagtatgtcagaaaaacgcacaaagcaattttcagatgccagtcaattggatttcgttaaaacacgaaaatcaaaaagcatggatttaggtatagctgacgagactaaactcaatacagtggatgaccagaaagcaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcaggtttggcaaacatcgaaaagatgacaagattgagaaaacgggtaaaataaaaatacaggaatcctttacatcagaagaggagaggatacgaatgaagcaggagcaggagaggattcaagccaaaactcgagaatttagggaacgacaagctcgagagcgtgactatgctgaaattcaagattttcatcggacatttggctgtgatgatgagttaatgtatgggggagtttcttcttatgaaggttccatggctctcaacgctagacctcagagcccacgagaagggcatatgatggatgctttgtatgcccaagtcaagaagccgcggaattccaaaccctcacctgtagacagtaacagatcaactcctagcaatcatgatcggatacagcgtctgaggcaagaatttcagcaagcaaagcaagatgaagatgtagaagatcgtcggcggacctatagttttgagcaaccctggccgaacgcacggccggcgacgcagagcgggcgacactcggtgtccgtggaggtgcagatgcagcggcagcggcaggaggagcgcgagagctcccagcaggcccagcgccagtacagctctctgcctcggcaaagcaggaaaaatgccagctcggtctcccaggactcttgggagcagaactactcccctggggaaggcttccagagtgccaaagagaaccccaggtactccagctaccaaggctccaggaacggctacctgggaggacatggcttcaacgccagggtcatgctggaaactcaggagctccttcgccaggaacagaggcggaaggagcagcagatgaagaagcagcctccttccgaggggcccagcaactatgactcgtataagaaagtccaggaccccagttacgcccctcccaaggggcccttccggcaagatgtgcccccctccccttctcaggttgcgaggctgaacagacttcagactcctgagaaagggaggcccttctattcctgagcacgcaaataacggatgcttcatgtcgcgcaataaaagacattttcctatgaagacttgtattttgggagtttttttaaaacctcgatggtactatggagtatttctgttgttggtatcagtgcctttaagcggtgtaggcaaagaaatggaaggccttaatgtctttgccactatgtctcaagtgtctgtttcatggaaggatttcccaccctgtgacaatcatctgtttgaggtgttcatatgctctgcgcctctccacagtaccaggaatctcggccctactcatgagttgtccgcggcttggttgtaacatccctgcaccacttgcagtgacaaattcacctgaagtggaggatgacgtgcggccctgtttctccctctaagttctcttagctatgggatgacatcttagtctctggtggaggaaaagtgggcgacatacaccaaaaattggggctttctggtacttcacagcacagccatttgtcgtactttgtcatcactgtggttttctctttcctttctcagctctttgtgacgggagagtcggtcatcctattacagaagctaagccatagtccaacattgtttggtcaccatgggggtccttttgtaactgccttatgactcaacattaccaataaagtgatgatcctggtctgcgtttatacatacgcttgttcggtcctgttcctgacacgtgggttgagtcaccacagctctgtgtggggaacgtgggagacaggagtggctcctgccgggggaagctgggcctgccattggccctgtgtctatcatgaggggagagctaagaaagaaattctcctaggaagagctcatggcccagtacatcctagtaattattttaattagtttttgttctgacagcttgtcaggaagggcacagaatgggacagagataaaccagacagtcattttgatctgctctctacggtttttcaagtcagaggcaattgatgcttgtctaatgcatccacacactgcatgtctgactggcgatgccgcgctcctaagtagttctgccatgaaacataaaagacaaaggaaaagccgttacacatcacacagagaacattttcgggtcccacagcggtggtggcaggaagctcactctcgcgtcagtattagagtgtgtgtgtgggtctcggggatctcggtggctcccatcttccttcattgttctgaacatcctgtattgtaaaccatggctggggtgctaaagtgcctgtgaatcccgatgtggaaaaagctggaggtgaaagctcagcataccatgtatttactttaaaaacagaaaaaaagacatgtatggatatgtctattttttttttattggcacattgtatttttgtgttgacttgtttttagaaatgatgtgtccacacacgtacccgtgtctcttctgcatttctgtgtcatggttctgtttcttaatcacgtgcggcggtgtctaagtggtgttaccagtgtacgcgcagtgaccttggatgacagtggctctttctcacagcctcccctgagctgtgagaaacagctttctctgtacatatgcaactcctaataaaaggcatatttcttcctgtt

SEQ ID NO: 21618 - DNA, 5825 bp, Homo sapiens
gcggccccgagcgagcgccagcgccacacagccccgggcagccgccggcgagcgcgccgcgacgccgaacaggtggccggaggctgcgggcgccgcggcggggagaggcgaggcaagccccgggcgaagcgaggcgaggcgagggcggccgggccgggcatgcgagctgagcggccccccggcgtcgccgccgcctgcccgcgcccctagccgcccgcgcgcccgagtccccagcggctcctccgcgcccagcgtcctcggtcccggcctcggctgctccggctgcgctcggcgaggggcgcgggcccgcccgcggcggcggcggcatgaaagtgaccgtgtgcttcggacggacccgggtggtcgtgccgtgcggggacggccacatgaaagttttcagcctcatccagcaggcggtgacccgctaccggaaggccatcgccaaggatccaaactactggatacaggtgcatcgcttggaacatggagatggaggaatactagaccttgatgacattctttgtgatgtagcagacgataaagacagactggtagcagtgtttgatgagcaggatccacatcacggaggtgatggcaccagtgccagttccacgggtacccagagcccagagatatttggtagtgagcttggcaccaacaatgtctcagcctttcagccttaccaagcaacaagtgaaattgaggtcacaccttcagtccttcgagcaaatatgcctcttcatgttcgacgcagtagtgacccagctctaattggcctctccacttctgtcagtgatagtaatttttcctctgaagagccttcaaggaaaaatcccacacgctggtcaacaacagctggcttcctcaagcagaacactgctgggagtcctaaaacctgcgacaggaaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagagtatgtcagaaaaacgcacaaagcaattttcagatgccagtcaattggatttcgttaaaacacgaaaatcaaaaagcatggatttaggtatagctgacgagactaaactcaatacagtggatgaccagaaagcaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcaggtttggcaaacatcgaaaagatgacaagattgagaaaacgggtaaaataaaaatacaggaatcctttacatcagaagaggagaggatacgaatgaagcaggagcaggagaggattcaagccaaaactcgagaatttagggaacgacaagctcgagagcgtgactatgctgaaattcaagattttcatcggacatttggctgtgatgatgagttaatgtatgggggagtttcttcttatgaaggttccatggctctcaacgctagacctcagagcccacgagaagggcatatgatggatgctttgtatgcccaagtcaagaagccgcggaattccaaaccctcacctgtagacagtaacagatcaactcctagcaatcatgatcggatacagcgtctgaggcaagaatttcagcaagcaaagcaagatgaagatgtagaagatcgtcggcggacctatagttttgagcaaccctggccgaacgcacggccggcgacgcagagcgggcgacactcggtgtccgtggaggtgcagatgcagcggcagcggcaggaggagcgcgagagctcccagcaggcccagcgccagtacagctctctgcctcggcaaagcaggaaaaatgccagctcggtctcccaggactcttgggagcagaactactcccctggggaaggcttccagagtgccaaagagaaccccaggtactccagctaccaaggctccaggaacggctacctgggaggacatggcttcaacgccagggtcatgctggaaactcaggagctccttcgccaggaacagaggcggaaggagcagcagatgaagaagcagcctccttccgaggggcccagcaactatgactcgtataagaaagtccaggaccccagttacgcccctcccaaggggcccttccggcaagatgtgcccccctccccttctcaggttgcgaggctgaacagacttcagactcctgagaaagggaggcccttctattcctgagcacgcaaataacggatgcttcatgtcgcgcaataaaagacattttcctatgaagacttgtattttgggagtttttttaaaacctcgatggtactatggagtatttctgttgttggtatcagtgcctttaagcggtgtaggcaaagaaatggaaggccttaatgtctttgccactatgtctcaagtgtctgtttcatggaaggatttcccaccctgtgacaatcatctgtttgaggtgttcatatgctctgcgcctctccacagtaccaggaatctcggccctactcatgagttgtccgcggcttggttgtaacatccctgcaccacttgcagtgacaaattcacctgaagtggaggatgacgtgcggccctgtttctccctctaagttctcttagctatgggatgacatcttagtctctggtggaggaaaagtgggcgacatacaccaaaaattggggctttctggtacttcacagcacagccatttgtcgtactttgtcatcactgtggttttctctttcctttctcagctctttgtgacgggagagtcggtcatcctattacagaagctaagccatagtccaacattgtttggtcaccatgggggtccttttgtaactgccttatgactcaacattaccaataaagtgatgatcctggtctgcgtttatacatacgcttgttcggtcctgttcctgacacgtgggttgagtcaccacagctctgtgtggggaacgtgggagacaggagtggctcctgccgggggaagctgggcctgccattggccctgtgtctatcatgaggggagagctaagaaagaaattctcctaggaagagctcatggcccagtacatcctagtaattattttaattagtttttgttctgacagcttgtcaggaagggcacagaatgggacagagataaaccagacagtcattttgatctgctctctacggtttttcaagtcagaggcaattgatgcttgtctaatgcatccacacactgcatgtctgactggcgatgccgcgctcctaagtagttctgccatgaaacataaaagacaaaggaaaagccgttacacatcacacagagaacattttcgggtcccacagcggtggtggcaggaagctcactctcgcgtcagtattagagtgtgtgtgtgggtctcggggatctcggtggctcccatcttccttcattgttctgaacatcctgtattgtaaaccatggctggggtgctaaagtgcctgtgaatcccgatgtggaaaaagctggaggtgaaagctcagcataccatgtatttactttaaaaacagaaaaaaagacatgtatggatatgtctattttttttttattggcacattgtatttttgtgttgacttgtttttagaaatgatgtgtccacacacgtacccgtgtctcttctgcatttctgtgtcatggttctgtttcttaatcacgtgcggcggtgtctaagtggtgttaccagtgtacgcgcagtgaccttggatgacagtggctctttctcacagcctcccctgagctgtgagaaacagctttctctgtacatatgcaactcctaataaaaggcatatttcttcctgtt

SEQ ID NO: 21619 - DNA, 5669 bp, Homo sapiens
gcggccccgagcgagcgccagcgccacacagccccgggcagccgccggcgagcgcgccgcgacgccgaacaggtggccggaggctgcgggcgccgcggcggggagaggcgaggcaagccccgggcgaagcgaggcgaggcgagggcggccgggccgggcatgcgagctgagcggccccccggcgtcgccgccgcctgcccgcgcccctagccgcccgcgcgcccgagtccccagcggctcctccgcgcccagcgtcctcggtcccggcctcggctgctccggctgcgctcggcgaggggcgcgggcccgcccgcggcggcggcggcatgaaagtgaccgtgtgcttcggacggacccgggtggtcgtgccgtgcggggacggccacatgaaagttttcagcctcatccagcaggcggtgacccgctaccggaaggccatcgccaaggatccaaactactggatacaggtgcatcgcttggaacatggagatggaggaatactagaccttgatgacattctttgtgatgtagcagacgataaagacagactggtagcagtgtttgatgagcaggatccacatcacggaggtgatggcaccagtgccagttccacgggtacccagagcccagagatatttggtagtgagcttggcaccaacaatgtctcagcctttcagccttaccaagcaacaagtgaaattgaggtcacaccttcagtccttcgagcaaatatgcctcttcatgttcgacgcagtagtgacccagctctaattggcctctccacttctgtcagtgatagtaatttttcctctgaagagccttcaaggaaaaatcccacacgctggtcaacaacagctggcttcctcaagcagaacactgctgggagtcctaaaacctgcgacaggaaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagagtatgtcagaaaaacgcacaaagcaattttcagatgccagtcaattggatttcgttaaaacacgaaaatcaaaaagcatggatttaggtagttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcaggattcaagccaaaactcgagaatttagggaacgacaagctcgagagcgtgactatgctgaaattcaagattttcatcggacatttggctgtgatgatgagttaatgtatgggggagtttcttcttatgaaggttccatggctctcaacgctagacctcagagcccacgagaagggcatatgatggatgctttgtatgcccaagtcaagaagccgcggaattccaaaccctcacctgtagacagtaacagatcaactcctagcaatcatgatcggatacagcgtctgaggcaagaatttcagcaagcaaagcaagatgaagatgtagaagatcgtcggcggacctatagttttgagcaaccctggccgaacgcacggccggcgacgcagagcgggcgacactcggtgtccgtggaggtgcagatgcagcggcagcggcaggaggagcgcgagagctcccagcaggcccagcgccagtacagctctctgcctcggcaaagcaggaaaaatgccagctcggtctcccaggactcttgggagcagaactactcccctggggaaggcttccagagtgccaaagagaaccccaggtactccagctaccaaggctccaggaacggctacctgggaggacatggcttcaacgccagggtcatgctggaaactcaggagctccttcgccaggaacagaggcggaaggagcagcagatgaagaagcagcctccttccgaggggcccagcaactatgactcgtataagaaagtccaggaccccagttacgcccctcccaaggggcccttccggcaagatgtgcccccctccccttctcaggttgcgaggctgaacagacttcagactcctgagaaagggaggcccttctattcctgagcacgcaaataacggatgcttcatgtcgcgcaataaaagacattttcctatgaagacttgtattttgggagtttttttaaaacctcgatggtactatggagtatttctgttgttggtatcagtgcctttaagcggtgtaggcaaagaaatggaaggccttaatgtctttgccactatgtctcaagtgtctgtttcatggaaggatttcccaccctgtgacaatcatctgtttgaggtgttcatatgctctgcgcctctccacagtaccaggaatctcggccctactcatgagttgtccgcggcttggttgtaacatccctgcaccacttgcagtgacaaattcacctgaagtggaggatgacgtgcggccctgtttctccctctaagttctcttagctatgggatgacatcttagtctctggtggaggaaaagtgggcgacatacaccaaaaattggggctttctggtacttcacagcacagccatttgtcgtactttgtcatcactgtggttttctctttcctttctcagctctttgtgacgggagagtcggtcatcctattacagaagctaagccatagtccaacattgtttggtcaccatgggggtccttttgtaactgccttatgactcaacattaccaataaagtgatgatcctggtctgcgtttatacatacgcttgttcggtcctgttcctgacacgtgggttgagtcaccacagctctgtgtggggaacgtgggagacaggagtggctcctgccgggggaagctgggcctgccattggccctgtgtctatcatgaggggagagctaagaaagaaattctcctaggaagagctcatggcccagtacatcctagtaattattttaattagtttttgttctgacagcttgtcaggaagggcacagaatgggacagagataaaccagacagtcattttgatctgctctctacggtttttcaagtcagaggcaattgatgcttgtctaatgcatccacacactgcatgtctgactggcgatgccgcgctcctaagtagttctgccatgaaacataaaagacaaaggaaaagccgttacacatcacacagagaacattttcgggtcccacagcggtggtggcaggaagctcactctcgcgtcagtattagagtgtgtgtgtgggtctcggggatctcggtggctcccatcttccttcattgttctgaacatcctgtattgtaaaccatggctggggtgctaaagtgcctgtgaatcccgatgtggaaaaagctggaggtgaaagctcagcataccatgtatttactttaaaaacagaaaaaaagacatgtatggatatgtctattttttttttattggcacattgtatttttgtgttgacttgtttttagaaatgatgtgtccacacacgtacccgtgtctcttctgcatttctgtgtcatggttctgtttcttaatcacgtgcggcggtgtctaagtggtgttaccagtgtacgcgcagtgaccttggatgacagtggctctttctcacagcctcccctgagctgtgagaaacagctttctctgtacatatgcaactcctaataaaaggcatatttcttcctgtt

SEQ ID NO: 21620 - DNA, 2475 bp, Homo sapiens
cttttaactgtaacttattgaaggtctcctacatttttaacactgaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagagtatgtcagaaaaacgcacaaagcaattttcagatgccagtcaattggatttcgttaaaacacgaaaatcaaaaagcatggatttagtagctgacgagactaaactcaatacagtggatgaccagaaagcaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcagccttgccaaactgaagcccgagaagagatgaacaacaaagcgattcaaaacatgtcttgaacagcacatattgcacagttgttgttttttttaaacaaacaataaatttacttttaatg

SEQ ID NO: 21621 - DNA, 5740 bp, Homo sapiens
cccagcggccccgagcgagcgccagcgccacacagccccgggcagccgccggcgagcgcgccgcgacgccgaacaggtggccggaggctgcgggcgccgcggcggggagaggcgaggcaagccccgggcgaagcgaggcgaggcgagggcggccgggccgggcatgcgagctgagcggccccccggcgtcgccgccgcctgcccgcgcccctagccgcccgcgcgcccgagtccccagcggctcctccgcgcccagcgtcctcggtcccggcctcggctgctccggctgcgctcggcgaggggcgcgggcccgcccgcggcggcggcggcatgaaagtgaccgtgtgcttcggacggacccgggtggtcgtgccgtgcggggacggccacatgaaagttttcagcctcatccagcaggcggtgacccgctaccggaaggccatcgccaaggatccaaactactggatacaggtgcatcgcttggaacatggagatggaggaatactagaccttgatgacattctttgtgatgtagcagacgataaagacagactggtagcagtgtttgatgagcaggatccacatcacggaggtgatggcaccagtgccagttccacgggtacccagagcccagagatatttggtagtgagcttggcaccaacaatgtctcagcctttcagccttaccaagcaacaagtgaaattgaggtcacaccttcagtccttcgagcaaatatgcctcttcatgttcgacgcagtagtgacccagctctaattggcctctccacttctgtcagtgatagtaatttttcctctgaagagccttcaaggaaaaatcccacacgctggtcaacaacagctggcttcctcaagcagaacactgctgggagtcctaaaacctgcgacaggaaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagatagctgacgagactaaactcaatacagtggatgaccagaaagcaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcaggtttggcaaacatcgaaaagatgacaagattgagaaaacgggtaaaataaaaatacaggaatcctttacatcagaagaggagaggatacgaatgaagcaggagcaggagaggattcaagccaaaactcgagaatttagggaacgacaagctcgagagcgtgactatgctgaaattcaagattttcatcggacatttggctgtgatgatgagttaatgtatgggggagtttcttcttatgaaggttccatggctctcaacgctagacctcagagcccacgagaagggcatatgatggatgctttgtatgcccaagtcaagaagccgcggaattccaaaccctcacctgtagacagtaacagatcaactcctagcaatcatgatcggatacagcgtctgaggcaagaatttcagcaagcaaagcaagatgaagatgtagaagatcgtcggcggacctatagttttgagcaaccctggccgaacgcacggccggcgacgcagagcgggcgacactcggtgtccgtggaggtgcagatgcagcggcagcggcaggaggagcgcgagagctcccagcaggcccagcgccagtacagctctctgcctcggcaaagcaggaaaaatgccagctcggtctcccaggactcttgggagcagaactactcccctggggaaggcttccagagtgccaaagagaaccccaggtactccagctaccaaggctccaggaacggctacctgggaggacatggcttcaacgccagggtcatgctggaaactcaggagctccttcgccaggaacagaggcggaaggagcagcagatgaagaagcagcctccttccgaggggcccagcaactatgactcgtataagaaagtccaggaccccagttacgcccctcccaaggggcccttccggcaagatgtgcccccctccccttctcaggttgcgaggctgaacagacttcagactcctgagaaagggaggcccttctattcctgagcacgcaaataacggatgcttcatgtcgcgcaataaaagacattttcctatgaagacttgtattttgggagtttttttaaaacctcgatggtactatggagtatttctgttgttggtatcagtgcctttaagcggtgtaggcaaagaaatggaaggccttaatgtctttgccactatgtctcaagtgtctgtttcatggaaggatttcccaccctgtgacaatcatctgtttgaggtgttcatatgctctgcgcctctccacagtaccaggaatctcggccctactcatgagttgtccgcggcttggttgtaacatccctgcaccacttgcagtgacaaattcacctgaagtggaggatgacgtgcggccctgtttctccctctaagttctcttagctatgggatgacatcttagtctctggtggaggaaaagtgggcgacatacaccaaaaattggggctttctggtacttcacagcacagccatttgtcgtactttgtcatcactgtggttttctctttcctttctcagctctttgtgacgggagagtcggtcatcctattacagaagctaagccatagtccaacattgtttggtcaccatgggggtccttttgtaactgccttatgactcaacattaccaataaagtgatgatcctggtctgcgtttatacatacgcttgttcggtcctgttcctgacacgtgggttgagtcaccacagctctgtgtggggaacgtgggagacaggagtggctcctgccgggggaagctgggcctgccattggccctgtgtctatcatgaggggagagctaagaaagaaattctcctaggaagagctcatggcccagtacatcctagtaattattttaattagtttttgttctgacagcttgtcaggaagggcacagaatgggacagagataaaccagacagtcattttgatctgctctctacggtttttcaagtcagaggcaattgatgcttgtctaatgcatccacacactgcatgtctgactggcgatgccgcgctcctaagtagttctgccatgaaacataaaagacaaaggaaaagccgttacacatcacacagagaacattttcgggtcccacagcggtggtggcaggaagctcactctcgcgtcagtattagagtgtgtgtgtgggtctcggggatctcggtggctcccatcttccttcattgttctgaacatcctgtattgtaaaccatggctggggtgctaaagtgcctgtgaatcccgatgtggaaaaagctggaggtgaaagctcagcataccatgtatttactttaaaaacagaaaaaaagacatgtatggatatgtctattttttttttattggcacattgtatttttgtgttgacttgtttttagaaatgatgtgtccacacacgtacccgtgtctcttctgcatttctgtgtcatggttctgtttcttaatcacgtgcggcggtgtctaagtggtgttaccagtgtacgcgcagtgaccttggatgacagtggctctttctcacagcctcccctgagctgtgagaaacagctttctctgtacatatgcaactcctaataaaaggcatatttcttcctgttc

SEQ ID NO: 21622 - DNA, 5962 bp, Homo sapiens
cccagcggccccgagcgagcgccagcgccacacagccccgggcagccgccggcgagcgcgccgcgacgccgaacaggtggccggaggctgcgggcgccgcggcggggagaggcgaggcaagccccgggcgaagcgaggcgaggcgagggcggccgggccgggcatgcgagctgagcggccccccggcgtcgccgccgcctgcccgcgcccctagccgcccgcgcgcccgagtccccagcggctcctccgcgcccagcgtcctcggtcccggcctcggctgctccggctgcgctcggcgaggggcgcgggcccgcccgcggcggcggcggcatgaaagtgaccgtgtgcttcggacggacccgggtggtcgtgccgtgcggggacggccacatgaaagttttcagcctcatccagcaggcggtgacccgctaccggaaggccatcgccaaggatccaaactactggatacaggtgcatcgcttggaacatggagatggaggaatactagaccttgatgacattctttgtgatgtagcagacgataaagacagactggtagcagtgtttgatgagcaggatccacatcacggaggtgatggcaccagtgccagttccacgggtacccagagcccagagatatttggtagtgagcttggcaccaacaatgtctcagcctttcagccttaccaagcaacaagtgaaattgaggtcacaccttcagtccttcgagcaaatatgcctcttcatgttcgacgcagtagtgacccagctctaattggcctctccacttctgtcagtgatagtaatttttcctctgaagagccttcaaggaaaaatcccacacgctggtcaacaacagctggcttcctcaagcagaacactgctgggagtcctaaaacctgcgacaggaagaaagatgaaaactacagaagcctcccgcgggatactagtaactggtctaaccaatttcagagagacaatgctcgctcgtctctgagtgccagtcacccaatggtgggcaagtggctggagaaacaagaacaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccacgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgttgcaaggagaataagcaagtgcaatgagctgaagtcacctgggagcccccctggacctgagctgcccattgaaacagcgttggatgatagagaacgaagaatttcccattccctctacagtgggattgaggggcttgatgaatcgcccagcagaaatgctgccctcagtaggataatgggtaaataccagctgtcccctacagtgaatatgccccaagatgacactgtcattatagaagatgacaggttgccagtgcttcctccacatctctctgaccagtcctcttccagctcccatgatgatgtggggtttgtgacggcagatgctggtacttgggccaaggctgcaatcagtgattcagccgactgctctttgagtccagatgttgatccagttcttgcttttcaacgagaaggatttggacgtcagagtatgtcagaaaaacgcacaaagcaattttcagatgccagtcaattggatttcgttaaaacacgaaaatcaaaaagcatggatttaggtatagctgacgagactaaactcaatacagtggatgaccagaaagcaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcaggtttggcaaacatcgaaaagatgacaagattgagaaaacgggtaaaataaaaatacaggaatcctttacatcagaagaggagaggatacgaatgaagcaggagcaggagaggattcaagccaaaactcgagaatttagggaacgacaagctcgagagcgtgactatgctgaaattcaagattttcatcggacatttggctgtgatgatgagttaatgtatgggggagtttcttcttatgaaggttccatggctctcaacgctagacctcagagcccacgagaagggcatatgatggatgctttgtatgcccaagtcaagaagccgcggaattccaaaccctcacctgtagacagtaacagatcaactcctagcaatcatgatcggatacagcgtctgaggcaagaatttcagcaagcaaagcaagatgaagatgtagaagatcgtcggcggacctatagttttgagcaaccctggccgaacgcacggccggcgacgcagagcgggcgacactcggtgtccgtggaggtgcagatgcagcggcagcggcaggaggagcgcgagagctcccagcaggcccagcgccagtacagctctctgcctcggcaaagcaggaaaaatgccagctcggtctcccaggactcttgggagcagaactactcccctggggaaggcttccagagtgccaaagagaaccccaggtactccagctaccaaggctccaggaacggctacctgggaggacatggcttcaacgccagggtcatgctggaaactcaggagctccttcgccaggaacagaggcggaaggagcagcagatgaagaagcagcctccttccgaggggcccagcaactatgactcgtataagaaagtccaggaccccagttacgcccctcccaaggggcccttccggcaagatgtgcccccctccccttctcaggttgcgaggctgaacagacttcagactcctgagaaagggaggcccttctattcctgagcacgcaaataacggatgcttcatgtcgcgcaataaaagacattttcctatgaagacttgtattttgggagtttttttaaaacctcgatggtactatggagtatttctgttgttggtatcagtgcctttaagcggtgtaggcaaagaaatggaaggccttaatgtctttgccactatgtctcaagtgtctgtttcatggaaggatttcccaccctgtgacaatcatctgtttgaggtgttcatatgctctgcgcctctccacagtaccaggaatctcggccctactcatgagttgtccgcggcttggttgtaacatccctgcaccacttgcagtgacaaattcacctgaagtggaggatgacgtgcggccctgtttctccctctaagttctcttagctatgggatgacatcttagtctctggtggaggaaaagtgggcgacatacaccaaaaattggggctttctggtacttcacagcacagccatttgtcgtactttgtcatcactgtggttttctctttcctttctcagctctttgtgacgggagagtcggtcatcctattacagaagctaagccatagtccaacattgtttggtcaccatgggggtccttttgtaactgccttatgactcaacattaccaataaagtgatgatcctggtctgcgtttatacatacgcttgttcggtcctgttcctgacacgtgggttgagtcaccacagctctgtgtggggaacgtgggagacaggagtggctcctgccgggggaagctgggcctgccattggccctgtgtctatcatgaggggagagctaagaaagaaattctcctaggaagagctcatggcccagtacatcctagtaattattttaattagtttttgttctgacagcttgtcaggaagggcacagaatgggacagagataaaccagacagtcattttgatctgctctctacggtttttcaagtcagaggcaattgatgcttgtctaatgcatccacacactgcatgtctgactggcgatgccgcgctcctaagtagttctgccatgaaacataaaagacaaaggaaaagccgttacacatcacacagagaacattttcgggtcccacagcggtggtggcaggaagctcactctcgcgtcagtattagagtgtgtgtgtgggtctcggggatctcggtggctcccatcttccttcattgttctgaacatcctgtattgtaaaccatggctggggtgctaaagtgcctgtgaatcccgatgtggaaaaagctggaggtgaaagctcagcataccatgtatttactttaaaaacagaaaaaaagacatgtatggatatgtctattttttttttattggcacattgtatttttgtgttgacttgtttttagaaatgatgtgtccacacacgtacccgtgtctcttctgcatttctgtgtcatggttctgtttcttaatcacgtgcggcggtgtctaagtggtgttaccagtgtacgcgcagtgaccttggatgacagtggctctttctcacagcctcccctgagctgtgagaaacagctttctctgtacatatgcaactcctaataaaaggcatatttcttcctgttc

SEQ ID NO: 21623 - DNA, 4615 bp, Homo sapiens
gagggagggagctgcttccccgcctgccgcgccaccagtccgaccctcggtcccgccgtgtgagcagctggtggagtggagctcagcgcggacgccggagctgcggccgccccctctgcaggtgcctgtgaggaggcgcccgggccgcaaccgctttccgagatccccagtcgcgcactcgctccccgcgctcctgaggggccgcccggccggaggaggccgtcgcggggctcggcgttcagcatgaaccgcagccaccggcacggggcgggcagcggctgcctgggcactatggaggtgaagagcaagtttggagctgaatttcgtcggttttcgctggaaagatcaaaacctggaaaatttgaggagttttatggattactacaacatgttcataagatccccaatgttgacgttttggtaggctatgcagacatccatggagacttactacctataaataatgatgataattatcacaaagctgtttcaacggccaatccactgcttaggatatttatacaaaagaaggaagaagcagactacagtgcctttggtacagacacgctaataaagaagaagaatgttttaaccaacgtattgcgtcctgacaaccatagaaaaaagccacatatagtcattagtatgccccaagactttagacctgtgtcttctattatagacgtggatattctcccagaaacgcatcgtagggtacgtctttacaaatacggcacggagaaacccctaggattctacatccgggatggctccagtgtcagggtaacaccacatggcttagaaaaggttccagggatctttatatccaggcttgtcccaggaggtctggctcaaagtacaggactattagctgttaatgatgaagttttagaagttaatggcatagaagtttcagggaagagccttgatcaagtaacagacatgatgattgcaaatagccgtaacctcatcataacagtgagaccggcaaaccagaggaataatgttgtgaggaacagtcggacttctggcagttccggtcagtctactgataacagccttcttggctacccacagcagattgaaccaagctttgagccagaggatgaagacagcgaagaagatgacattatcattgaagacaatggagtgccacagcagattccaaaagctgttcctaatactgagagcctggagtcattaacacagatagagctaagctttgagtctggacagaatggctttattccctctaatgaagtgagcttagcagccatagcaagcagctcaaacacggaatttgaaacacatgctccagatcaaaaactcttagaagaagatggaacaatcataacattatgaaaccgtggtttgaatgttttcagagtgaggatgccatgaggacttgtacatttggctagtttaaaagcatatatacctctgaccagtgacgtggaataggcatgagacgagtaacgttgcaagcttacaatattattaaagtagtagtttgataattgttaatataaactttggtggatcagaggtgaatttaagtccaaaacaaaggggcctttgctgatgaagttacgtgcttttgctgttttgtctgtggagaatcagatgttaaagcacattcttggaactatgtgagaagactagatcatttctgttggaagtggttgcatatttaacctgctgtgcagagcccagttaatttttcctttaactgtatttttaaaattctaatgtgaagtctgattctctcttgtggtacattggggacctcagctcttaaaggtctcatgttcccaatattttattttgattttttttttttttttttttttttttttttttagtgactgggtctcactctgttgcccacactggaatgcagtggcatgatcacagctctctgcagcctcaatcccctgggctcaagcagtcctcccacctcagcctcctgagtagctgggaccataggcacataccaccacatctgtctactttttgtattttttgtagagacagggtttcgccatgttgcccaagttggtcttgaactcctgggcttaagcagtcctgcctcggcttcccaaaatgctaggattagagccaccatgcccagcctattttgatttttgtttttttatgttcctttctaataaattgtaacaaatgatgttctcaagtacatttccagtttcttttcttttctttctttttttttttttttttttttttgagatggagtctcgctctatcgcccaggctggagtgcagtggcgcgatcttggctcactgcaagctctacctcctgggttcacaccattctcctgcctcagcctcccaagtagctgggactacaggcgcctgccaccatgcctggctaatttttagtagagacggggtttcgcagtgttagccaggaaggtctcaatctcctgacctcctgatccgcccgcctcggcctcccaaagtgctgggattacaggcgtgagccaccgcgcccagttgtgcatttctggtttctaagaatcaaaccacttggctgtttttaggagttacttcccatgttataaagctgaggaagctttttttttttttttttgagacagagtctctgtcacccaggctggagtgcagtggtgcaatctcagctcccgggttcaagcaattctcctgcctcagccttctgagtagctaagattacaggtgtgcgccaacacgtctggcttatttttttgtatttttagtagagatggagtttcaccatgttggtcaggtgggtctcaaactcctgacctcaagtgatccgcccatctcctcccaaagtgctggattgcaggcatgagcgcctagccaggaagctatcttttcttgagttatgaaactttgcaacagttgttcaaattggtgtttgtccttcctatagctttcatattttcaaattaattctgtatggctatataatttatgttttaaaaggcaattctcttgactttggaaatatggaagtctctcctttaacctattcttgttcccattcccagtctcatttgaaatcattccttttattgttagtgtgtgtatttttgttggtgtgcttttaatgcatccaagtatgcatcattttggataaaaaatacatccaaattaagatgttttaacacataggacaaacttgtgcactttttatgccaaaaaaaaaaaaaattgggttttccttcatgggatttctagaaacactgcctacactttatgaaaactacatagtattcacctgtgacaggtagagtttatcactattaattttatgaggctatttattactttccaatgcatccacttagaacaagctaagagtaaggctgctaactttaattccttgcctgattttattgtacagtgtgcacaagcacaatggtatgcttgtatatagaaactaaaaatactatgaagtacataagttccctatggcttatggagagttatttattaattaactttatggtagggctagtatgaatacctttttaacaattgtgtgctattacaacaatgaagattcaaatgactccgctttgaaggatgttttctctatatggtaaaatatatatgaagaagtcttgattacgtgaagatcacttgactcagaatacttcaatgtattttgttcacattaccactaagcatattatcagtaaactattaactgactgcacattatgtaatacgttgtactttttgttgaattcaccgaagttcttccatttatatgctatttttaatggcattccggctttaacattctgtgagtcttacaaatttgactcttgaatggcaaaataatgttagtatgtagaaggttaactttcatttataatataagtggtgcaggggttcaacattttaagtaaaaatatttttacacactacctctctctttttttttttaaagttttaacatcagaacttttgggggaaaaactacttcagggcttgactttttgtacaaattttaactgtaaaatacagatttatcttgtacgcattcatggaaatggaaatcaaagctgctattgctttttattttaattatcctgttaagggtatctatcaatggtattttcaagtagatctctgtttcttaaattattggtgaaataattgattactagatatattgtaaaaccaatagatcctggttatacgataaaatatcagctcattggtaggctgaatcaattatttcaagtgcaccttattaacaaaagtatcagtggatccaacataaaattttatagtactaaatgtcaagcctaactgtgaattttgttctgtatcttaagtaaatttatgataatgttctcgagctatcaacaaaatatatgtacttttgtgagctatgaattttctaattaaattttacatgctataacatgatttttacatgaatgatactttgtttataactatcaaatgtcagtattttactacaattttattataaagtgtacattatcactaaatgaacttcgattttaaaaatcaaattagctttagttgtatattattttttacaaataaagatagacttgtataaaggcta

SEQ ID NO: 21624 - DNA, 3868 bp, Homo sapiens
cgctcctcccgcgcgcggcccctggagtccctgaggcgcgcggccagcccagctcgggcccgcagcaccgggagcagcccgccggccaagcgagcgcgggccggggccggggccggggcctgggggcgccgcccccgggagtctttctgcggcccctgaggagcgagggcgacggcgaggctgaccggggccgaaaccatgaaccgaagttttcacaagtctcagaccttgcgattctacgattgcagcgcagtggaagtcaagagcaagtttggggcggaattccgaaggttctctctggaccgtcataagcctgggaagtttgaagatttctacaagctggttgtgcacacccaccatatctccaacagtgatgtaactattggctatgcagatgtgcacggagacctgctgcccatcaacaatgatgacaacttctgcaaggcggtttctagtgcaaatcccctgctcagggtcttcatccagaaacgagaggaggccgagcgtggcagcctcggcgcgggctcgctgtgcaggcggaggcgggcgctgggcgcgctgcgtgatgaaggaccccggcggcgtgcacacctggacatcggcctcccgcgcgacttccgccccgtatcatccatcatcgatgtggacctggtccccgagacgcaccggcgagtgcggctgcaccggcacggctgcgagaagccgctgggcttctacatccgcgatggcgccagcgtgcgcgtgaccccgcacgggctggagaaggtgcccggcatcttcatctcgcgcatggtacccgggggcctggcggagagcaccgggctgctggctgtgaatgacgaggtcctggaggtgaacggcattgaggtggccgggaagacgctggaccaggtcacggacatgatgatcgccaacagccacaacctcatcgtcaccgtcaagcccgccaaccagcgcaacaacgtggtgcgcggcggccgcgcgttgggcagctcgggaccgccctcggacggcaccgcgggcttcgtgggtccccccgccccgcgcgtcctgcagaacttccaccccgacgaggcggagagcgatgaggacaacgacgtcgtcatcgagggcacactggagcctgcacgtcccccccagaccccgggcgcgcccgcaggcagcctctcccgggtcaatggcgcgggcctggcgcagcggctgcagcgggacctggccctggacggcggcctccagcggctgctcagctccctgcgggccgacccccgtcacagcctggcgctgccgccaggcggcgtggaggagcacgggcccgcggtcacgctctagactcccgagaggcccccaaatcctagctccagttccccggtaaggacagggacaggacctgcagactgcatccgctcattttttgttgtttttgtgaccacaaaaacaacgctgctctttgtttcaacttccggatataaaaacacaagtattgcctatttttatagaatttcgccacagaacttaaaatgaacgcctgtagagacactctataccaggcctgagtgcaggtcttggcgcctttgcaaagtgatagaaaagatctgaccaagtgcaaaaaaatgctttttaaaatttttacaaatactttgtttttaaagtgaagctttaaaattacttttttaaaatagtcaaattcatgtttttaagtaagttggcccatgcaacatatctcagcattcttgctgtgctctctgctgacttgcaggcgaggccgactgtgctgatgtacgtgacaagaggctggtttttaataacgaatgcagccaggtgcagtggctcacgtctgtaatcccagcactttgggaggcctacgtgggctgatcacgaggtcaggaggtcgagaccagcatggccaacatggtgaaaccctgtctctactaaaaatataaaaattagccaggtgtggtggcaggcgcctgtaatcccagctaccttgggaggctgaggcaggagaatcgcttgaacccgggaggcagaggttgcagtgagctgagatcgcaccactgcactccagcctgggtgacagagcaagactctgtctcgggaaaaaaaaaaaatacacccaaacctgtccatgtacaaccatggagatgaattccagattttcacactgttcatagtcataattcggttgggacaggagagctcccaccagcacacttatggcacccgcagctgtggaattgttccggggcttttttttgtttgttttgagacatagtgtcttgttctgtcatccaagctggagggatctcagctcactgcaacctccgcctcctgggttcaagcaattctcctgcctcagcctcccaaggagctgggacaggcacatgccaccatacccagctaatttttgtatttttagtagagatgggatttcaccacgttggtcaggctggtcttgaactcctgacctcaggtgatacggtcccccctcagcctccaaaaatgctaggattatagacgtgagccacagcaccagaccaggggctatttttgtgacccacataggtggcccattcagcctcaaggggaaatccagggtaggaagcagcagctctgctggactgggctcagcagtcccatttgggatgtaagcctctattgcctctaagatgacccttttcctgtgggttgactgactctgagggcgatttcggaaatgttttcagcagaaatgaaggataagcatcgcacatgtccagcaatgtctttgagaatgcagtcatttgcacgtgagttctcatctttgttttctgaaacagacgtttcttttagtaagtcacaatacatgctaattttcatttctagaatggtcactggcagttctcacttttaactataagaagtcacgtggaacttagtgatttttaacaaatactaaattcatcctcactttatgttgatcttccagcaacgtttatatatttagtaattttaaaaattcctatttgatacaattaaattttatataatgtgttttgcttgaataaaatgttacatttatactttgagaactctgaccaaatctttcatacagatacaggtaaagaaatatttttctaggttgtcggagctgcgtacctcccgctgcttctccttgtggtccagcaccacctgctggtcagtggcagaactgtcctgacttcgtgaacatggaactgctaagagggaaaactgcatctcagcattttcattttttctgaatattaagtgaaaagcaagttctatttttaagaaatagcttttgctgaggagttgtgaattcctgcacctgtgtttgatgttatttgtatgcaatggattgctggccctttgttcctaagcaagagaagaccaaagatgcttccccatgacctctccggtgaggatccgcaccccccggacttgctctctgatgaagggcatgtcgttcagtgccccagcagtcagaagcagtttttgtggaactaaaactaataatgttaccctcacaaaggaaatgttcttttactaagttattgctgattcttgaatgtctgttatataactgggtcggctatcaagaaggaaggttatatttcttatcacattttaagttgttaagcaaatgtgagtttttttttaagaaatgaggctttcactgagatttgtgtgctattcataattttaggaattactgcttagaacagctgcttgggtgtatttttctacacaggtctgtacttctgccactttctccttttaaaaaaacaaaactatgcatattatgtattaaagttttcttggttttatatatcagagaataaaaacttttttgacttttgagtaaacaaaa

SEQ ID NO: 21625 - DNA, 1332 bp, Homo sapiens
gcgtgtgttttttctttcctctttcccctgcctgtgtgcccttctccaggatggcagaggcggaattgcacaaggaaaggctgcaagccatagcagaaaaaagaaagaggcagactgaaatagaaggcaagcgacaacagcttgacgagcagatacttctgctgcagcattccaagtccaaagtgcttcgggagaaatggctgctgcagggcatacccgctggaactgccgaagaggaggaagccaggaggcggcagtctgaagaggatgagttcagagtcaagcaacttgaagataacattcagaggctggagcaagaaatacaaacgctagaaagtgaagagtcccagatatctgccaaagagcaaatcatcctagagaaactgaaggaaacagaaaaatccttcaaggactttcagaagggtttctccagtacggatggagatgcagtaaattacatttcctcccagcttcccgacctgccaatcctctgttcacgaacagcagaaccatcacctgggcaggacgggaccagcagagcggctgctgtgtacgccatggaaattaatgtggagaaagacaaacaaacaggagagaccaagattctctctacatctaccattggcccagagggggtccatcagaaaggagtcaaagtctatgatgatggtaccaaagtagtgtatgaggtgcgctcaggaggcaccgtagtagaaaatggagtgcacaaattaagcacaaaggatgtagaagagcttattcagaaggctggacaatcaagcttaggaggagggcacgtgtctgaaaggactgtgattgcagatgggagcctcagccatcccaaggaacacatgctctgcaaagaagctaagttagaaatggtacataagtctaggaaagaccattcttccgggaacccagggcagcaggcccaagcccccagcgctgcagggccggaggcaaacttggatcagcccgtcaccatgatttttatgggctaccaaaatatcgaggatgaagaggagacgaaaaaggtgctaggctatgatgaaaccatcaaggctgaattggtcctcattgatgaagatgatgagaagtcattgagggagaagacagtgacggacgtgtccactattgacgggaacgcggctgagcttgtgtccgggaggccggtctcagacaccacagagccctcatccccagaagggaaggaagagagcctagctacagagccagccccaggtacccaaaagaaaaagcgctgtcaatgctgtgttgtcatgtgaccacttctttcttctcctttcttctgggcagcctgtactctccacc

SEQ ID NO: 21626 - DNA, 4492 bp, Homo sapiens
gtgcactcggctccgggagaggcgagcagcgccggtgagccccgcagcagcgcacccggccgcggagccccgcgatggagatggcagaggcggaattgcacaaggaaaggctgcaagccatagcagaaaaaagaaagaggcagactgaaatagaaggcaagcgacaacagcttgacgagcagatacttctgctgcagcattccaagtccaaagtgcttcgggagaaatggctgctgcagggcatacccgctggaactgccgaagaggaggaagccaggaggcggcagtctgaagaggatgagttcagagtcaagcaacttgaagataacattcagaggctggagcaagaaatacaaacgctagaaagtgaagagtcccagatatctgccaaagagcaaatcatcctagagaaactgaaggaaacagaaaaatccttcaaggactttcagaagggtttctccagtacggatggagctgtgtacgccatggaaattaatgtggagaaagacaaacaaacaggagagaccaagattctctctacatctaccattggcccagagggggtccatcagaaaggagtcaaagtctatgatgatggtaccaaagtagtgtatgaggtgcgctcaggaggcaccgtagtagaaaatggagtgcacaaattaagcacaaaggatgtagaagagcttattcagaaggctggacaatcaagcttaggaggagggcacgtgtctgaaaggactgtgattgcagatgggagcctcagccatcccaaggaacacatgctctgcaaagaagctaagttagaaatggtacataagtctaggaaagaccattcttccgggaacccagggcagcaggcccaagcccccagcgctgcagggccggaggcaaacttggatcagcccgtcaccatgatttttatgggctaccaaaatatcgaggatgaagaggagacgaaaaaggtgctaggctatgatgaaaccatcaaggctgaattggtcctcattgatgaagatgatgagaagtcattgagggagaagacagtgacggacgtgtccactattgacgggaacgcggctgagcttgtgtccgggaggccggtctcagacaccacagagccctcatccccagaagggaaggaagagagcctagctacagagccagccccaggtacccaaaagaaaaagcgctgtcaatgctgtgttgtcatgtgaccacttctttcttctcctttcttctgggcagcctgtactctccaccactcacgtagacctcactgtaccactaactgcaatactgtgaactggaagcaaacacctgccttgccttgcagttgaattgctttgatctctctcattttttttccttttcctcacctgagagacaacgtgcatgtgtgtgcttcattctctccaagaacttgcttttcctctaaacctttccttgtgtcttcaagagtgaatcacttccttcctgctcgattggaatggactcttcgtatcagccagtgatatggtagccttaactcacttgactggaattgaacccattggcactgggggtttcattttgtagtgtgttcctgtaacgtagtcacacactgccatgtctctggtttctcacttgcctcctttgctgtggatctttgtttttatatcttgtgtggcaaaatgctgttggctctagccggttgctagtgtagccaaaagtggaccttacttagtctgtccgatctagggtgatgctttttgctgccttacataagcttccagattacagtattgtgcattcatggctttctttctgttaaaactgaaatgaagtcaatgtagaagaacccagagcttgtcacagctgaaatgtagggactgattccataacctgcccatcagcggttgtctctctttctatggtttaaccgatgaaccctttatataagaagcaccattttaaaatttctaaggacatgaaacaaacattgtttgaagcatcagtagcaattgatctccaaacttaggcaaattcacaagccttgtttctattctcttaaaaaaatgtaaatttttatattgtttcttttttctggatattttctggtcatgttaatctattttcaatgaggagatcatcttgagaagtatctttgcagtgaccatatttctaaaacagtctgtccaacctacaatggttgccatgatgctcccacttcatcatggatggtgctgtaatgcattaactgttcatctcctccccagttgattacaaagccttgcatccatactcttttctttctggccccatgagaaagagaatgttttaggtaacttcaacttgtaggtttatctgcccttcaaaaaaaaaaactttaaaaaacttttaaaaattaagaaagacctatcttctcaatgttaagcacttaatttcataacaaatattaagtggcacatagctgagcttcttagggcattgttttgtttttagcttctggagattccagaagagcaaagaatattttttatctagaacacaatgaacagtttttgaaataccttctcagcactcccccaaagcaaaaagccacatatgtagtaaaaccaaagggaaacaatttaataaaataacaatagtatagtaatgaaataaagatataacatgattactggttttaataagagttatcttaactttaagttatttgcccatttatagcattgttatgaattattcataaaattatgtcccacagtatatagttttgaaaaaacatatgatatactacatccagtctaacttctgtggaaagtagatcagaaaaaataagatagtcttgagagaattttattatagaagctgtctaatttgacctattttgcttgctcagtgctaaatctattgcttttttttaatctcctggcttgaaattatatttacttcaataggaaaggtaaaaacatcagtttttacttttcaaagttaattttctgaaataattgcattttaatgagcacaaaatgggtcattttatttttattatactcatcttgtttacacctatacataaacagaaaacgttaaagaagagaaaaataaaggagctaagttctgctgttgaagattatttcatccaaggcttggttttgaataactgagggaaatatctctaaatctcaagttcatcaaagcagctgcaatggaataaaattgctattttatcgagaaacctggtttggatgcttataaattccactactctcagcttcattttcctgagtacgtggtcactgaagcatcatttagacattacataaactggcatgcagataaacctatttacatagagggagaaaacagtttcaatgtcttggacaatctgttattttaatgatttacttaagaaagaaacaatctgaaagcttaccatagcttatcttttctactcacttggagattcaagctattcaatgtgagttttaaaaagttaagcacagttagtgagtgaaatggtagaatgtagaacctttaagcttgctggttgataaacagaatcaatcttccaggacagataattccctgaagggacctatccttgcataagtgaactagttactcatacagaaaatgatctgcacatcttactacaacactacacacaagaactaaaagattaatgattatctgtattctcttcactaattactattatgggggaataatgattagcaaattatatgaattcgagttctctctatacttttattagtaaagcttatcatttaatggactgaagtaagatgtgttacctttattcgagctatttgtagccacactaaatgaaggtgtgtttgaatatggcgcatatatttgcatatgtcccatcattttcttgtcataatggggaattcaggcttagccagtacttctatgggatgagacctataatcccacctatagcagcaagtaactacccttcatgatgatagtgtacatggagctgtgattatgaacatgctgcctttcctgctgccattggcattctctctgtaaattttattatgtgtggtatcacactctccaaaaatgcagggtatttggttacataaccaaactaattaaagaatcagtaatgaaattgcaaaaccatgatcttttttgagctaatgattagttgggctttcctttaaaataatataatcaggccgagtgcagcggctcacacctgtaatctcggcactttggaagtccgcggcgggtggttcacctgaggtcgggagttcaagaccagcctgaccaacatggagaaacccccatctctactaaaaaaaaaatacaaaattagccaggcgtgatggcgcatgcctgtaatcccagctactcgggagactgaggcaggagaatcgcttgaacctgggaggcaggggttgcaatgagccgagatgtgcactccagcctgggcaacaaagagcgaaactccatctcaaaaaaaaaaaaaaaa

SEQ ID NO: 21627 - DNA, 9292 bp, Homo sapiens
atggagatggcagaggcggaattgcacaaggaaaggctgcaagccatagcagaaaaaagaaagaggcagactgaaatagaaggcaagcgacaacagcttgacgagcagatacttctgctgcagcattccaagtccaaagtgcttcgggagaaatggctgctgcagggcatacccgctggaactgccgaagaggaggaagccaggaggcggcagtctgaagaggatgagttcagagtcaagcaacttgaagataacattcagaggctggagcaagaaatacaaacgctagaaagtgaagagtcccagatatctgccaaagagcaaatcatcctagagaaactgaaggaaacagaaaaatccttcaaggactttcagaagggtttctccagtacggatggagatgcagtaaattacatttcctcccagcttcccgacctgccaatcctctgttcacgaacagcagaaccatcacctgggcaggacgggaccagcagagcggctgctgtgtacgccatggaaattaatgtggagaaagacaaacaaacaggagagaccaagattctctctacatctaccattggcccagagggggtccatcagaaaggagtcaaagtctatgatgatggtaccaaagtagtgtatgaggtgcgctcaggaggcaccgtagtagaaaatggagtgcacaaattaagcacaaaggatgtagaagagcttattcagaaggctggacaatcaagcttaggaggagggcacgtgtctgaaaggactgtgattgcagatgggagcctcagccatcccaaggaacacatgctctgcaaagaagctaagttagaaatggtacataagtctaggaaagaccattcttccgggaacccagggcagcaggcccaagcccccagcgctgcagggccggaggcaaacttggatcagcccgtcaccatgatttttatgggctaccaaaatatcgaggatgaagaggagacgaaaaaggtgctaggctatgatgaaaccatcaaggctgaattggtcctcattgatgaagatgatgagaagtcattgagggagaagacagtgacggacgtgtccactattgacgggaacgcggctgagcttgtgtccgggaggccggtctcagacaccacagagccctcatccccagaagggaaggaagagagcctagctacagagccagccccaggtacccaaaagaaaaagcgctgtcaatgctgtgttgtcatgtgaccacttctttcttctcctttcttctgggcagcctgtactctccaccactcacgtagacctcactgtaccactaactgcaatactgtgaactggaagcaaacacctgccttgccttgcagttgaattgctttgatctctctcattttttttccttttcctcacctgagagacaacgtgcatgtgtgtgcttcattctctccaagaacttgcttttcctctaaacctttccttgtgtcttcaagagtgaatcacttccttcctgctcgattggaatggactcttcgtatcagccagtgatatggtagccttaactcacttgactggaattgaacccattggcactgggggtttcattttgtagtgtgttcctgtaacgtagtcacacactgccatgtctctggtttctcacttgcctcctttgctgtggatctttgtttttatatcttgtgtggcaaaatgctgttggctctagccggttgctagtgtagccaaaagtggaccttacttagtctgtccgatctagggtgatgctttttgctgccttacataagcttccagattacagtattgtgcattcatggctttctttctgttaaaactgaaatgaagtcaatgtagaagaacccagagcttgtcacagctgaaatgtagggactgattccataacctgcccatcagcggttgtctctctttctatggtttaaccgatgaaccctttatataagaagcaccattttaaaatttctaaggacatgaaacaaacattgtttgaagcatcagtagcaattgatctccaaacttaggcaaattcacaagccttgtttctattctcttaaaaaaatgtaaatttttatattgtttcttttttctggatattttctggtcatgttaatctattttcaatgaggagatcatcttgagaagtatctttgcagtgaccatatttctaaaacagtctgtccaacctacaatggttgccatgatgctcccacttcatcatggatggtgctgtaatgcattaactgttcatctcctccccagttgattacaaagccttgcatccatactcttttctttctggccccatgagaaagagaatgttttaggtaacttcaacttgtaggtttatctgcccttcaaaaaaaaaaactttaaaaaacttttaaaaattaagaaagacctatcttctcaatgttaagcacttaatttcataacaaatattaagtggcacatagctgagcttcttagggcattgttttgtttttagcttctggagattccagaagagcaaagaatattttttatctagaacacaatgaacagtttttgaaataccttctcagcactcccccaaagcaaaaagccacatatgtagtaaaaccaaagggaaacaatttaataaaataacaatagtatagtaatgaaataaagatataacatgattactggttttaataagagttatcttaactttaagttatttgcccatttatagcattgttatgaattattcataaaattatgtcccacagtatatagttttgaaaaaacatatgatatactacatccagtctaacttctgtggaaagtagatcagaaaaaataagatagtcttgagagaattttattatagaagctgtctaatttgacctattttgcttgctcagtgctaaatctattgcttttttttaatctcctggcttgaaattatatttacttcaataggaaaggtaaaaacatcagtttttacttttcaaagttaattttctgaaataattgcattttaatgagcacaaaatgggtcattttatttttattatactcatcttgtttacacctatacataaacagaaaacgttaaagaagagaaaaataaaggagctaagttctgctgttgaagattatttcatccaaggcttggttttgaataactgagggaaatatctctaaatctcaagttcatcaaagcagctgcaatggaataaaattgctattttatcgagaaacctggtttggatgcttataaattccactactctcagcttcattttcctgagtacgtggtcactgaagcatcatttagacattacataaactggcatgcagataaacctatttacatagagggagaaaacagtttcaatgtcttggacaatctgttattttaatgatttacttaagaaagaaacaatctgaaagcttaccatagcttatcttttctactcacttggagattcaagctattcaatgtgagttttaaaaagttaagcacagttagtgagtgaaatggtagaatgtagaacctttaagcttgctggttgataaacagaatcaatcttccaggacagataattccctgaagggacctatccttgcataagtgaactagttactcatacagaaaatgatctgcacatcttactacaacactacacacaagaactaaaagattaatgattatctgtattctcttcactaattactattatgggggaataatgattagcaaattatatgaattcgagttctctctatacttttattagtaaagcttatcatttaatggactgaagtaagatgtgttacctttattcgagctatttgtagccacactaaatgaaggtgtgtttgaatatggcgcatatatttgcatatgtcccatcattttcttgtcataatggggaattcaggcttagccagtacttctatgggatgagacctataatcccacctatagcagcaagtaactacccttcatgatgatagtgtacatggagctgtgattatgaacatgctgcctttcctgctgccattggcattctctctgtaaattttattatgtgtggtatcacactctccaaaaatgcagggtatttggttacataaccaaactaattaaagaatcagtaatgaaattgcaaaaccatgatcttttttgagctaatgattagttgggctttcctttaaaataatataatcaggccgagtgcagcggctcacacctgtaatctcggcactttggaagtccgcggcgggtggttcacctgaggtcgggagttcaagaccagcctgaccaacatggagaaacccccatctctactaaaaaaaaaatacaaaattagccaggcgtgatggcgcatgcctgtaatcccagctactcgggagactgaggcaggagaatcgcttgaacctgggaggcaggggttgcaatgagccgagatgtgcactccagcctgggcaacaaagagcgaaactccatctcaaaaaaaaaaaaaaaaaaaaaaaaatcatataatcagttcccttttaaatagaaagaggaggaaaaaaaaaaggaaaagggggggtatctcatttgtatacaaatagattttcaatggcatttaataaaagattctttaatggttaaaatgataaagattaattctacatatcttgaaaaatcttaatgacttctgtattcttgacttcttaaaaatattttctttcttttagtgtgcaataagacaaactaaggggaattttttcagcttgtatctcttttacccatattattttccttgcataagcaaaaaaataataattgcctctaaaactgatttgacagtgttcagtgacatcatttaatattggtgatggggtggaagagaaggtagggaatgcccttatggccaaacctaaaacacagtttccttgagccttctgagcaatcttagaattattcagaagctttcaggaaactcaaattctattaatttgatttggttcctttccaaaatgttaatagacatgtatttgcttaaaacgtctacctattccatttaatttcctgctgataaatgtattttatctacaagcaagtagaatattttgttttggttaaagtcaagtttttataaaaggaggggaagtataagagagagtttcctagagatacaatatcatctctggagcaaaatgttgaggccaagtgtaaaaacagactatttctctttacttcctgcagaatttcatttcaagggaccacagcacacccttgaaaattaccatttatttaatgccagttgaaccaatgggtagcaaaagaggagggagggaacatggtcatagagacaaaatctaactactataccaggtcttcctttgtaagaaatattagccctgccaatataaaacgcagatggacatagacagaataagcatcgaggactttttcttatttacttgaaatctagaagctcagtcatctctgctcatccctggacccactggagagttttactcactaacaggtcctttcctggaagaaataacctcatctcctgccatattagtttacaataaaaatcattccaaagtgagccatttcacattgcatttttgccacatgcacatttgctattgaaaccacagattctcagcataagtaagacataggtgtttcagaaacttcataaatacacgatctttcaggtgctcctcaatttcttaatcaaggtatattgaactccagtgattaggatagaacctgaaaacatcctttgttctattggatagtacaacacagcaagagcacacagttatttgtataataaaacaacttaattaatgaggaagatgggatgtttgattcctgctaccaccagttcacttcacaaaggccttcttctggtattaccaggaaaactttcctgcattttctagggaaaaagaaaagtcgtttattaggagcacaatgcagatatgtatctgtgttttcatagcttcagcaaacttcttagtaaaattcccatttcaacaaaaaccaaaatactgattgtttgaatgtagaaaggtatagaataaagactacaaaggggaattttaccagggctccttagaccagcttccccagcataatttttatataactcaagtaagcctctgcttcccctctcctttccagtataatataagaaggtcggaactgtcgcacaaaagaacttgatttcaatatgaaaatataatatgtaattttggggactgcagactttctgcatcaaagatctggacagccttaacttttataaaaataatttttcaatgttctcttttactaaccaggaaaacaagatgttttctgaaattaatgactttttctattttgggtctgttttctaagtttttacaggttgaggtataaagggtcgtcttctcctcatattgcctcttcataatcacctggggctattttttgcaagtcactgcatttttacaaaaaataaaaataaaaagtacatctcacaaatcataaaattctccctagacttcagacagtccttctggagtgaaagaatagaaatacagaaagaaaagaattacagggtggctttctttttattttcctatggttaatgtactgtatggtatatatgtttacagaatgtatctgccttgtgatgttaacaaaatgaatgacaaaaaatagtactgatgtgccatttgacagtttgccttagcatcactgtttatgttcttcttttctgtcctttttggtaaaaaaaaacgcaggttgtattccaaagctgtattaacacaacattctcttccccactcctacccagccttcttcagagctgtgaatttcattacaggagcattgaggcagaaccttgcaggtgtggcccaaaggggctaaagtgggcataggttgggatttacttctgcccgtctaccaaccaaacacgtatctgtgttctcatataagcctgcaaaattttacaccctgcctttcagggagacaggccacatggagcgcatgacctcttgtagtcgtctcctcacagtccttcccactgtgagagaaggaaacttgcagacccccaactggatctgggagcatatttttaagcacagttggcattgcttgaaaaagcaagagagatggactcaaattctatgattgagccatgactgaggaatgtgcccattcgttatagtcgaagatgagtaggatgatatgggtgagaataggagtggctgtagaaatggaatattttacagttatgtatttttttaaggaatagtatttttataatgaaatctatatacattatggagcttgagttggaaaacacccttgactgagctatttcttcattccattaaaggtaactttctggggagtcctatagcactaggccaagccttgggggcatgaacaaagggcctgtcacttggccttgcactgccattacatgagatccagtgtttccaaataggccttggttggaagattgagctttctatacctgccattaggtagattagatagatggcttgatagctctctgggctatacttttaataatatataataatctttgggaaggagatagctattttaaatgcaagcaaagcccagaaactatcaaagtccaaatctttcacatatttaaggagtaattgccacatttgaggttaagggaccacttactatggtgcatttgagaaatatatatgaaacggtgagtcagagccctctgaccatcttcagtctacacataagcagataaaccaccaatataaatcttataggggccagacgaggtggcttatgcctgtaatcccagcactttggggggccaaggcaggaggatagtgtgagcccagaagttcaagaccaggctaggcaacatgttgagaccatgttgtttagtctctactaaaaaatataaaaattagccagcatggtggcacacacctgtagtcccagctacttgggagactgaggcaggaggatcacttgagcccaggaggtggaggctgcagggggctgagatctcaccactccattccagcctgggcaacagagcaagactctgtctcaaaaaaaaaaacaaaaaaacaattatcagttggccttctacataacacagggctacactgtatttttagagttaagtagatacaggaaaagattgtctttatccataaaggagattctgaatttttagagttcctgaatattttcccccaagtttctgtcaaattcctgaagtcccttccctatcacactcagtttcctgaagctcttcccctacacctgctcctctgtctggctaacagagttgtcatgtctcagaaactactcaccactcttgtgagactctcttcccaagcatcatccttcctcaggatgaggcctttttctactacccaagagatcaagaccctttttctaacaagacaaggttatatctactccattttcaagagaaataacccctctggttcccatgcaaatcgcttaaattccttcatcaccagaatctctccaacaggcccaactccagcccagctgtgaacactgctgtcatggagacaactccaaaatgaaagaactatgcaattgcctgaaggtgctaatggagagccagtttactctaatctcttattactaaggaacctctcggtttcgagattaagtgggcagggagacatccagtcacttagttttgcaatgacaggtcttgatatacacagaggccaccaggcaatgcctgatccaaactattctgtatgtagctccaactccaattctgtgatatcctattctggcaggtgggaagagttctattctttgcagggttctggaacattctttcctgctctcaagctcctgacttaggagagtcaaaatcatacaggggttccagaaaatgttgtgtctgatgcagcttctcagtgaatgtaggttgttggtgaaattttcagctttagcatctcactcggggtgagtgatgtctctgtaaatactttcatttgtggttggttggtgggggtgggggtgggagcctgtcgtgcttactctgaattagcttactgggctagctgctgtactttgtaacctgaagtgtactttgactgttctgtttccttcagatgaaaaacaaaataaaaaccgacttcagaaaagacactaccagcgacagctgatgctgtacttgtagcttctctctgttcctctgtacagtattaatagacaataaactgccttttcactgcatct

SEQ ID NO: 21628 - DNA, 2568 bp, Homo sapiens
gttggaaggagcaaaatgggacttttggctgaaagtgctgagctcctgcggtgggggctgaccgcaagccacgccttctgtgcacctggtcggcccagctagctgccgacccggcggggaggggcggggcgggccaatcggcgctgccccagcagggctgcggctgcaggcaggcagagcctcctagcccgtcggtgtctgcgcccatcgatccctttgtctatccccgaccatggcgaagctgattgcgctcaccctcttggggatgggactggcactcttcaggaaccaccagtcttcttaccaaacacgacttaatgctctccgagaggtacaacccgtagaacttcctaactgtaatttagttaaaggaatcgaaactggctctgaagacttggagatactgcctaatggactggctttcattagctctggattaaagtatcctggaataaagagcttcaaccccaacagtcctggaaaaatacttctgatggacctgaatgaagaagatccaacagtgttggaattggggatcactggaagtaaatttgatgtatcttcatttaaccctcatgggattagcacattcacagatgaagataatgccatgtacctcctggtggtgaaccatccagatgccaagtccacagtggagttgtttaaatttcaagaagaagaaaaatcgcttttgcatctaaaaaccatcagacataaacttctgcctaatttgaatgatattgttgctgtgggacctgagcacttttatggcacaaatgatcactattttcttgacccctacttacaatcctgggagatgtatttgggtttagcgtggtcgtatgttgtctactatagtccaagtgaagttcgagtggtggcagaaggatttgattttgctaatggaatcaacatttcacccgatggcaagtatgtctatatagctgagttgctggctcataagattcatgtgtatgaaaagcatgctaattggactttaactccattgaagtcccttgactttaataccctcgtggataacatatctgtggatcctgagacaggagacctttgggttggatgccatcccaatggcatgaaaatcttcttctatgactcagagaatcctcctgcatcagaggtgcttcgaatccagaacattctaacagaagaacctaaagtgacacaggtttatgcagaaaatggcacagtgttgcaaggcagtacagttgcctctgtgtacaaagggaaactgctgattggcacagtgtttcacaaagctctttactgtgagctctaacagaccgatttgcacccatgccatagaaactgaggccattatttcaaccgcttgccatattccgaggacccagtgttcttagctgaacaatgaatgctgaccctaaatgtggacatcatgaagcatcaaagcactgtttaactgggagtgatatgatgtgtagggcttttttttgagaatacactatcaaatcagtcttggaatacttgaaaacctcatttaccataaaaatccttctcactaaaatggataaatcagttatgtcaattgtcagatattaaataacagtgtgtgaccccaaaagtacttaccctaaaacatgtgttgcctggaagcacatgtgtgtatcgctgccttgccatgtcttgttcagaagacacaggggagcagggttagctcacgtgtctttagaactccagtactcacccagggactccagttcacaggccagaaaacatatgcattatgaagttcccctctactccatgcacatagtaagtctgactatggcagtcagacttacttactcccattttcccttcgatatatgactttttctcagtaaatattaacctgaattattccaactccccttgtactcttgctttttcaattctcctgttgcaatgacacataggaaaatcttaaaattcttgggagtgttgtcacacctgaaaattatgagtctctatgatcttggcacaaattgtacatttgagtgtctttgacttggttaaaggaagtttgttcacttcgatgactggatacagaatgaatcccataattgacatgggcgaagctaaaagtgtccccaaagactacactgttgttgaggtggtggtagtgctggtgggtttttgtttaatatttaaacttcttgttgtggaggctgaaaagaaaaaaaataatagaaaggtaaacaaacaaataaatagaaaagatcaacaacccctttggctatctactgagacatgactaggaagaaaacatgactttatcattttgttatagaaactgatatataaaggttacacattttcatttatttgtttttctgatttgaaggtataaccttcatgatgaattacttcttcagggtgttaaggcagtgactttagaaacaaatttttttcttgtttttgttttgtttttgagaccgaatctcactctgttgcccaggctggagtgcagtggtgcgatcttggctcactgcaacttctacctccgaggttcaagagattcttgtgcctcagcctcccggatagctg

SEQ ID NO: 21629 - DNA, 1112 bp, Homo sapiens
accccgagaccatggggaagctcgtggcgctggtcctgctgggggtcggcctgtccttagtcggggagatgttcctggcgtttagagaaagggtgaatgcctctcgagaagtggagccagtagaacctgaaaactgccaccttattgaggaacttgaaactggctctgaagacttggagatactgcctaatggactggctttcattagctctggattaaagtatcctggaataaagagcttcaaccccaacagtcctggaaaaatacttctgatggacctgaatgaagaagatccaacagtgttggaattggggatcactggaagtaaatttgatgtatcttcatttaaccctcatgggattagcacattcacagatgaagataatgccatgtacctcctggtggtgaaccatccagatgccaagtccacagtggagttgtttaaatttcaagaagaagaaaaatcgcttttgcatctaaaaaccatcagacataaacttctgcctaatttgaatgatattgttgctgtgggacctgagcacttttatggcacaaatgatcactattttcttgacccctacttacaatcctgggagatgtatttgggtttagcgtggtcgtatgttgtctactatagtccaagtgaagttcgagtggtggcagaaggatttgattttgctaatggaatcaacatttcacccgatggcaagtatgtctatatagctgagttgctggctcataagattcatgtgtatgaaaagcatgctaattggactttaactccattgaagtcccttgactttaataccctcgtggataacatatctgtggatcctgagacaggagacctttgggttggatgccatcccaatggcatgaaaatcttcttctatgactcagagaatcctcctgcatcagaggtgcttcgaatccagaacattctaacagaagaacctaaagtgacacaggtttatgcagaaaatggcacagtgttgcaaggcagtacagttgcctctgtgtacaaagggaaactgctgattggcacagtgtttcacaaagctctttactgtgagctctaacagaccgatttgcacccatgccatagaaactga

SEQ ID NO: 21630 - DNA, 1745 bp, Homo sapiens
aagtttcacatcatgagcctaatgtaaggcgtgtccgggccgtcccgaaggtatctggggaaataggtttgtgaggacaaagaccagggccaggcccagggcggagcctccgcggccccgacgcagggactcggcctaggcggaggacggggcggagcgcggccggcaccatcgagccgggaagatggcaccgcccacggagctgctggccaggccggagcgaggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgataacgtattttgatgttttgtacttacatctttgtttaccattaaaa

SEQ ID NO: 21631 - DNA, 1516 bp, Homo sapiens
ggggcggctggtggctgtgggcttgctggggatcgcgctggcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgataacgtattttgatgttttgtacttacatctttgtttaccattaaaaagttggagttatattaaagactaa

SEQ ID NO: 21632 - DNA, 1779 bp, Homo sapiens
aagtttcacatcatgagcctaatgtaaggcgtgtccgggccgtcccgaaggtatctggggaaataggtttgtgaggacaaagaccagggccaggcccagggcggagcctccgcggccccgacgcagggactcggcctaggcggaggacggggcggagcgcggccggcaccatcgagccgggaagatggcaccgcccacggagctgctggccaggccggagcgaggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgataacgtattttgatgttttgtacttacatctttgtttaccattaaaaagttggagttatattaaagactaactaaaatccc

SEQ ID NO: 21633 - DNA, 1726 bp, Homo sapiens
aagtttcacatcatgagcctaatgtaaggcgtgtccgggccgtcccgaaggtatctggggaaataggtttgtgaggacaaagaccagggccaggcccagggcggagcctccgcggccccgacgcagggactcggcctaggcggaggacggggcggagcgcggccggcaccatcgagccgggaagatggcaccgcccacggagctgctggccaggccggagcgaggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgataacgtattttgatgttttgtacttacatctttgtttaccattaaaaagttggagttatattaa

SEQ ID NO: 21634 - DNA, 1105 bp, Homo sapiens
accccgagaccatggggaagctcgtggcgctggtcctgctgggggtcggcctgtccttagtcggggagatgttcctggcgtttagagaaagggtgaatgcctctcgagaagtggagccagtagaacctgaaaactgccaccttattgaggaacttgaaagtggctctgaagatattgatatacttcctagtgggctggcttttatctccagtggattaaaatatccaggcatgccaaactttgcgccagatgaaccaggaaaaatcttcttgatggatctgaatgaacaaaacccaagggcacaagcgctagaaatcagtggtggatttgacaaagaattatttaatccacatgggatcagtattttcatcgacaaagacaatactgtgtatctttatgttgtgaatcatccccacatgaagtccactgtggagatatttaaatttgaggaacaacaacgttctctggtatacctgaaaactataaaacatgaacttctcaaaagtgtgaatgacattgtggttcttggaccagaacagttctatgccaccagagaccactattttaccaactccctcctgtcattttttgagatgatcttggatcttcgctggacttatgttcttttctacagcccaagggaggttaaagtggtggccaaaggattttgtagtgccaatgggatcacagtctcagcagaccagaagtatgtctatgtagctgatgtagcagctaagaacattcacataatggaaaaacatgataactgggatttaactcaactgaaggtgatacagttgggcaccttagtggataacctgactgtcgatcctgccacaggagacattttggcaggatgccatcctaatcctatgaagctactgaactataaccctgaggaccctccaggatcagaagtacttcgcatccagaatgttttgtctgagaagcccagggtgagcaccgtgtatgccaacaatggctctgtgcttcagggcacctctgtggcttctgtgtaccatgggaaaattctcataggcaccgtatttcacaaaactctgtactgtgagctctagactctagatagtaaaaaaaaaaaaaaaaa

SEQ ID NO: 21635 - DNA, 2407 bp, Homo sapiens
cgtgagttgggggaggacgggttgccgactcgcctacctagcggtctcttgattgtcgatattttgttggcataggtttatgtagagacgtatacatatatatagacacactgtctataaatctaggcctgtatccggtgtccgaggcgaactcagtaagatgatgttaagaggaaacctgaagcaagtgcgcattgagaaaaacccggcccgccttcgcgccctggagtccgcggtgggcgagagcgagccggcggccgcggcagccatggcgctcgctcttgccggggagccggcaccgcccgcgcccgcgcctccagaggaccacccggacgaggagatggggttcactatcgacatcaagagtttcctcaagccgggcgagaagacgtacacgcagcgctgccgcctcttcgtgggaaatctgcccaccgacatcacggaggaggacttcaagaggctcttcgaacgctatggcgagcccagcgaagtcttcatcaaccgggaccgtggcttcggcttcatccgcttggaatccagaaccctggctgaaattgcaaaagcagagctggacggcaccattctcaagagcagacctctacggattcgcttcgctacacatggagcagccttgactgtcaagaacctttctccagttgtttccaatgagctgctagagcaagcattttctcagtttggtccagtagagaaagctgttgtggttgtggatgatcgcggtagagctacaggaaaaggttttgtagagtttgcagcaaaacctcctgcacgaaaggctctggaaagatgtggtgatggggcattcttgctaacaacgacccctcgtccagtcattgtggaacccatggagcagtttgatgatgaagatggcttgccagagaagctgatgcagaaaactcaacaatatcataaggaaagagaacaaccaccacgttttgctcaacctgggacatttgaatttgagtatgcatctcgatggaaggctcttgatgaaatggaaaagcagcagcgtgagcaggttgatagaaacatcagagaagccaaagagaaactggaggcagaaatggaagcagctaggcatgaacaccaattaatgctaatgaggcaagatctaatgaggcgtcaagaagaactcagacgcttggaagaactcagaaaccaagagttgcaaaaacggaagcaaatacaactaagacatgaagaggagcatcggcggcgtgaggaagaaatgatccgacacagagaacaggaggaactgaggcgacagcaagagggctttaagccaaactacatggaaaatagagaacaggaaatgagaatgggtgatatgggtccccgtggagcaataaacatgggagatgcgtttagcccagcccctgctggtaaccaaggtcctcctccaatgatgggtatgaatatgaacaacagagcaactatacctggcccaccaatgggtcctggtcctgccatgggaccagaaggagccgcaaatatgggaactccaatgatgccagataatggagcagtgcacaatgacagatttcctcaaggaccaccatctcagatgggttcacctatggggagtagaacaggttctgaaacccctcaagcaccaatgagtggtgtaggtcctgtgagtggtggtcctggtggctttggtagaggaagtcaagggggcaactttgaaggccctaataagcgtcgtagatattaaacattcgttcattcctggctatctagaaaaaaaaaagtcagtggtatgcctttatacttttacctgttatctggaagaaatggttttattgttaatgtatgtagacttaaaagtttttttttttttgtaaaacttgaggtttttgtatttttctttattcatgagctttgtagattagaatggtaatgatgctcatcattttgaatgttgaaatgtgtttgtgactttagctaaatataagtattccatagtactgtgaaatctatgtagttaatctcaataaagaaatcattttggataatttaaaactgttattagtggtattctcttacggtcttactaaactttgctgtaacagtaatgctttggttgctttaactaatcctatcattaaaaatgaaaatgattttgctttttaatttgcgcaagtagcactaaagatagaagcttaattaatgaaagctaatgtcaataaggggtagatagagtagtatatgtgggggtgggagggtatgggagtttaatttgtataaaccactgatgttctgtgaaatcggaatttccagctacatttcatatagcttctgaatattcaggtattctgagacagattattaaggatatctttgtcctgtgctgatttttccaaataaatctttttcatcttgaaaaaaa

SEQ ID NO: 21636 - DNA, 1645 bp, Homo sapiens
attttgaatgtgcagctgcagcgggcgcctgtatccggtgtccgaggcgaactcagtaagatgatgttaagaggaaacctgaagcaagtgcgcattgagaaaaacccggcccgcgcctccagaggaccacccggacgaggagatggggttcactatcgacatcaagagtttcctcaagccgggcgagaagacgtacacgcagcgctgccgcctcttcgtgggaaatctgcccaccgacatcacggaggaggacttcaagaggctcttcgaacgctatggcgagcccagcgaagtcttcatcaaccgggaccgtggcttcggcttcatccgcttggaatccagaaccctggctgaaattgcaaaagcagagctggacggcaccattctcaagagcagacctctacggattcgcttcgctacacatggagcagccttgactgtcaagaacctttctccagttgtttccaatgagctgctagagcaagcattttctcagtttggtccagtagagaaagctgttgtggttgtggatgatcgcggtagagctacaggaaaaggttttgtagagtttgcagcaaaacctcctgcacgaaaggctctggaaagatgtggtgatggggcattcttgctaacaacgacccctcgtccagtcattgtggaacccatggagcagtttgatgatgaagatggcttgccagagaagctgatgcagaaaactcaacaatatcataaggaaagagaacaaccaccacgttttgctcaacctgggacatttgaatttgagtatgcatctcgatggaaggctcttgatgaaatggaaaagcagcagcgtgagcaggttgatagaaacatcagagaagccaaagagaaactggaggcagaaatggaagcagctaggcatgaacaccaattaatgctaatgaggcaagatctaatgaggcgtcaagaagaactcagacgcttggaagaactcagaaaccaagagttgcaaaaacggaagcaaatacaactaagacatgaagaggagcatcggcggcgtgaggaagaaatgatccgacacagagaacaggaggaactgaggcgacagcaagagggctttaagccaaactacatggaaaatagagaacaggaaatgagaatgggtgatatgggtccccgtggagcaataaacatgggagatgcgtttagcccagcccctgctggtaaccaaggtcctcctccaatgatgggtatgaatatgaacaacagagcaactatacctggcccaccaatgggtcctggtcctgccatgggaccagaaggagccgcaaatatgggaactccaatgatgccagataatggagcagtgcacaatgacagatttcctcaaggaccaccatctcagatgggttcacctatggggagtagaacaggttctgaaacccctcaagcaccaatgagtggtgtaggtcctgtgagtggtggtcctggtggctttggtagaggaagtcaagggggcaactttgaaggccctaataagcgtcgtagatattaaacattcgttcattcctggctatctagaaaaaaaaaagtcagtggtatgcctttatacttttacctgttatctggaagaaatggttttattgttaatgtatgtagacttaaa

SEQ ID NO: 21637 - DNA, 866 bp, Homo sapiens
ggcggaggggtgggacttgcaccggcgtctcttcttctaactgcagtttgtggcagcgccattttgaatgtgcagctgcagcgggcgcctgtatccggtgtccgaggcgaactcagtaagatgatgttaagaggaaacctgaagcaagtgcgcattgagaaaaacccggcccgccttcgcgccctggagtccgcggtgggcgagagcgagccggcggccgcggcagccatggcgctcgctcttgccggggagccggcaccgcccgcgcccgcgcctccagaggaccacccggacgaggagatggggttcactatcgacatcaagagtttcctcaagccgggcgagaagacgtacacgcagcgctgccgcctcttcgtgggaaatctgcccaccgacatcacggaggaggacttcaagaggctcttcgaacgctatggcgagcccagcgaagtcttcatcaaccgggaccgtggcttcggcttcatccgcttggaatccagaaccctggctgaaattgcaaaagcagagctggacggcaccattctcaagagcagacctctacggattcgcttcgctacacatggagcagccttgactgtcaagaacctttctccagttgtttccaatgagctgctagagcaagcattttctcagtttggtccagtagagaaagctgttgtggttgtggatgatcgcggtagagctacaggaaaaggttttgtagagtttgcagcaaaacctcctgcacgaaaggctctggaaagatgtggtgatggggcattcttgctaacaacgacccctcgtccagtcattgtggaacccatggagcagtttgatgatgaagatggcttgccagagaagctgat

SEQ ID NO: 21638 - DNA, 1139 bp, Homo sapiens
ggcagctctgctggtgcgggggcggcgagcccgggatcgagctaccgcggccgagcgcgccggccaccgcctgcaccgcccttccgcccgccctccggacggccgcagccctgcgggtctccgctccagacccacccccgccccaccccgcgcgcctctgccgcctcttccagagacccagcttgccgagcggccgccgctgccgctgtcgccgccgccgccgccaccgcgccaggttccggccgcggccaccctccgccgtccagggcccctccgtctcggccccgggaccccggctccccgccagccccggccccggccccggcaccatgtcggagaaaagcgtggaggcagcggccgagttgagcgccaaggacctgaaggagaagaaggagaaggtggaggagaaggcaagccggaaagagcgaaagaaagaagtggtggaggaggaggagaacggggctgaggaggaagaagaagaaactgccgaggatggagaggaggaagatgaaggggaagaagaagatgaggaagaagaagaagaggatgatgaagggcccgcgctgaagagagctgccgaagaggaggatgaagcggatcccaaacggcagaagacagaaaatggggcatcggcgtgagcccctgccaacaggctggggttgggaggcctctctgggcctggaggtgggggtgggggcagccaagtccagccactcttcacctggctccctgctctgggccctgcaccagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtggggccggggttggggccgagccccacagctgcccccctcccctccctttttgtataatttaataaagaaatggtcgcgcttc

SEQ ID NO: 21639 - DNA, 773 bp, Homo sapiens
gcggcagctctgctggtgcgggggcggcgagcccgggatcgagctaccgcggccgagcgcgccggccaccgcctgcaccgcccttccgcccgccctccggacggccgcagccctgcgggtctccgctccagacccacccccgccccaccccgcgcgcctctgccgcctcttccagagacccagcttgccgagcggccgccgctgccgctgtcgccgccgccgccgccaccgcgccaggttccggccgcggccaccctccgccgtccagggcccctccgtctcggccccgggaccccggctccccgccagccccggccccggccccggcaccatgtcggagaaaagcgtggaggcagcggccgagttgagcgccaaggacctgaaggagaagaaggagaaggtggaggagaaggcaagccggaaagagcgaaagaaagaagtggtggaggctccagtcccattggtggtgatggtgggcaaggcatgcagccagcctgaggctactccctctcctggtccccacaggaggaggagaacggggctgaggaggaagaagaagaaactgccgaggatggagaggaggaagatgaaggggaagaagaagatgaggaagaagaagaagaggatgatgaagggcccgcgctgaagagagctgccgaagaggaggatgaagcggatcccaaacggcagaagacagaaaatggggcatcggcgtgagcccctgccaacaggctggggttgggaggcctctctgggcctggaggtgggggtgg

SEQ ID NO: 21640 - DNA, 816 bp, Homo sapiens
tccagagacccagcttgccgagcggccgagttgagcgccaaggacctgaaggagaagaaggagaaggtggaggagaaggcaagccggaaagagcgaaagaaagaagtggtggaggaggaggagaacggggctgaggaggaagaagaagaaactgccgaggatggagaggaggaagatgaaggggaagaagaagatgaggaagaagaagaagaggatgatgaagggcccgcgctgaagagagctgccgaagaggaggatgaagcggatcccaaacggcagaagacagaaaatggggcatcggcgtgagcccctgccaacaggctggggttgggaggcctctctgggcctggaggtgggggtgggggcagccaagtccagccactcttcacctggctccctgctctgggccctgcaccagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtggggccggggttggggccgagccccacagctgcccccctcccctccctttttgtataatttaataaagaaatggtcgcgcttctgtttttaa

SEQ ID NO: 21641 - DNA, 1872 bp, Homo sapiens
cctgcatctttttggaaggattctttttataaatcagaaagtgttcgaggttcaaaggtttgcctcggagcgtgtgaacattcctccgctcggttttcaactcgcctccaacctgcgccgcccggccagcatgtctccccgcccgtgaagcggggctgccgcctccctgccgctccggctgccactaacgacccgccctcgccgccacctggccctcctgatcgacgacacacgcacttgaaacttgttctcagggtgtgtggaatcaactttccggaagcaaccagcccaccagaggaggtcccgagcgcgagcggagacgatgcagcggagactggttcagcagtggagcgtcgcggtgttcctgctgagctacgcggtgccctcctgcgggcgctcggtggagggtctcagccgccgcctcaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctcgattcacggtaacaggcttctctggcccgtagcctcagcggggtgctctcagctgggttttggagcctcccttctgccttggcttggacaaacctagaattttctccctttatgtatctctatcgattgtgtagcaattgacagagaataactcagaatattgtctgccttaaagcagtacccccctaccacacacacccctgtcctccagcaccatagagaggcgctagagcccattcctctttctccaccgtcacccaacatcaatcctttaccactctaccaaataatttcatattcaagcttcagaagctagtgaccatcttcataatttgctggagaagtgtgtttcttccccttactctcacacctgggcaaactttcttcagtgtttttcatttcttacgttctttcacttcaagggagaatatagaagcatttgatattatctacaaacactgcagaacagcatcatgtcataaacgattctgagccattcacactttttatttaattaaatgtatttaattaaatctcaaatttattttaatgtaaagaacttaaattatgttttaaacacatgccttaaatttgtttaattaaatttaactctggtttctaccagctcatacaaaataaatggtttctgaaaatgtttaagtattaacttacaaggatataggtttttctcatgtatctttttgttcattggcaagatgaaataatttttctagggtaatgccgtaggaaaaataaaacttcacatttatgtggcttgtttatccttagctcacagattgaggtaataatgacactcctagactttgggatcaaataacttagggccaagtcttgggtctgaatttatttaagttcacaacctagggcaagttactctgcctttctaagactcacttacatcttctgtgaaatataattgtaccaacctcatagagtttggtgtcaactaaatgagattatatgtggactaaatatctgtcatatagtaaacactcaataaattgcaacatatt

SEQ ID NO: 21642 - DNA, 952 bp, Homo sapiens
cctgcatctttttggaaggattctttttataaatcagaaagtgttcgaggttcaaaggtttgcctcggagcgtgtgaacattcctccgctcggttttcaactcgcctccaacctgcgccgcccggccagcatgtctccccgcccgtgaagcggggctgccgcctccctgccgctccggctgccactaacgacccgccctcgccgccacctggccctcctgatcgacgacacacgcacttgaaacttgttctcagggtgtgtggaatcaactttccggaagcaaccagcccaccagaggaggtcccgagcgcgagcggagacgatgcagcggagactggttcagcagtggagcgtcgcggtgttcctgctgagctacgcggtgccctcctgcgggcgctcggtggagggtctcagccgccgcctcaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctcgattcacgtacagcacttctgtggggtttgaaaaaaaaaaaggaaaacaacagaagaacacatcatatgcaactaatgatctcattatttaagagtcccctgttacttctttag

SEQ ID NO: 21643 - DNA, 1674 bp, Homo sapiens
aagcaaccagcccaccagaggaggtagacagacagctatgtatatatatgtgggtttcgctacaagtggctctggaacgaaagggcctggttcgcaaagaagctgacttcagagggggaaactttcttcttttaggaggcggttagccctgttccacgaacccaggagaactgctggccagattaattagacattgctatgggagacgtgtaaacacactacttatcattgatgcatatataaaaccattttattttcgctattatttcagaggaagcgcctctgatttgtttcttttttccctttttgctctttctggctgtgtggtttggagaaagcacagttggagtagccggttgctaaataagtcccgagcgcgagcggagacgatgcagcggagactggttcagcagtggagcgtcgcggtgttcctgctgagctacgcggtgccctcctgcgggcgctcggtggagggtctcagccgccgcctcaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctcgattcacggtaacaggcttctctggcccgtagcctcagcggggtgctctcagctgggttttggagcctcccttctgccttggcttggacaaacctagaattttctccctttatgtatctctatcgattgtgtagcaattgacagagaataactcagaatattgtctgccttaaagcagtacccccctaccacacacacccctgtcctccagcaccatagagaggcgctagagcccattcctctttctccaccgtcacccaacatcaatcctttaccactctaccaaataatttcatattcaagcttcagaagctagtgaccatcttcataatttgctggagaagtgtgtttcttccccttactctcacacctgggcaaactttcttcagtgtttttcatttcttacgttctttcacttcaagggagaatatagaagcatttgatattatctacaaacactgcagaacagcatcatgtcataaacgattctgagccattcacactttttatttaattaaatgtatttaattaaatctcaaatttattttaatgtaaagaacttaaattatgttttaaacacatgccttaaatttgtttaattaaatttaactctggtttctaccagctcatacaaaataaatggtttctgaaaatgtttaagtattaacttacaaggatataggtttttctcatgtatctttttgttcattggcaagatgaaataatttttctagggtaatgccgtaggaaaaataaaacttcacattta

SEQ ID NO: 21644 - DNA, 1318 bp, Homo sapiens
ggaaggattctttttataaatcagaaagtgttcgaggttcaaaggtttgcctcggagcgtgtgaacattcctccgctcggttttcaactcgcctccaacctgcgccgcccggccagcatgtctccccgcccgtgaagcggggctgccgcctccctgccgctccggctgccactaacgacccgccctcgccgccacctggccctcctgatcgacgacacacgcacttgaaacttgttctcagggtgtgtggaatcaactttccggaagcaaccagcccaccagaggaggtcccgagcgcgagcggagacgatgcagcggagactggttcagcagtggagcgtcgcggtgttcctgctgagctacgcggtgccctcctgcgggcgctcggtggagggtctcagccgccgcctcaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctcgattcacggaggcattgaaattttcagcagagaccttccaaggacatattgcaggattctgtaatagtgaacatatggaaagtattagaaatatttattgtctgtaaatactgtaaatgcattggaataaaactgtctcccccattgctctatgaaactgcacattggtcattgtgaatattttttttttgccaaggctaatccaattattattatcacatttaccataatttattttgtccattgatgtatttattttgtaaatgtatcttggtgctgctgaatttctatattttttgtaacataatgcactttagatatacatatcaagtatgttgataaatgacacaatgaagtgtctctattttgtggttgattttaatgaatgcctaaatataattatccaaattgattttcctttgtgcatgtaaaaataacagtattttaaatttgtaaagaatgtctaataaaatataatctaattacatcatga

SEQ ID NO: 21645 - DNA, 1891 bp, Homo sapiens
cgccagcccgcctgcgccctcgctcgccccgcgcgcgttcctagggcgccacctctttgcgactagctcacttctccggcaggtttgcctcggagcgtgtgaacattcctccgctcggttttcaactcgcctccaacctgcgccgcccggccagcatgtctccccgcccgtgaagcggggctgccgcctccctgccgctccggctgccactaacgacccgccctcgccgccacctggccctcctgatcgacgacacacgcacttgaaacttgttctcagggtgtgtggaatcaactttccggaagcaaccagcccaccagaggaggtcccgagcgcgagcggagacgatgcagcggagactggttcagcagtggagcgtcgcggtgttcctgctgagctacgcggtgccctcctgcgggcgctcggtggagggtctcagccgccgcctcaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctcgattcacggtaacaggcttctctggcccgtagcctcagcggggtgctctcagctgggttttggagcctcccttctgccttggcttggacaaacctagaattttctccctttatgtatctctatcgattgtgtagcaattgacagagaataactcagaatattgtctgccttaaagcagtacccccctaccacacacacccctgtcctccagcaccatagagaggcgctagagcccattcctctttctccaccgtcacccaacatcaatcctttaccactctaccaaataatttcatattcaagcttcagaagctagtgaccatcttcataatttgctggagaagtgtgtttcttccccttactctcacacctgggcaaactttcttcagtgtttttcatttcttacgttctttcacttcaagggagaatatagaagcatttgatattatctacaaacactgcagaacagcatcatgtcataaacgattctgagccattcacactttttatttaattaaatgtatttaattaaatctcaaatttattttaatgtaaagaacttaaattatgttttaaacacatgccttaaatttgtttaattaaatttaactctggtttctaccagctcatacaaaataaatggtttctgaaaatgtttaagtattaacttacaaggatataggtttttctcatgtatctttttgttcattggcaagatgaaataatttttctagggtaatgccgtaggaaaaataaaacttcacatttatgtggcttgtttatccttagctcacagattgaggtaataatgacactcctagactttgggatcaaataacttagggccaagtcttgggtctgaatttatttaagttcacaacctagggcaagttactctgcctttctaagactcacttacatcttctgtgaaatataattgtaccaacctcatagagtttggtgtcaactaaatgagattatatgtggactaaatatctgtcatatagtaaacactcaataaattgcaa

SEQ ID NO: 21646 - DNA, 81 bp, Homo sapiens
acagcacttctgtggggtttgaaaaaaaaaggaaaacaacagaagaacacatcatatgcaactaatgatctcattatttaa

SEQ ID NO: 21647 - DNA, 854 bp, Homo sapiens
atgcagcggagactggttcagcagtggagcgtcgcggtgttcctgctgagctacgcggtgccctcctgcgggcgctcggtggagggtctcagccgccgcctcaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctcgattcacgtacagcacttctgtggggtttgaaaaaaaaaaaggaaaacaacagaagaacacatcatatgcaactaatgatctcattatttaagagtcccctgttacttctttagtcatttcctttgactctgctacagataggattataggatgatgcttcaaaggggaccttgaacctattcaccattatttgtctctttaagctggcaaacccatcattaaatagcacataaaatagcaatcatatgggataagtagtacagcttcagtaatcaatgggcagtggcactagaaaaatcttgagcacagtgaatgacctatcctgcaaacatctaat

SEQ ID NO: 21648 - DNA, 890 bp, Homo sapiens
ggagagtccagactgacactcgggtcccattcccttctgttgcaggtcccgagcgcgagcggagacgatgcagcggagactggttcagcagtggagcgtcgcggtgttcctgctgagctacgcggtgccctcctgcgggcgctcggtggagggtctcagccgccgcctcaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctcgattcacggaggcattgaaattttcagcagagaccttccaaggacatattgcaggattctgtaatagtgaacatatggaaagtattagaaatatttattgtctgtaaatactgtaaatgcattggaataaaactgtctcccccattgctctatgaaactgcacattggtcattgtgaatattttttttttgccaaggctaatccaattattattatcacatttaccataatttattttgtccattgatgtatttattttgtaaatgtatcttggtgctgctgaatttctatattttttgtaacataa

SEQ ID NO: 21649 - DNA, 746 bp, Homo sapiens
tctccggcaggtttgcctcggagcgtgtgaacattcctccgctcggttttcaactcgcctccaacctgcgccgcccggccagcatgtctccccgcccgtgaagcggggctgccgcctccctgccgctccggctgccactaacgacccgccctcgccgccacctggccctcctgatcgacgacacacgcacttgaaacttgttctcagggtcccgagcgcgagcggagacgatgcagcggagactggttcagcagtggagcgtcgcggtgttcctgctgagctacgcggtgccctcctgcgggcgctcggtggagggtctcagccgccgcctcaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctc

SEQ ID NO: 21650 - DNA, 1214 bp, Homo sapiens
ctgctttctaataattgcctttagtgggaacagaagtctcctttcaagaagcttttaattcattttaagatttaattttatgttttctgaagaacaacaaaaaatatttctggaaaagactgctgagaagatttccctctttcagccagaagagcagagagaagattgtaaatcaaggaaaagatttcccccttcagatctaacgattacattagggctcctgcatctttttggaaggattctttttataaatcagaaagtgttcgaggttcaaaggtttgcctcggagcgtgtgaacattcctccgctcggttttcaactcgcctccaacctgcgccgcccggccagcatgtctccccgcccgtgaagcggggctgccgcctccctgccgctccggctgccactaacgacccgccctcgccgccacctggccctcctgatcgacgacacacgcacttgaaacttgttctcagggtgtgtggaatcaactttccggaagcaaccagcccaccagaggaggtcccgagcgcgagcggagacgatgcagcggagactggttcagcagtggagcgtcgcggtgttcctgctgagctacgcggtgccctcctgcgggcgctcggtggagggtctcagccgccgcctcaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctcgattcacggaggcattgaaattttcagcagagaccttccaaggacatattgcaggattctgtaatagtgaacatatggaaagtattagaaatatttattgtctgtaaatactgtaaatgcattggaataaaactgtctcccccattgctctatgaaa

SEQ ID NO: 21651 - DNA, 1619 bp, Homo sapiens
agatctatctggaggagtttctgtggagccagccaccctcaccaggtgccttccattagagtttaatgctttgctgcggtttcctgaaagagccccacagagagtgggtctcgatgggtcctgaaccgcaccacaaccggccagtgagacctcctgctcacatccgtaaagcccactgattcttttactacactttttatgagaacaagacattttctaggaagatggtggcagaaaaagagaccctgagcttaaacaaatgcccagacaagatgccgaagaggaccaagctgctggcacaacagccgctcccggtgcaccagcctcactctctggtttctgagggtttcacagtcaaagccatgatgaaaaactcagtcgtgagaggccctccagctgcaggggcatttaaagaaagaccaaccaagcccacagcatttcgaaaattctatgagcgaggtgacttcccaattgcccttgagcatgattcgaaaggaaacaaaatcgcctggaaggtagaaattgagaagctggattaccatcattatctgcctctgttttttgatgggctttgtgaaatgacatttccctatgagttttttgctcggcaaggaatccacgacatgctggaacacggtgggaacaagatcctacctgtccttccacagctcattatcccgataaaaaatgccttgaacctccgaaaccgacaggtcatctgtgtcactctcaaggtcctccagcatctggttgtgtcagctgagatggtgggcaaggccttggtgccttattaccgtcaaatcctccctgtcctgaacatctttaagaatatgaatgggtcttactctttgcccaggctggagtgcagtggcgcgatcatggctcgttgcaacctcgaccacctgggctcaagtgatcctcccacctcagcctctcaagtagctgagattatagtgaactccggagacggcattgactacagccagcagaagagggagaacattggggacttgatccaggagacactggaggccttcgagcgctacggaggagaaaatgcctttatcaacattaagtacgtggtcccaacctacgagtcttgcttgctaaactaacagtggcagcagctgggacttgaaacctcccgttggtgttgggatcatctgtctctgttgcttttagcatctcattccttgtgacttccacagctttcttttctacagctgctaaaatagtggcttatgggccattggactgttagccctattgagagcaaggctttccaatacataaatagtgtctgtttcttagattacaatagtgtactgtgcttatttgttctaagagaagaattgcttctttatacagctccgacagaagcaggagtccgagttaaaccttcagttgtatagacaataaactataattttcatatgcaattcagcaattgctgttctgtgtgtgcctgccctgggggtgatgtcagaggttgtaagggaagagtttatgctgactgcttactaggtgtttgtcatggaagagaagcatgggttcagcagtgcctctctagcagctgtgcggaataatgtgctttgacattcaataaaactgttgaatct

SEQ ID NO: 21652 - DNA, 1373 bp, Homo sapiens
gtgttgaccagtcgcttagcaaccgggaggcttacctttggaagcttgttgcagctctagccaaggtcctgccctcttcccgccccgcccctagggtccagctcccttcacctaggagctgccaaacatctggatcaacctgggcactacgaggggttgaatttctaccattatcgcgccttttgatatttttttccagacctcctgctcacatccgtaaagcccactgattcttttactacactttttatgagaacaagacattttctaggaagatggtggcagaaaaagagaccctgagcttaaacaaatgcccagacaagatgccgaagaggaccaagctgctggcacaacagccgctcccggtgcaccagcctcactctctggtttctgagggtttcacagtcaaagccatgatgaaaaactcagtcgtgagaggccctccagctgcaggggcatttaaagaaagaccaaccaagcccacagcatttcgaaaattctatgagcgaggtgacttcccaattgcccttgagcatgattcgaaaggaaacaaaatcgcctggaaggtagaaattgagaagctggattaccatcattatctgcctctgttttttgatgggctttgtgaaatgacatttccctatgagttttttgctcggcaaggaatccacgacatgctggaacacggtgggaacaagatcctacctgtccttccacagctcattatcccgataaaaaatgccttgaacctccgaaaccgacaggtcatctgtgtcactctcaaggtcctccagcatctggttgtgtcagctgagatggtgggcaaggccttggtgccttattaccgtcaaatcctccctgtcctgaacatctttaagaatatgaatgtgaactccggagacggcattgactacagccagcagaagagggagaacattggggacttgatccaggagacactggaggccttcgagcgctacggaggagaaaatgcctttatcaacattaagtacgtggtcccaacctacgagtcttgcttgctaaactaacagtggcagcagctgggacttgaaacctcccgttggtgttgggatcatctgtctctgttgcttttagcatctcattccttgtgacttccacagctttcttttctacagctgctaaaatagtggcttatgggccattggactgttagccctattgagagcaaggctttccaatacataaatagtgtctgtttcttagattacaatagtgtactgtgcttatttgttctaagagaagaattgcttctttatacagctccgacagaagcaggagtccgagttaaaccttcagttgtatagacaataaactataattttcatatgcaa

SEQ ID NO: 21653 - DNA, 1503 bp, Homo sapiens
agatctatctggaggagtttctgtggagccagccaccctcaccaggtgccttccattagagtttaatgctttgctgcggtttcctgaaagagccccacagagagtgggtctcgatgggtcctgaaccgcaccacaaccggccagtgagacctcctgctcacatccgtaaagcccactgattcttttactacactttttatgagaacaagacattttctaggaagatggtggcagaaaaagagaccctgagcttaaacaaatgcccagacaagatgccgaagaggaccaagctgctggcacaacagccgctcccggtgcaccagcctcactctctggtttctgagggtttcacagtcaaagccatgatgaaaaactcagtcgtgagaggccctccagctgcaggggcatttaaagaaagaccaaccaagcccacagcatttcgaaaattctatgagcgaggtgacttcccaattgcccttgagcatgattcgaaaggaaacaaaatcgcctggaaggtagaaattgagaagctggattaccatcattatctgcctctgttttttgatgggctttgtgaaatgacatttccctatgagttttttgctcggcaaggaatccacgacatgctggaacacggtgggaacaagatcctacctgtccttccacagctcattatcccgataaaaaatgccttgaacctccgaaaccgacaggtcatctgtgtcactctcaaggtcctccagcatctggttgtgtcagctgagatggtgggcaaggccttggtgccttattaccgtcaaatcctccctgtcctgaacatctttaagaatatgaatgtgaactccggagacggcattgactacagccagcagaagagggagaacattggggacttgatccaggagacactggaggccttcgagcgctacggaggagaaaatgcctttatcaacattaagtacgtggtcccaacctacgagtcttgcttgctaaactaacagtggcagcagctgggacttgaaacctcccgttggtgttgggatcatctgtctctgttgcttttagcatctcattccttgtgacttccacagctttcttttctacagctgctaaaatagtggcttatgggccattggactgttagccctattgagagcaaggctttccaatacataaatagtgtctgtttcttagattacaatagtgtactgtgcttatttgttctaagagaagaattgcttctttatacagctccgacagaagcaggagtccgagttaaaccttcagttgtatagacaataaactataattttcatatgcaattcagcaattgctgttctgtgtgtgcctgccctgggggtgatgtcagaggttgtaagggaagagtttatgctgactgcttactaggtgtttgtcatggaagagaagcatgggttcagcagtgcctctctagcagctgtgcggaataatgtgctttgacattcaataaaactgttgaatcta

SEQ ID NO: 21654 - DNA, 1276 bp, Homo sapiens
atgatagtgtttgtcaggttcaactccagccatggtttcccagtggaggtcgattctgacaccagcatcttccagctcaaggaggtggttgctaagcgacagggggttccggctgaccagttgcgtgtgattttcgcagggaaggagctgaggaatgactggactgtgcagaattgtgacctggatcagcagagcattgttcacattgtgcagagaccgtggagaaaaggtcaagaaatgaatgcaactggaggcgacgaccccagaaacgcggcgggaggctgtgagcgggagccccagagcttgactcgggtggacctcagcagctcagtcctcccaggagactctgtggggctggctgtcattctgcacactgacagcaggaaggactcaccaccagctggaagtccagggtccatcttgctgggatgatgttttaattccaaaccggatgagtggtgaatgccaatccccacactgccctgggactagtgcagaatttttctttaaatgtggagcacaccccacctctgacaaggaaacatcagtagctttgcacctgatcgcaacaaatagtcggaacatcacttgcattacgtgcacagacgtcaggagccccgtcctggttttccagtgcaactcccgccacgtgatttgcttagactgtttccacttatactgtgtgacaagactcaatgatcggcagtttgttcacgaccctcaacttggctactccctgccttgtgtggctggctgtcccaactccttgattaaagagctccatcacttcaggattctgggagaagagcagtacaaccggtaccagcagtatggtgcagaggagtgtgtcctgcagatggggggcgtgttatgcccccgccctggctgtggagcggggctgctgccggagcctgaccagaggaaagtcacctgcgaagggggcaatggcctgggctgtgggtttgccttctgccgggaatgtaaagaagcgtaccatgaaggggagtgcagtgccgtatttgaagcctcaggaacaactactcaggcctacagagtcgatgaaagagccgccgagcaggctcgttgggaagcagcctccaaagaaaccatcaagaaaaccaccaagccctgtccccgctgccatgtaccagtggaaaaaaatggaggctgcatgcacatgaagtgtccgcagccccagtgcaggctcgagtggtgctggaactgtggctgcgagtggaaccgcgtctgcatgggggaccactggttcgacgtgtag

SEQ ID NO: 21655 - DNA, 1505 bp, Homo sapiens
gatttaacccaggagagccgctggtgggaggcgcggctggcgccgctgcgcgcatgggcctgttcctggcccgcagccgccacctacccagtgaccatgatagtgtttgtcaggttcaactccagccatggtttcccagtggaggtcgattctgacaccagcatcttccagctcaaggaggtggttgctaagcgacagggggttccggctgaccagttgcgtgtgattttcgcagggaaggagctgaggaatgactggactgtgcagaattgtgacctggatcagcagagcattgttcacattgtgcagagaccgtggagaaaaggtcaagaaatgaatgcaactggaggcgacgaccccagaaacgcggcgggaggctgtgagcgggagccccagagcttgactcgggtggacctcagcagctcagtcctcccaggagactctgtggggctggctgtcattctgcacactgacagcaggaaggactcaccaccagctggaagtccagcaggtagatcaatctacaacagcttttatgtgtattgcaaaggcccctgtcaaagagtgcagccgggaaaactcagggtacagtgcagcacctgcaggcaggcaacgctcaccttgacccagggtccatcttgctgggatgatgttttaattccaaaccggatgagtggtgaatgccaatccccacactgccctgggactagtgcagaatttttctttaaatgtggagcacaccccacctctgacaaggaaacatcagtagctttgcacctgatcgcaacaaatagtcggaacatcacttgcattacgtgcacagacgtcaggagccccgtcctggttttccagtgcaactcccgccacgtgatttgcttagactgtttccacttatactgtgtgacaagactcaatgatcggcagtttgttcacgaccctcaacttggctactccctgccttgtgtggctggctgtcccaactccttgattaaagagctccatcacttcaggattctgggagaagagcagtacaaccggtaccagcagtatggtgcagaggagtgtgtcctgcagatggggggcgtgttatgcccccgccctggctgtggagcggggctgctgccggagcctgaccagaggaaagtcacctgcgaagggggcaatggcctgggctgtgggtatggacaacgaagaacaaaataagctgcctcagggagaagtgagtgcctcattcaatacatcgttcaaggaaaagtcattggtagcaaagctatagaagaattacagagttccagatgtggaaaaagccctagacgtcattaactccagtgattatcaggatgtggttcacagatttattgtaagatgcctgtgaattcacccgtgcttaatttttttttccctcaattatcaagatagaaaaagtacaactcttaccatgtgggtatgcaagaaatgttagctgttacaaaaaaaatcgcgtataaaaaagttgaaaaccaaat

SEQ ID NO: 21656 - DNA, 1157 bp, Homo sapiens
atgatagtgtttgtcaggttcaactccagccatggtttcccagtggaggtcgattctgacaccagcatcttccagctcaaggaggtggttgctaagcgacagggggttccggctgaccagttgcgtgtgattttcgcagggaaggagctgaggaatgactggactgtgcagcaggtagatcaatctacaacagcttttatgtgtattgcaaaggcccctgtcaaagagtgcagccgggaaaactcagggtacagtgcagcacctgcaggcaggcaacgctcaccttgacccagggtccatcttgctgggatgatgttttaattccaaaccggatgagtggtgaatgccaatccccacactgccctgggactagtgcagaatttttctttaaatgtggagcacaccccacctctgacaaggaaacatcagtagctttgcacctgatcgcaacaaatagtcggaacatcacttgcattacgtgcacagacgtcaggagccccgtcctggttttccagtgcaactcccgccacgtgatttgcttagactgtttccacttatactgtgtgacaagactcaatgatcggcagtttgttcacgaccctcaacttggctactccctgccttgtgtggctggctgtcccaactccttgattaaagagctccatcacttcaggattctgggagaagagcagtacaaccggtaccagcagtatggtgcagaggagtgtgtcctgcagatggggggcgtgttatgcccccgccctggctgtggagcggggctgctgccggagcctgaccagaggaaagtcacctgcgaagggggcaatggcctgggctgtgggtttgccttctgccgggaatgtaaagaagcgtaccatgaaggggagtgcagtgccgtatttgaagcctcaggaacaactactcaggcctacagagtcgatgaaagagccgccgagcaggctcgttgggaagcagcctccaaagaaaccatcaagaaaaccaccaagccctgtccccgctgccatgtaccagtggaaaaaaatggaggctgcatgcacatgaagtgtccgcagccccagtgcaggctcgagtggtgctggaactgtggctgcgagtggaaccgcgtctgcatgggggaccactggttcgacgtgtag

SEQ ID NO: 21657 - DNA, 794 bp, Homo sapiens
gacagggggttccggctgaccagttgcgtgtgattttcgcagggaaggagctgaggaatgactggactgtgcagaattgtgacctggatcagcagagcattgttcacattgtgcagagaccgtggagaaaaggtcaagaaatgaatgcaactggaggcgacgaccccagaaacgcggcgggaggctgtgagcgggagccccagagcttgactcgggtggacctcagcagctcagtcctcccaggagactctgtggggctggctgtcattctgcacactgacagcaggaaggactcaccaccagctggaagtccagcaggtagatcaatctacaacagcttttatgtgtattgcaaaggcccctgtcaaagagtgcagccgggaaaactcagggtacagtgcagcacctgcaggcaggcaacgctcaccttgacccagggtccatcttgctgggatgatgttttaattccaaaccggatgagtggtgaatgccaatccccacactgccctgggactagtgcagaatttttctttaaatgtggagcacaccccacctctgacaaggaaacatcagtagctttgcacctgatcgcaacaaatagtcggaacatcacttgcattacgtgcacagacgtcaggagccccgtcctggttttccagtgcaactcccgccacgtgatttgcttagactgtttccacttatactgtgtgacaagactcaatgatcggcagtttgttcacgaccctcaacttggctactccctgccttgtgtggtaagccttctgccttcacaa

SEQ ID NO: 21658 - DNA, 2514 bp, Homo sapiens
cctggaggatttaacccaggagagccgctggtgggaggcgcggctggcgccgctgcgcgcatgggcctgttcctggcccgcagccgccacctacccagtgaccatgatagtgtttgtcaggttcaactccagccatggtttcccagtggaggtcgattctgacaccagcatcttccagctcaaggaggtggttgctaagcgacagggggttccggctgaccagttgcgtgtgattttcgcagggaaggagctgaggaatgactggactgtgcaggaatttttctttaaatgtggagcacaccccacctctgacaaggaaacatcagtagctttgcacctgatcgcaacaaatagtcggaacatcacttgcattacgtgcacagacgtcaggagccccgtcctggttttccagtgcaactcccgccacgtgatttgcttagactgtttccacttatactgtgtgacaagactcaatgatcggcagtttgttcacgaccctcaacttggctactccctgccttgtgtggctggctgtcccaactccttgattaaagagctccatcacttcaggattctgggagaagagcagtacaaccggtaccagcagtatggtgcagaggagtgtgtcctgcagatggggggcgtgttatgcccccgccctggctgtggagcggggctgctgccggagcctgaccagaggaaagtcacctgcgaagggggcaatggcctgggctgtgggtttgccttctgccgggaatgtaaagaagcgtaccatgaaggggagtgcagtgccgtatttgaagcctcaggaacaactactcaggcctacagagtcgatgaaagagccgccgagcaggctcgttgggaagcagcctccaaagaaaccatcaagaaaaccaccaagccctgtccccgctgccatgtaccagtggaaaaaaatggaggctgcatgcacatgaagtgtccgcagccccagtgcaggctcgagtggtgctggaactgtggctgcgagtggaaccgcgtctgcatgggggaccactggttcgacgtgtagccagggcggccgggcgccccatcgccacatcctgggggagcatacccagtgtctaccttcattttctaattctcttttcaaacacacacacacacgcgcgcgcgcgcacacacactcttcaagtttttttcaaagtccaactacagccaaattgcagaagaaactcctggatccctttcactatgtccatgaaaaacagcagagtaaaattacagaagaagctcctgaatccctttcagtttgtccacacaagacagcagagccatctgcgacaccaccaacaggcgttctcagcctccggatgacacaaataccagagcacagattcaagtgcaatccatgtatctgtatgggtcattctcacctgaattcgagacaggcagaatcagtagctggagagagagttctcacatttaatatcctgccttttaccttcagtaaacaccatgaagatgccattgacaaggtgtttctctgtaaaatgaactgcagtgggttctccaaactagattcatggctttaacagtaatgttcttatttaaattttcagaaagcatctattcccaaagaaccccaggcaatagtcaaaaacatttgtttatccttaagaattccatctatataaatcgcattaatgaaataccaactatgcgtaaatcaacttgtcacaaagtgagaaattatgaaagttaatttgaatgttgaatgtttgaattacagggaagaaatcaagttaatgtactttcattccctttcatgatttgcaactttagaaagaaattgtttttctgaaagtatcaccaaaaaatctatagtttgattctgagtattcattttgcaacttggagattttgctaatacatttggctccactgtaaatttaatagataaagtgcctataaaggaaacacgtttagaaatgatttcaaaatgatattcaatcttaacaaaagtgaacattattaaatcagaatctttaaagaggagcctttccagaactaccaaaatgaagacacgcccgactctctccatcagaagggtttatacccctttggcacaccctctctgtccaatctgcaagtcccagggagctctgcataccaggggttccccaggagagaccttctcttaggacagtaaactcactagaatattccttatgttgacatggattggatttcagttcaatcaaactttcagcttttttttcagccattcacaacacaatcaaaagattaacaacactgcatgcggcaaaccgcatgctcttacccacactacgcagaagagaaagtacaaccactatcttttgttctacctgtattgtctgacttctcaggaagatcgtgaacataactgagggcatgagtctcactagcacatggaggcccttttggatttagagactgtaaattattaaatcggcaacagggcttctctttttagatgtagcactgaaa

SEQ ID NO: 21659 - DNA, 2877 bp, Homo sapiens
cctggaggatttaacccaggagagccgctggtgggaggcgcggctggcgccgctgcgcgcatgggcctgttcctggcccgcagccgccacctacccagtgaccatgatagtgtttgtcaggttcaactccagccatggtttcccagtggaggtcgattctgacaccagcatcttccagctcaaggaggtggttgctaagcgacagggggttccggctgaccagttgcgtgtgattttcgcagggaaggagctgaggaatgactggactgtgcagaattgtgacctggatcagcagagcattgttcacattgtgcagagaccgtggagaaaaggtcaagaaatgaatgcaactggaggcgacgaccccagaaacgcggcgggaggctgtgagcgggagccccagagcttgactcgggtggacctcagcagctcagtcctcccaggagactctgtggggctggctgtcattctgcacactgacagcaggaaggactcaccaccagctggaagtccagcaggtagatcaatctacaacagcttttatgtgtattgcaaaggcccctgtcaaagagtgcagccgggaaaactcagggtacagtgcagcacctgcaggcaggcaacgctcaccttgacccaggaatttttctttaaatgtggagcacaccccacctctgacaaggaaacatcagtagctttgcacctgatcgcaacaaatagtcggaacatcacttgcattacgtgcacagacgtcaggagccccgtcctggttttccagtgcaactcccgccacgtgatttgcttagactgtttccacttatactgtgtgacaagactcaatgatcggcagtttgttcacgaccctcaacttggctactccctgccttgtgtggctggctgtcccaactccttgattaaagagctccatcacttcaggattctgggagaagagcagtacaaccggtaccagcagtatggtgcagaggagtgtgtcctgcagatggggggcgtgttatgcccccgccctggctgtggagcggggctgctgccggagcctgaccagaggaaagtcacctgcgaagggggcaatggcctgggctgtgggtttgccttctgccgggaatgtaaagaagcgtaccatgaaggggagtgcagtgccgtatttgaagcctcaggaacaactactcaggcctacagagtcgatgaaagagccgccgagcaggctcgttgggaagcagcctccaaagaaaccatcaagaaaaccaccaagccctgtccccgctgccatgtaccagtggaaaaaaatggaggctgcatgcacatgaagtgtccgcagccccagtgcaggctcgagtggtgctggaactgtggctgcgagtggaaccgcgtctgcatgggggaccactggttcgacgtgtagccagggcggccgggcgccccatcgccacatcctgggggagcatacccagtgtctaccttcattttctaattctcttttcaaacacacacacacacgcgcgcgcgcgcacacacactcttcaagtttttttcaaagtccaactacagccaaattgcagaagaaactcctggatccctttcactatgtccatgaaaaacagcagagtaaaattacagaagaagctcctgaatccctttcagtttgtccacacaagacagcagagccatctgcgacaccaccaacaggcgttctcagcctccggatgacacaaataccagagcacagattcaagtgcaatccatgtatctgtatgggtcattctcacctgaattcgagacaggcagaatcagtagctggagagagagttctcacatttaatatcctgccttttaccttcagtaaacaccatgaagatgccattgacaaggtgtttctctgtaaaatgaactgcagtgggttctccaaactagattcatggctttaacagtaatgttcttatttaaattttcagaaagcatctattcccaaagaaccccaggcaatagtcaaaaacatttgtttatccttaagaattccatctatataaatcgcattaatgaaataccaactatgcgtaaatcaacttgtcacaaagtgagaaattatgaaagttaatttgaatgttgaatgtttgaattacagggaagaaatcaagttaatgtactttcattccctttcatgatttgcaactttagaaagaaattgtttttctgaaagtatcaccaaaaaatctatagtttgattctgagtattcattttgcaacttggagattttgctaatacatttggctccactgtaaatttaatagataaagtgcctataaaggaaacacgtttagaaatgatttcaaaatgatattcaatcttaacaaaagtgaacattattaaatcagaatctttaaagaggagcctttccagaactaccaaaatgaagacacgcccgactctctccatcagaagggtttatacccctttggcacaccctctctgtccaatctgcaagtcccagggagctctgcataccaggggttccccaggagagaccttctcttaggacagtaaactcactagaatattccttatgttgacatggattggatttcagttcaatcaaactttcagcttttttttcagccattcacaacacaatcaaaagattaacaacactgcatgcggcaaaccgcatgctcttacccacactacgcagaagagaaagtacaaccactatcttttgttctacctgtattgtctgacttctcaggaagatcgtgaacataactgagggcatgagtctcactagcacatggaggcccttttggatttagagactgtaaattattaaatcggcaacagggcttctctttttagatgtagcactgaaa

SEQ ID NO: 21660 - DNA, 4180 bp, Homo sapiens
cctggaggatttaacccaggagagccgctggtgggaggcgcggctggcgccgctgcgcgcatgggcctgttcctggcccgcagccgccacctacccagtgaccatgatagtgtttgtcaggttcaactccagccatggtttcccagtggaggtcgattctgacaccagcatcttccagctcaaggaggtggttgctaagcgacagggggttccggctgaccagttgcgtgtgattttcgcagggaaggagctgaggaatgactggactgtgcagaattgtgacctggatcagcagagcattgttcacattgtgcagagaccgtggagaaaaggtcaagaaatgaatgcaactggaggcgacgaccccagaaacgcggcgggaggctgtgagcgggagccccagagcttgactcgggtggacctcagcagctcagtcctcccaggagactctgtggggctggctgtcattctgcacactgacagcaggaaggactcaccaccagctggaagtccagcaggtagatcaatctacaacagcttttatgtgtattgcaaaggcccctgtcaaagagtgcagccgggaaaactcagggtacagtgcagcacctgcaggcaggcaacgctcaccttgacccagggtccatcttgctgggatgatgttttaattccaaaccggatgagtggtgaatgccaatccccacactgccctgggactagtgcagaatttttctttaaatgtggagcacaccccacctctgacaaggaaacatcagtagctttgcacctgatcgcaacaaatagtcggaacatcacttgcattacgtgcacagacgtcaggagccccgtcctggttttccagtgcaactcccgccacgtgatttgcttagactgtttccacttatactgtgtgacaagactcaatgatcggcagtttgttcacgaccctcaacttggctactccctgccttgtgtggctggctgtcccaactccttgattaaagagctccatcacttcaggattctgggagaagagcagtacaaccggtaccagcagtatggtgcagaggagtgtgtcctgcagatggggggcgtgttatgcccccgccctggctgtggagcggggctgctgccggagcctgaccagaggaaagtcacctgcgaagggggcaatggcctgggctgtgggtttgccttctgccgggaatgtaaagaagcgtaccatgaaggggagtgcagtgccgtatttgaagcctcaggaacaactactcaggcctacagagtcgatgaaagagccgccgagcaggctcgttgggaagcagcctccaaagaaaccatcaagaaaaccaccaagccctgtccccgctgccatgtaccagtggaaaaaaatggaggctgcatgcacatgaagtgtccgcagccccagtgcaggctcgagtggtgctggaactgtggctgcgagtggaaccgcgtctgcatgggggaccactggttcgacgtgtagccagggcggccgggcgccccatcgccacatcctgggggagcatacccagtgtctaccttcattttctaattctcttttcaaacacacacacacacgcgcgcgcgcgcacacacactcttcaagtttttttcaaagtccaactacagccaaattgcagaagaaactcctggatccctttcactatgtccatgaaaaacagcagagtaaaattacagaagaagctcctgaatccctttcagtttgtccacacaagacagcagagccatctgcgacaccaccaacaggcgttctcagcctccggatgacacaaataccagagcacagattcaagtgcaatccatgtatctgtatgggtcattctcacctgaattcgagacaggcagaatcagtagctggagagagagttctcacatttaatatcctgccttttaccttcagtaaacaccatgaagatgccattgacaaggtgtttctctgtaaaatgaactgcagtgggttctccaaactagattcatggctttaacagtaatgttcttatttaaattttcagaaagcatctattcccaaagaaccccaggcaatagtcaaaaacatttgtttatccttaagaattccatctatataaatcgcattaatgaaataccaactatgcgtaaatcaacttgtcacaaagtgagaaattatgaaagttaatttgaatgttgaatgtttgaattacagggaagaaatcaagttaatgtactttcattccctttcatgatttgcaactttagaaagaaattgtttttctgaaagtatcaccaaaaaatctatagtttgattctgagtattcattttgcaacttggagattttgctaatacatttggctccactgtaaatttaatagataaagtgcctataaaggaaacacgtttagaaatgatttcaaaatgatattcaatcttaacaaaagtgaacattattaaatcagaatctttaaagaggagcctttccagaactaccaaaatgaagacacgcccgactctctccatcagaagggtttatacccctttggcacaccctctctgtccaatctgcaagtcccagggagctctgcataccaggggttccccaggagagaccttctcttaggacagtaaactcactagaatattccttatgttgacatggattggatttcagttcaatcaaactttcagcttttttttcagccattcacaacacaatcaaaagattaacaacactgcatgcggcaaaccgcatgctcttacccacactacgcagaagagaaagtacaaccactatcttttgttctacctgtattgtctgacttctcaggaagatcgtgaacataactgagggcatgagtctcactagcacatggaggcccttttggatttagagactgtaaattattaaatcggcaacagggcttctctttttagatgtagcactgaaatccttgctggagggaagagaggggatgaactcaagttttccacatcctgggacacctgtccctcttttcctaactgcctaagataacccatttcttccaaccatctgaggacagtcccgtcgtctcagaggccctgcaccggggagagactgggctctgcagcagccacatcagcattcacagcttcatgtggcttcactgtctgaaaatctaccgactccaacatggccccacggtgacaacagacctgtgacaggaagcccaaagctcacatagaaatggtggacagatcaaagtctctatagtaagggaaaaaaagagaggtggcaggcatgagccccctgcacccagtggctcgtgtccatactgagtccagaccctgatcaaggcctgacttagtgtcactggcagtcccactaaattacacttccttacactggcccgatgcgacaaatcaggtggctcccttctgtcacgtggagcacacagtgttttccatcatccatagctttcttcctgatggtgtttgcattattgcgccttcccaatctgcatgctgcgttgggcttgcggtgcctgaacaaggtttgctcccatgagctcaggcaccctaggatcccctgttagactattaggctgtccagcatggtctcctttcccttcttggtggtggtcttttccctttccagaatagaacagtgattcttaaaataagttagagcaggccgggcgcggtggctcatgcctgtaatcccagcactttgggaggccgaggtgggtggatcacgaggtcaggagttcaagaccagcctggccaagatgatgaaaccccgtctctattaaaaatacaaaaattagctgggcgtggtggcaggcacctgtaatcccagcttcctgggaggctgaggcaggagaatcacttgaacccggggggcagaggttgcagtgagccgagatcacgccactgaactccagcctgggcaacagagtgagactctgtctcaaaaaaaaaaaaaaaacaaaaacaaaaaagcaagatcatccactacacatgaacatgaatcacagtattatttgcacaggaagggtgtaacaaaatatgaatgtatcaaaaaatagaaataaagtctttgcagaaaaagtctgtttttctctgaagtgtgttgagattatctgacaactctaagattgtacttaaattgtcaataaagcatcaaaa

SEQ ID NO: 21661 - DNA, 609 bp, Homo sapiens
atgagtggtgaatgccaatccccacactgccctgggactagtgcagaatttttctttaaatgtggagcacaccccacctctgacaaggaaacatcagtagctttgcacctgatcgcaacaaatagtcggaacatcacttgcattacgtgcacagacgtcaggagccccgtcctggttttccagtgcaactcccgccacgtgatttgcttagactgtttccacttatactgtgtgacaagactcaatgatcggcagtttgttcacgaccctcaacttggctactccctgccttgtgtggctggctgtcccaactccttgattaaagagctccatcacttcaggattctgggagaagagcagtacaaccggtaccagcagtatggtgcagaggagtgtgtcctgcagatggggggcgtgttatgcccccgccctggctgtggagcggggctgctgccggagcctgaccagaggaaagtcacctgcgaagggggcaatggcctgggctgtgggtttgccttctgccgggaatgtaaagaagcgtaccatgaaggggagtgcagtgccgtatttgaagcctcaggaacaactactcagcattcagggtgcacc

SEQ ID NO: 21662 - DNA, 426 bp, Homo sapiens
tcagtgtttgtcaggttcaactccagccatggtttcccagtggaggtcgattctgacaccagcatcttccagctcaaggaggtggttgctaagcgacagggggttccggctgaccagttgcgtgtgattttcgcagggaaggagctgaggaatgactggactgtgcagaattgtgacctggatcagcagagcattgttcacattgtgcagagaccgtggagaaaaggtcaagaaatgaatgcaactggaggcgacgaccccagaaacgcggcgggaggctgtgagcgggagccccagagcttgactcgggtggacctcagcagctcagtcctcccaggagactctgtggggctggctgtcattctgcacactgacagcaggaaggactcaccaccagctggaagtccaggtaattgtctgcatgga

SEQ ID NO: 21663 - DNA, 758 bp, Homo sapiens
gagtagttctcctgggtccgctctgcgggcttctgggagatgtagtttctggtctgtaggcaggacggaaggagcgggggaggccccttacgcaaactacaattcccggcggggagcgcggtgaagcgggggtgggatctgaacatggcggcggtggtagctgctacggcgctgaagggccggggggcgagaaatgcccgcgtcctccgggggattctcgcaggagccacagctaacaaggcttctcataacaggacccgggccctgcaaagccacagctccccagagggcaaggaggaacctgaacccctatccccggagctggaatacattcccagaaagaggggcaagaaccccatgaaagctgtgggactggcctgggccatcggcttcccttgtggtatcctcctcttcatcctcaccaagcgggaagtggacaaggaccgtgtgaagcagatgaaggctcggcagaacatgcggttgtccaacacgggcgagtatgagagccagaggttcagggcttcctcccagagtgccccgtcccctgatgttgggtctggggtgcagacctgaggagcgctgcgaccctcctaggctattgactgttaagtcctcaggtttggcccagattccagttcgtgcctctgaggtccaccagagggcgcatgaagcccaggctgttgccaaaccctaccctgccccacaccaaggagccagccaaaggcaaataaagttattgagtgtttagtagaaaggaa

SEQ ID NO: 21664 - DNA, 2991 bp, Homo sapiens
cagagccggcaggcaggttccccgcggggggccggggccgggccgttgcctagcaacgccgagccccgcccggccggcgcgtgcctgcccccagcatggcttggcagggctggcccgcggcgtggcagtgggtcgccggctgctggctcctcctcgtccttgtcctcgtcctacttgtgagcccccgcggctgccgagcgcggcggggcctccgcggtctgctcatggcgcacagccagcggctgctcttccgaatcgggtacagcctgtacacccgcacctggctcgggtacctcttctaccgacagcagctgcgcagggctcggaatcgctaccctaaaggccactcgaaaacccagccccgcctcttcaatggagtgaaggtgcttcccatccctgtcctctcggacaactacagctacctcatcatcgacacccaggcccagctggctgtggctgtggacccttcagaccctcgggctgtgcaggcttccattgaaaaggaaggggtcaccttggtcgccattctgtgtactcacaagcactgggaccacagtggagggaaccgtgacctcagccggcggcaccgggactgtcgggtgtacgggagccctcaggacggcatcccctacctcacccatcccctgtgtcatcaagatgtggtcagcgtgggacggcttcagatccgggccctggctacacctggccacacacaaggccatctggtctacctactggatggggagccctacaagggtccctcctgcctcttctcaggggacctgctcttcctctctggctgtgggcggacctttgagggcaatgcagagaccatgctgagctcactggacactgtgctggggctaggggatgacacccttctgtggcctggtcatgagtatgcagaggagaacctgggctttgcaggtgtggtggagcccgagaacctggcccgggagaggaagatgcagtgggtgcagcggcagcggctggagcgcaagggcacgtgcccatctaccctgggagaggagcgctcctacaacccgttcctgagaacccactgcctggcgctacaggaggctctggggccggggccgggccccactggggatgatgactactcccgggcccagctcctggaagagctccgccggctgaaggatatgcacaagagcaagtgatgcccccagcgcccccagcccagcccactccccgcatggggaggccgccaccaccaacacctcatcatccttctcatcgctaacaccaccacctccatcggcacccaagcgggcatcatccccccacactgctcaggggaggggagggatcaggcgatgagactgtgaggccaaaagaagggggcctgttggaggctgggaaccccgcagcgcgaggctgcctcatcaacggcaagaggaaaggaggggtctcgggacatctccagaccctaccaactgggagggtcccctcctccttccctactcctgggacggcagcaaggacatgggggctgctgttagcttctccgtcaggaggcctcatctcactgtagccctggaacccagggtccatcttgcccttcccccatccatggttgggaaagaagctcagcccctcacagtggcctcaagtgtgatgccttacaaaagcaccactcagatgggcagctggactctggtgtcctgagactctgccctcttcccacagcctccctgccccacccatccctgcaaagccatttttcagacagagccattcctaagaacactgaagggctggaatgctggctggccactctctgcctcagtggcctccctacagcctggaagaaggagggtcctgattgccaaggaaacctcctcattgggctaaggagacactggagtctggagtgtggagccccacagtcttgcaggtcacatgctctccttgcacatctggcctggttgtacccactggcctctgcctctgccctgggccaaaagggcccctccttgccaggggagagacagccacggtcctctttggccgatgctgtattctcattttggcccttgttcttaggcccgtctgcccgccttcctccatctaacctttcctgttttatccgcagcccttttcttctttgagttagtaaagatttattctgtaacctgacactcatctggccctttgcagtttgccagccatattcccatgtgatttcccactggatccaggcccccatccggctggcaggagggggctctgacgtgcaggttggaaatcagaagtctgtgagagcgcgggagtgcatggcagctctgggtcccagacctggcccgacccctctgcttcacctccagctctgctgctcctctactcttgggtcgagatccctttggagccacagcgaggaaccctgtggtcctcaggcaggtgtaccttgagtcagccaggagccctcttttcctgtgtcaaagcctgccctcgggctctgctcacctctggtgaccctccaagatgcccctgccctcagtttcccctcatgatctggcctctgcccccttctctagccacagcctctagtacactttagcaataccaccagactagttagagttccccactcaccaagcaagacatgcagtttcatgcctctgtgccttcgctcatgctgtttcttccgactggaatgccttcccctgctcctcctgccttgtctgcctggcaagttcatctctcacgatcccctcaaaggccccctcctccaggaaggcaacccctgtgcccctcccctccaggctacctctgcactttgtcaatgcttctcttgtggcacttatcacactgtattttacttgtttacatgtttgtctccccttctagactgtgaatccttaagggcatggactgtatcttatgcatctctgtatttctgcgcctagcacggtgcctagcacacagtaggcgctcaataaatgttgaatgaatgaatgatttaatcaa

SEQ ID NO: 21665 - DNA, 3021 bp, Homo sapiens
aaactacaattcccggcggggagcgcggtgaagcgggggtgggatctgaacatggcggcggtggtagctgctacggcgctgaagggccggggggcgagaaatgcccgcgtcctccgggggattctcgcaggagccacagctaacaaggcttctcataacaggacccgggccctgcaaagccacagctccccagagggcaaggaggaacctgaacccctatccccggagctggaatacattcccagaaagaggggcaagaaccccatgaaagctgtgggactggcctggtacagcctgtacacccgcacctggctcgggtacctcttctaccgacagcagctgcgcagggctcggaatcgctaccctaaaggccactcgaaaacccagccccgcctcttcaatggagtgaaggtgcttcccatccctgtcctctcggacaactacagctacctcatcatcgacacccaggcccagctggctgtggctgtggacccttcagaccctcgggctgtgcaggcttccattgaaaaggaaggggtcaccttggtcgccattctgtgtactcacaagcactgggaccacagtggagggaaccgtgacctcagccggcggcaccgggactgtcgggtgtacgggagccctcaggacggcatcccctacctcacccatcccctgtgtcatcaagatgtggtcagcgtgggacggcttcagatccgggccctggctacacctggccacacacaaggccatctggtctacctactggatggggagccctacaagggtccctcctgcctcttctcaggggacctgctcttcctctctggctgtgggcggacctttgagggcaatgcagagaccatgctgagctcactggacactgtgctggggctaggggatgacacccttctgtggcctggtcatgagtatgcagaggagaacctgggctttgcaggtgtggtggagcccgagaacctggcccgggagaggaagatgcagtgggtgcagcggcagcggctggagcgcaagggcacgtgcccatctaccctgggagaggagcgctcctacaacccgttcctgagaacccactgcctggcgctacaggaggctctggggccggggccgggccccactggggatgatgactactcccgggcccagctcctggaagagctccgccggctgaaggatatgcacaagagcaagtgatgcccccagcgcccccagcccagcccactccccgcatggggaggccgccaccaccaacacctcatcatccttctcatcgctaacaccaccacctccatcggcacccaagcgggcatcatccccccacactgctcaggggaggggagggatcaggcgatgagactgtgaggccaaaagaagggggcctgttggaggctgggaaccccgcagcgcgaggctgcctcatcaacggcaagaggaaaggaggggtctcgggacatctccagaccctaccaactgggagggtcccctcctccttccctactcctgggacggcagcaaggacatgggggctgctgttagcttctccgtcaggaggcctcatctcactgtagccctggaacccagggtccatcttgcccttcccccatccatggttgggaaagaagctcagcccctcacagtggcctcaagtgtgatgccttacaaaagcaccactcagatgggcagctggactctggtgtcctgagactctgccctcttcccacagcctccctgccccacccatccctgcaaagccatttttcagacagagccattcctaagaacactgaagggctggaatgctggctggccactctctgcctcagtggcctccctacagcctggaagaaggagggtcctgattgccaaggaaacctcctcattgggctaaggagacactggagtctggagtgtggagccccacagtcttgcaggtcacatgctctccttgcacatctggcctggttgtacccactggcctctgcctctgccctgggccaaaagggcccctccttgccaggggagagacagccacggtcctctttggccgatgctgtattctcattttggcccttgttcttaggcccgtctgcccgccttcctccatctaacctttcctgttttatccgcagcccttttcttctttgagttagtaaagatttattctgtaacctgacactcatctggccctttgcagtttgccagccatattcccatgtgatttcccactggatccaggcccccatccggctggcaggagggggctctgacgtgcaggttggaaatcagaagtctgtgagagcgcgggagtgcatggcagctctgggtcccagacctggcccgacccctctgcttcacctccagctctgctgctcctctactcttgggtcgagatccctttggagccacagcgaggaaccctgtggtcctcaggcaggtgtaccttgagtcagccaggagccctcttttcctgtgtcaaagcctgccctcgggctctgctcacctctggtgaccctccaagatgcccctgccctcagtttcccctcatgatctggcctctgcccccttctctagccacagcctctagtacactttagcaataccaccagactagttagagttccccactcaccaagcaagacatgcagtttcatgcctctgtgccttcgctcatgctgtttcttccgactggaatgccttcccctgctcctcctgccttgtctgcctggcaagttcatctctcacgatcccctcaaaggccccctcctccaggaaggcaacccctgtgcccctcccctccaggctacctctgcactttgtcaatgcttctcttgtggcacttatcacactgtattttacttgtttacatgtttgtctccccttctagactgtgaatccttaagggcatggactgtatcttatgcatctctgtatttctgcgcctagcacggtgcctagcacacagtaggcgctcaataaatgttgaatgaatgaatgatttaatcaaga

SEQ ID NO: 21666 - DNA, 595 bp, Homo sapiens
accagcccagcctttcagtgcaggctccagccctccacccccacccgagttgcaggatgtcgatgacagacttgctgaacgctgaggacatcaagaaggcggtgggagcctttagcgctaccgactccttcgaccacaaaaagttcttccaaatggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacgaattctccactctggtggctgaaagctaagaagcactgactgcccctggtcttccacctctctgccctgaacacccaatctcggcccctctcgccaccctcctgcatttctgttcagttcgtttatgttattttttactcccccatcccctgtggccctctaatgacaccattcttctggaaaatgctggagaagcaataaaggttgtaccagtcagactctgcttgctcaggaa

SEQ ID NO: 21667 - DNA, 422 bp, Homo sapiens
ccgggctccctcagccctccaatggagctaccgactccttcgaccacaaaaagttcttccaaatggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacgaattctccactctggtggctgaaagctaagaagcactgactgcccctggtcttccacctctctgccctgaacacccaatctcggcccctctcgccaccctcctgcatttctgttcagttcgtttatgttattttttactcccccatcccctg

SEQ ID NO: 21668 - DNA, 569 bp, Homo sapiens
acttgctctgcccgctcaaacagttgcaggatgtcgatgacagacttgctgaacgctgaggacatcaagaaggcggtgggagcctttagcgctaccgactccttcgaccacaaaaagttcttccaaatggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacgaattctccactctggtggctgaaagctaagaagcactgactgcccctggtcttccacctctctgccctgaacacccaatctcggcccctctcgccaccctcctgcatttctgttcagttcgtttatgttattttttactcccccatcccctgtggccctctaatgacaccattcttctggaaaatgctggagaagcaataaaggttgtaccagtcagactctgcttgctcaggaa

SEQ ID NO: 21669 - DNA, 470 bp, Homo sapiens
aggctgaggtaggagtggagagagaaagggagcagggcctaggaggtcctgaggtgcaggctggccgctgaaggttcaggatcttcccccacgcggcaggacatccgccaaggttcccagatctgagacggcgcacctcctgcgtgtccttgacggcagttgcaggatgtcgatgacagacttgctgaacgctgaggacatcaagaaggcggtgggagcctttagcgctaccgactccttcgaccacaaaaagttcttccaaatggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacg

SEQ ID NO: 21670 - DNA, 1591 bp, Homo sapiens
ctgccacgtccctatatgaacggggtgtgtgcccgcctgccctccgacgtccgccggctgtgctggtctgcagagctgccgccagctgcaccctcctcgccatgagtgacctgcaggaagaaggcaagaatgccatcaactcaccgatgtcccccgccctggtggatgttcaccctgaagacacccagcttgaggagaacgaggagcgcacgatgattgaccccacttccaaggaagaccccaagttcaaggaactggtcaaggtcctcctcgactggattaatgacgtgctggtggaggagaggatcattgtgaagcagctggaggaagacctgtatgacggccaggtgctgcagaagctcttggaaaaactggcagggtgcaagctgaatgtggctgaggtgacacagtccgaaatagggcagaaacagaagctgcagacggtgctggaagcagtacatgacctgctgcggccccgaggctgggcgctccggtggagcgtggactcaattcacgggaagaacctggtggccatcctccacctgctggtctctctggccatgcacttcagggcccccatccgccttcctgagcatgtaacggtgcaggtggtggtcgtgcggaaacgggaaggcctgctgcattccagccacatctcggaggagctgaccacaactacagagatgatgatgggccggttcgagcgggatgccttcgacacgctgttcgaccacgccccggataagctcagcgtggtgaagaagtctctcatcacttttgtgaacaagcacctgaacaagctgaatttggaggtgacggaactggagacccagtttgcagatggcgtgtacctggttctgctcatgggccttctggaagactactttgttcctctccaccacttctacctgactccggaaagcttcgatcagaaggtccacaatgtgtccttcgcctttgagctgatgctggacggaggcctcaagaaacccaaggctcgtcctgaagacgtggttaacttggacctcaaatccaccctgagggttctttacaacctgttcaccaagtacaagaacgtggagtgacgggggagctgtggatggtggcaggagtgtcccagcaagaaaggcggcatccgtctgtgccctgtgcctttccagggagccaggcgccatgggcttctggtccaagctgtgttgactgtcatccccaccccacccctacctcacgcctgccccaccccctgcctcttttggttgttgttcttaatctcctctccatgtagttcccagtgggcaagagcctttgaaaatgcaggattctaaacactcgtgcttgcgtttgaagcctcgcgtcactcagtcgcgtgggatgatgagtccgttgttgtctgccttggccgaaagatgaaaaaaagcctgaaccccaacccccagctggttgagagcaccctgcattctgcctcatggtgcagttagcgatcacaggccttcagaagtacaacatcagctcagcaggaacgccggctccccgaggacccaggcttgacgattcaccggggatctcctgggctgggctctccttggaagtg

SEQ ID NO: 21671 - DNA, 4458 bp, Homo sapiens
acaggcagtagtgctggggcagagcgagctcaccagccgccggctggaagaccccgggagagtagcagggttgggttggttctcagatgtgttttgcgccaggctgtgtggtggggacagagcctgggtaaatgaagctttccggctcgaccgctcccaacctgggcacacacgtcctcctgtcctgcaaggggcagttttggggcatcctccctgcttggggcaacccaggggcgcaaggcgcggccccgggagcgcagctccttccagggcagagggcggcgcgagggagggagcgagggagggagcgagggaagggaaaggcgagcgtgagctgcctcaaatgcttggaataattccgcttccgtttggaaagccgcagcctcagtcccgccgccgcccgctgcgtccgcccagcgccagctccgcgtcccgaccggcccgcggcagcctgcgccgcgccatggccacctccccgcagaagtcgccttctgtccccaagtctcccactcccaagtcgcccccgtcccgcaagaaagatgattccttcttggggaaactcggagggaccctggcccggaggaagaaagccaaggaggtgtccgagctgcaggaggagggaatgaacgccatcaacctgcccctcagcccaattccctttgagctggaccccgaggacacgatgctggaggagaatgaggtgcgaacaatggtggatccaaactcacgcagtgaccccaagcttcaagaactgatgaaggtattaattgactggattaatgatgtgttggttggagaaagaatcattgtgaaagacctagctgaagatttgtatgatggacaagtcctgcagaagcttttcgagaaactggagagtgagaagctaaatgtggctgaggtcacccagtcagagattgctcagaagcaaaaactgcagactgtcctggagaagatcaatgaaaccctgaaacttcctcccaggagcatcaagtggaatgtggattctgttcatgccaagagcctggtggccatcttacacctgctcgttgctctgtctcagtatttccgcgcaccaattcgactcccagaccatgtttccatccaagtggttgtggtccagaaacgagaaggaatcctccagtctcggcaaatccaagaggaaataactggtaacacagaggctctttccgggaggcatgaacgtgatgcctttgacaccttgttcgaccatgccccagacaagctgaatgtggtgaaaaagacactcatcactttcgtgaacaagcacctgaataaactgaacctggaggtcacagaactggaaacccagtttgcagatggggtgtacctggtgctgctcatggggctcctggagggctactttgtgcccctgcacagcttcttcctgaccccggacagctttgaacagaaggtcttgaatgtctcctttgcctttgagctcatgcaagatggagggttggaaaagccaaaaccgcggccagaagacatagtcaactgtgacctgaaatctacactacgagtgttgtacaacctcttcaccaagtaccgtaacgtggagtgaggggctgccctgggcccaccactgcccaagagttcttgctgttggcgtactggaccctcctccgaactgccttaccctgcttattcctgtctcttgcactgtgctctcccacaagtccagctgcaacccagagatagtggaaactgaaattaggaaggaaatcatcaataactcagtgggctgacccatccctcccaggcgctggggaccaacctagcaatgaaggttgggaaggttgttcccttcccggtgccaggtccagatttccctccatgatttgggaaccagcttaggcaaaagagtccccacaagatgaaaataaagatcctagttaccattcaaaggatgctaactgtgtgtcaggccccacactaagtgctctgctctgatatactcaaggccattaatcttcaggactcccattgacgtaggtgtttcattccccttttacagatgaggaaactaaggcttggaggttaaatgacttgccagaagttggaatttttttcctctttgaacataacctctcccttctccctaaaggtaaccactattctgagtccaatcatcaaggttttgcttttctttttagctaagtatgcattcctcaatagtagacagtacaacatgtttataacaagccaattacattatgttctttgcatgttctaaagttgtgtatgtgtgtgcacatctgagcacgtgcacatgtacacctgagccaaaaacacgagaacccactgatctcaccactggggcaagctaggtcagagcttagtgattcacactgaaattggcaaattggatttaacccaattaatagtgtgtgtgtggcaggagtcatgtccctcacatcctttgtacaaatgaaaattactcttaattccttcagatttataataactctgtactttggtttcagggtgacatttgggaaggattttgtttagaattaatggagtggcacattttgcagcctttttgcttgattgcatgtaatggaaatgccctatattttcctgcaaaataagtactaaattcattatcgttaagcaaatgtacaatatgctcaggcaccgcagagagctgggcacgggcccatgtgagcatcactttggaagtagggctcttcaacagggacccttgaactttaaagaaaggaacttctttttgccttctaattgatcatttagactattctggctaagtctgcccacatgtaattaccggctaattcaagcgaggaaaaatgtaagtcatttagaccaaagccaagcagtttctttgcgtgggttactcaagggcttgtggttacttgtatctcctctatgtgaacttgactttgaaagacagagctctagtgtgccagcctgctaagtcctgtaagaatagggaagggcggaggggggtgggcagtgactaggggacgagaagcatggggaaaatatttgcactctaaacatacagagatagaggtggggcttgtggtacttaacacttgtagccatcaactgactgagaccttgggctaaataatcaattgtgctgatattacatctcgttatggaatgttcctaaatatgccaggtagacaccagcccaagtaccctcctccagaagtctgtgactaccttgtcactactttaggcccattccacaaagcccatctctggtttgagaattcattttgatctgtatctacaccacccaaagttaggcctcctataatgtccaaaacattcctttcagcctttttatttcttactgtactgtctcttactgtactgtctatctgcagtaattgaggacccataaaatttagataactacatgtctttgctcttagaattgtcactcagcataatgagcatttaacatacaaaggcaatgtactgttttgtgttgatctatgtaaaagaatacaattcttttttacataattagtgaaattttattttttattaggaaacactaaatagtgtaatatttcttttgcttttaaaaaaattcctggtagcaaatcaagataaataattgcttcattttcttgagcaatactgaagcaggatgaagtaagaggaatgcattcatttaaacatgctttgctttatgaattttgtctcttttttggtctctttttcttatattcaagttacaaatgtacaagtatccttactaagagtgctccttttgtattttacatatatacagtatgaaaatacattggaacactaggaaagtttttaaataacagttctaatttatcagaaaattgtgttttgggattgagttctttgtctcagcccagaatcccaggtcctgggcctggttttctaatgctgtcatctcagttcgatattttactttagaacctggaatctcctacttaatatatgaccatgactttgaaaggcaaaagaggaatcaagaataaataaaacaaacttaatcttcatctttaaaaaaaagaaaaaagaaaccaaaatgagaatcaacacttcataggctcactgggttttcttttcttttctgttaatttaaactcagttatttttaatgcttaatacatacatggtgcaaaatttaaaaagcgcaaataggtatctagtggaaaacctaagcctccctctctcctccggcacccattacctctccctggaggcaactgttttgatccatttcttacacacactgccagagatactctaggcatgtaaagcacaaacatacatataaaatctgcgggcttcaaaaaatataagtaggatgtcatctatactgtcatacactttgttttttatcacttaatgttatatcttggatattgtattaccctgggtattaaaaagaactcctttcacattttaaaataacaa

SEQ ID NO: 21672 - DNA, 1219 bp, Homo sapiens
acattccaagagctgccctccttgggacttagatcactccctgagaacaacaccccaaccaggctgcggaggaagaccagctgctgtttgctggcctgcatgacagggaccagtgtccgagctgcaggaggagggaatgaacgccatcaacctgcccctcagcccaattccctttgagctggaccccgaggacacgatgctggaggagaatgaggtgcgaacaatggtggatccaaactcacgcagtgaccccaagcttcaagaactgatgaaggtattaattgactggattaatgatgtgttggttggagaaagaatcattgtgaaagacctagctgaagatttgtatgatggacaagtcctgcagaagcttttcgagaaactggagagtgagaagctaaatgtggctgaggtcacccagtcagagattgctcagaagcaaaaactgcagactgtcctggagaagatcaatgaaaccctgaaacttcctcccaggagcatcaagtggaatgtggattctgttcatgccaagagcctggtggccatcttacacctgctcgttgctctgtctcagtatttccgcgcaccaattcgactcccagaccatgtttccatccaagtggttgtggtccagaaacgagaaggaatcctccagtctcggcaaatccaagaggaaataactggtaacacagaggctctttccgggaggcatgaacgtgatgcctttgacaccttgttcgaccatgccccagacaagctgaatgtggtgaaaaaggtgggaaaggggtgcctgggatggacagagggaagcgagatgcaacagaacattgggaaaacccatccctgcagcttgcgagcttcctgccagaactggtggcatcacctaacctctgcacacacagggctttcccccttgccatccatgtacctgtctgttcctcactggatgttgcacctgggccttttcccctccatcagcatgaacagcctgtcttcccacccaggctaaccccagcaatctcagccttccccactcctcacagaattccctgtctccctggcctaggcacctgtgccgaagaagggacaggaaggagagatccagtggaatcattttatttcagttcccccacccagacactggctcagacactccacctatcattctgcctcttgggacctccttgttccttacacgccctgagttgtatgggactgc

SEQ ID NO: 21673 - DNA, 1544 bp, Homo sapiens
gcagcctcagtcccgccgccgcccgctgcgtccgcccagcgccagctccgcgtcccgaccggcccgcggcagcctgcgccgcgccatggccacctccccgcagaagtcgccttctgtccccaagtctcccactcccaagtcgcccccgtcccgcaagaaagatgattccttcttggggaaactcggagggaccctggcccggaggaagaaagccaaggaggtgtccgagctgcaggaggagggaatgaacgccatcaacctgcccctcagcccaattccctttgagctggaccccgaggacacgatgctggaggagaatgaggtgcgaacaatggtggatccaaactcacgcagtgaccccaagcttcaagaactgatgaaggtattaattgactggattaatgatgtgttggttggagaaagaatcattgtgaaagacctagctgaagatttgtatgatggacaagtcctgcagaagcttttcgagaaactggagagtgagaagctaaatgtggctgaggtcacccagtcagagattgctcagaagcaaaaactgcagactgtcctggagaagatcaatgaaaccctgaaacttcctcccaggagcatcaagtggaatgtggattctgttcatgccaagagcctggtggccatcttacacctgctcgttgctctgtctcagtatttccgcgcaccaattcgactcccagaccatgtttccatccaagtggttgtggtccagaaacgagaaggaatcctccagtctcggcaaatccaagaggaaataactggtaacacagagtatgtcagttcccggcacaaacgtgatgcctttgacaccttgttcgaccatgccccagacaagctgaatgtggtgaaaaagacactcatcactttcgtgaacaagcacctgaataaactgaacctggaggtcacagaactggaaacccagtttgcagatggggtgtacctggtgctgctcatggggctcctggagggctactttgtgcccctgcacagcttcttcctgaccccggacagctttgaacagaaggtcttgaatgtctcctttgcctttgagctcatgcaagatggagggttggaaaagccaaaaccgcggccagaagacatagtcaactgtgacctgaaatctacactacgagtgttgtacaacctcttcaccaagtaccgtaacgtggagtgaggggctgccctgggcccaccactgcccaagagttcttgctgttggcgtactggaccctcctccgaactgccttaccctgcttattcctgtctcttgcactgtgctctcccacaagtccagctgcaacccagagatagtggaaactgaaattaggaaggaaatcatcaataactcagtgggctgacccatccctcccaggcgctggggaccaacctagcaatgaaggttgggaaggttgttcccttcccggtgccaggtccagatttccctccatgatttgggaaccagcttaggcaaaagagtccccacaagatgaaaataaagatcctagttaccattc

SEQ ID NO: 21674 - DNA, 3106 bp, Homo sapiens
cagcgccagctccgcgtcccgaccggcccgcggcagcctgcgccgcgccatggccacctccccgcagaagtcgccttctgtccccaagtctcccactcccaagtcgcccccgtcccgcaagaaagatgattccttcttggggaaactcggagggaccctggcccggaggaagaaagccaaggaggtgtccgagctgcaggaggagggaatgaacgccatcaacctgcccctcagcccaattccctttgagctggaccccgaggacacgatgctggaggagaatgaggtgcgaacaatggtggatccaaactcacgcagtgaccccaagcttcaagaactgatgaaggtattaattgactggattaatgatgtgttggttggagaaagaatcattgtgaaagacctagctgaagatttgtatgatggacaagtcctgcagaagcttttcgagaaactggagagtgagaagctaaatgtggctgaggtcacccagtcagagattgctcagaagcaaaaactgcagactgtcctggagaagatcaatgaaaccctgaaacttcctcccaggagcatcaagtggaatgtggattctgttcatgccaagagcctggtggccatcttacacctgctcgttgctctgtctcagtatttccgcgcaccaattcgactcccagaccatgtttccatccaagtggttgtggtccagaaacgagaaggaatcctccagtctcggcaaatccaagaggaaataactggtaacacagaggctctttccgggaggcatgaacgtgatgcctttgacaccttgttcgaccatgccccagacaagctgaatgtggtgaaaaagacactcatcactttcgtgaacaagcacctgaataaactgaacctggaggtcacagaactggaaacccagtttgcagatggggtgtacctggtgctgctcatggggctcctggagggctactttgtgcccctgcacagcttcttcctgaccccggacagctttgaacagaaggtcttgaatgtctcctttgcctttgagctcatgcaagatggagggttggaaaagccaaaaccgcggccagaagacatagtcaactgtgacctgaaatctacactacgagtgttgtacaacctcttcaccaagtaccgtaacgtggagtgaggggctgccctgggcccaccactgcccaagagttcttgctgttggcgtactggaccctcctccgaactgccttaccctgcttattcctgtctcttgcactgtgctctcccacaagtccagctgcaacccagagatagtggaaactgaaattaggaaggaaatcatcaataactcagtgggctgacccatccctcccaggcgctggggaccaacctagcaatgaaggttgggaaggttgttcccttcccggtgccaggtccagatttccctccatgatttgggaaccagcttaggcaaaagagtccccacaagatgaaaataaagatcctagttaccattcaaaggatgctaactgtgtgtcaggccccacactaagtgctctgctctgatatactcaaggccattaatcttcaggactcccattgacgtaggtgtttcattccccttttacagatgaggaaactaaggcttggaggttaaatgacttgccagaagttggaatttttttcctctttgaacataacctctcccttctccctaaaggtaaccactattctgagtccaatcatcaaggttttgcttttctttttagctaagtatgcattcctcaatagtagacagtacaacatgtttataacaagccaattacattatgttctttgcatgttctaaagttgtgtatgtgtgtgcacatctgagcacgtgcacatgtacacctgagccaaaaacacgagaacccactgatctcaccactggggcaagctaggtcagagcttagtgattcacactgaaattggcaaattggatttaacccaattaatagtgtgtgtgtggcaggagtcatgtccctcacatcctttgtacaaatgaaaattactcttaattccttcagatttataataactctgtactttggtttcagggtgacatttgggaaggattttgtttagaattaatggagtggcacattttgcagcctttttgcttgattgcatgtaatggaaatgccctatattttcctgcaaaataagtactaaattcattatcgttaagcaaatgtacaatatgctcaggcaccgcagagagctgggcacgggcccatgtgagcatcactttggaagtagggctcttcaacagggacccttgaactttaaagaaaggaacttctttttgccttctaattgatcatttagactattctggctaagtctgcccacatgtaattaccggctaattcaagcgaggaaaaatgtaagtcatttagaccaaagccaagcagtttctttgcgtgggttactcaagggcttgtggttacttgtatctcctctatgtgaacttgactttgaaagacagagctctagtgtgccagcctgctaagtcctgtaagaatagggaagggcggaggggggtgggcagtgactaggggacgagaagcatggggaaaatatttgcactctaaacatacagagatagaggtggggcttgtggtacttaacacttgtagccatcaactgactgagaccttgggctaaataatcaattgtgctgatattacatctcgttatggaatgttcctaaatatgccaggtagacaccagcccaagtaccctcctccagaagtctgtgactaccttgtcactactttaggcccattccacaaagcccatctctggtttgagaattcattttgatctgtatctacaccacccaaagttaggcctcctataatgtccaaaacattcctttcagcctttttatttcttactgtactgtctcttactgtactgtctatctgcagtaattgaggacccataaaatttagataactacatgtctttgctcttagaattgtcactcagcataatgagcatttaacatacaaaggcaatgtactgttttgtgttgatctatgtaaaagaatacaattcttttttacat

SEQ ID NO: 21675 - DNA, 1706 bp, Homo sapiens
ctccccggggcgaccgggcggctccacacgcgctgcgcccgccgccggccccacgcgcggcccatgtcctccgcgccgcgctcgcccaccccgcggccccgcaggatgaagaaggacgagtcgttcctgggcaagctgggcggcaccctggccaggaagcggagggcgcgcgaggtgagtgacctgcaggaagaaggcaagaatgccatcaactcaccgatgtcccccgccctggtggatgttcaccctgaagacacccagcttgaggagaacgaggagcgcacgatgattgaccccacttccaaggaagaccccaagttcaaggaactggtcaaggtcctcctcgactggattaatgacgtgctggtggaggagaggatcattgtgaagcagctggaggaagacctgtatgacggccaggtgctgcagaagctcttggaaaaactggcagggtgcaagctgaatgtggctgaggtgacacagtccgaaatagggcagaaacagaagctgcagacggtgctggaagcagtacatgacctgctgcggccccgaggctgggcgctccggtggagcgtggactcaattcacgggaagaacctggtggccatcctccacctgctggtctctctggccatgcacttcagggcccccatccgccttcctgagcatgtaacggtgcaggtggtggtcgtgcggaaacgggaaggcctgctgcattccagccacatctcggaggagctgaccacaactacagagatgatgatgggccggttcgagcgggatgccttcgacacgctgttcgaccacgccccggataagctcagcgtggtgaagaagtctctcatcacttttgtgaacaagcacctgaacaagctgaatttggaggtgacggaactggagacccagtttgcagatggcgtgtacctggttctgctcatgggccttctggaagactactttgttcctctccaccacttctacctgactccggaaagcttcgatcagaaggtccacaatgtgtccttcgcctttgagctgatgctggacggaggcctcaagaaacccaaggctcgtcctgaagacgtggttaacttggacctcaaatccaccctgagggttctttacaacctgttcaccaagtacaagaacgtggagtgacgggggagctgtggatggtggcaggagtgtcccagcaagaaaggcggcatccgtctgtgccctgtgcctttccagggagccaggcgccatgggcttctggtccaagctgtgttgactgtcatccccaccccacccctacctcacgcctgccccaccccctgcctcttttggttgttgttcttaatctcctctccatgtagttcccagtgggcaagagcctttgaaaatgcaggattctaaacactcgtgcttgcgtttgaagcctcgcgtcactcagtcgcgtgggatgatgagtccgttgttgtctgccttggccgaaagatgaaaaaaagcctgaaccccaacccccagctggttgagagcaccctgcattctgcctcatggtgcagttagcgatcacaggccttcagaagtacaacatcagctcagcaggaacgccggctccccgaggacccaggcttgacgattcaccggggatctcctgggctgggctctccttggaagtgaggccttttattaaaaataaaagggttttgcagtttgaaaaa

SEQ ID NO: 21676 - DNA, 1569 bp, Homo sapiens
caaaggccctacactttgacgtcctccccatctccggcagctccttaaactaagaactcattttaatttctgaattctccctttttaaagaccagataaatttacctttgggacagttagatgtgcacaaatgcaccatgtgtttaaagatcaccaaagaggagagaaaaggggattccttagtccagagaacaaaaactgcaggaggctggagctgagacgtgggtgttcctgcagctggggcctgtgctcccaggcactcatggcttctctggctggttcacttctccctggctcagacagatcaggagtggaaacatctgaatatgctcaaggaggagtgagtgacctgcaggaagaaggcaagaatgccatcaactcaccgatgtcccccgccctggtggatgttcaccctgaagacacccagcttgaggagaacgaggagcgcacgatgattgaccccacttccaaggaagaccccaagttcaaggaactggtcaaggtcctcctcgactggattaatgacgtgctggtggaggagaggatcattgtgaagcagctggaggaagacctgtatgacggccaggtgctgcagaagctcttggaaaaactggcagggtgcaagctgaatgtggctgaggtgacacagtccgaaatagggcagaaacagaagctgcagacggtgctggaagcagtacatgacctgctgcggccccgaggctgggcgctccggtggagcgtggactcaattcacgggaagaacctggtggccatcctccacctgctggtctctctggccatgcacttcagggcccccatccgccttcctgagcatgtaacggtgcaggtggtggtcgtgcggaaacgggaaggcctgctgcattccagccacatctcggaggagctgaccacaactacagagatgatgatgggccggttcgagcgggatgccttcgacacgctgttcgaccacgccccggataagctcagcgtggtgaagaagtctctcatcacttttgtgaacaagcacctgaacaagctgaatttggaggtgacggaactggagacccagtttgcagatggcgtgtacctggttctgctcatgggccttctggaagactactttgttcctctccaccacttctacctgactccggaaagcttcgatcagaaggtccacaatgtgtccttcgcctttgagctgatgctggacggaggcctcaagaaacccaaggctcgtcctgaagacgtggttaacttggacctcaaatccaccctgagggttctttacaacctgttcaccaagtacaagaacgtggagtgacgggggagctgtggatggtggcaggagtgtcccagcaagaaaggcggcatccgtctgtgccctgtgcctttccagggagccaggcgccatgggcttctggtccaagctgtgttgactgtcatccccaccccacccctacctcacgcctgccccaccccctgcctcttttggttgttgttcttaatctcctctccatgtagttcccagtgggcaagagcctttgaaaatgcaggattctaaacact

SEQ ID NO: 21677 - DNA, 1967 bp, Homo sapiens
gtctcctgcgtggtcccgggagaggaaggggcctggcccggggcggggtgtggagagaggaggaagctcctgccggctgagcgggcctggaggaagtgagcagcggggctcctgcctcccggcctggtccccgaagaccccagaagaacccggaacttgcttccattcggaatccagggaccaccctttgcactcagtaggcctttgttttcctgcgtggaaagcggttgggcttgggaggcgatggagccggagttcttgtacgacctgctgcagctccccaagggggtggagcccccagcggaggaggagctctcaaaaggaggaaagaagaaatacctgccacccacttcccggaaggaccccaaatttgaagaactgcagaaggtgttgatggagtggatcaatgccactcttctccccgagcacattgtggtccgcagcctggaggaggacatgttcgacgggctcatcctacaccacctattccagaggctggcggcgctcaagctggaagcagaggacatcgccctgacagccacaagccagaagcacaagctcacagtggtgctggaggccgtgaaccggagtctgcagctggaggagtggcaggccaagtggagcgtggagagcatcttcaacaaggacctgttgtctaccctgcacctccttgtggccctggccaagcgcttccagcccgacctctccctcccaaccaacgtccaggtggaggtcatcactatcgagagcaccaaaagtggtctgaagtcagagaagttggtggaacagctcactgaatacagcacagacaaggacgagcctccaaaggacgtctttgatgaattatttaagctggctccggagaaagtgaacgcagtgaaagaggccatcgtgaactttgtcaaccagaagctggaccgcctgggcctgtctgtgcagaatctggacacccagtttgcagatggggtcatcttactcttgctgattggacaacttgaaggcttcttcctgcacttaaaggaattctacctcactcccaactctcctgcagaaatgctgcacaacgtcaccctggcgctggagctgctgaaggacgagggcctgctcagctgccctgtcagccctgaagatatcgtgaacaaggatgccaagagcacactgagggtgctctatggtctgttctgcaagcacacgcagaaggcacacagggacaggacgccccatggagccccgaattgaccctcactgcctccaaagcccagagcctgcctgtcagcccagctggagggcccgaggctgcagggtgtcctcccacagtcccgctgtttcctgtgcattcgtgacccgcttccctcccaccctgtctcctgtctccatcgttggattatctttgaacccccttgtgtggatcattttgagccgcctggccttgctcagtttattttaataaaagtatttctgggagggattctgggaacttgacagggtcctgaggagggcccttaaacctgcagcctccctcccatggggtgagtgtgtgtcacatcagtctctcatctctgggcccaggctagtgaccgcccagagaggtggcatcactcagggctggggactctcagggacagggcccacagccccagaccccaccttttccagcccagctccccacacccacctgcttctcactcgggaggatgggccccagagtcaccctccagggcaggagcccgaatggctccatagccatgcccccacccaccgggagaagtggattcagtgactgtcaaagcaacccgggctgtgtcctgcagctgccctcgtgagttttgcccaaaagtcacaaagaagcaatcttcgtggttgattagtgggttcaggtcatctccagtctgtcctcgggagctgtgggttcccactcgctccagtgagacttggcattttctgcacataaagaagagtcgtgtggg

SEQ ID NO: 21678 - DNA, 309 bp, Homo sapiens
ctccacctgccacgttctcaccccttcttcttccactgcaaactcctatgcagccgtcaaggccccattctcctctggaaagccttcccgatccccttggcaacaaccaccaccaatatttattcactgagcccactttgtgccaagcattgttctagacacggggaccaccctttgcactcagtaggcctttgttttcctgcgtggaaagcggttgggcttgggaggcgatggagccggagttcttgtacgacctgctgcagctccccaagggggtggagcccccagcggaggaggagctctcaaaag

SEQ ID NO: 21679 - DNA, 622 bp, Homo sapiens
gaggaaggggcctggcccggggcggggtgtggaggtgggaggacggcggtgcgggatggagggtggaggccaggctgacagggtgctggtggtgggttgcgggggtcgaccccaggctctggcctatgtagctgccattttggaggtgaacagcctgcggggaaactggcatggtttggggaaggcggggagagggggagaaatgaaagcattgagtttaagtggcctgcagaaccccgggggcccaggcggcacggcgggcgctggggctccgggcagagctttctggaggtttgtggcagcttcactttcacggcatccacccccctcgggccctgccgcagagaggaggaagctcctgccggctgagcgggcctggaggaagtgagcagcggggctcctgcctcccggcctggtccccgaagaccccagaagaacccggaacttgcttccattcggaatccagggaccaccctttgcactcagtaggcctttgttttcctgcgtggaaagcggttgggcttgggaggcgatggagccggagttcttgtacgacctgctgcagctccccaagggggtggagcccccagcggaggaggagctctcaaaaggtgtgtgccca

SEQ ID NO: 21680 - DNA, 2148 bp, Homo sapiens
ctttgtttggctgctgttttaatctttcatgcatttagcagtcatggatggtgccagcgaaggaacaggtgccagggcgttgtgactccacccagcgctgcttcccgggaccttccaattggacaggagctgggggaagagctggttcacagccctttgtgggggatgggactttgggaaccccaaacttctgctgggaccacaaggagaagagggcagcagagtcacagctgcagagaggaggaagctcctgccggctgagcgggcctggaggaagtgagcagcggggctcctgcctcccggcctggtccccgaagaccccagaagaacccggaacttgcttccattcggaatccagggaccaccctttgcactcagtaggcctttgttttcctgcgtggaaagcggttgggcttgggaggcgatggagccggagttcttgtacgacctgctgcagctccccaagggggtggagcccccagcggaggaggagctctcaaaaggaggaaagaagaaatacctgccacccacttcccggaaggaccccaaatttgaagaactgcagaaggtgttgatggagtggatcaatgccactcttctccccgagcacattgtggtccgcagcctggaggaggacatgttcgacgggctcatcctacaccacctattccagaggctggcggcgctcaagctggaagcagaggacatcgccctgacagccacaagccagaagcacaagctcacagtggtgctggaggccgtgaaccggagtctgcagctggaggagtggcaggccaagtggagcgtggagagcatcttcaacaaggacctgttgtctaccctgcacctccttgtggccctggccaagcgcttccagcccgacctctccctcccaaccaacgtccaggtggaggtcatcactatcgagagcaccaaaagtggtctgaagtcagagaagttggtggaacagctcactgaatacagcacagacaaggacgagcctccaaaggacgtctttgatgaattatttaagctggctccggagaaagtgaacgcagtgaaagaggccatcgtgaactttgtcaaccagaagctggaccgcctgggcctgtctgtgcagaatctggacacccagtttgcagatggggtcatcttactcttgctgattggacaacttgaaggcttcttcctgcacttaaaggaattctacctcactcccaactctcctgcagaaatgctgcacaacgtcaccctggcgctggagctgctgaaggacgagggcctgctcagctgccctgtcagccctgaagatatcgtgaacaaggatgccaagagcacactgagggtgctctatggtctgttctgcaagcacacgcagaaggcacacagggacaggacgccccatggagccccgaattgaccctcactgcctccaaagcccagagcctgcctgtcagcccagctggagggcccgaggctgcagggtgtcctcccacagtcccgctgtttcctgtgcattcgtgacccgcttccctcccaccctgtctcctgtctccatcgttggattatctttgaacccccttgtgtggatcattttgagccgcctggccttgctcagtttattttaataaaagtatttctgggagggattctgggaacttgacagggtcctgaggagggcccttaaacctgcagcctccctcccatggggtgagtgtgtgtcacatcagtctctcatctctgggcccaggctagtgaccgcccagagaggtggcatcactcagggctggggactctcagggacagggcccacagccccagaccccaccttttccagcccagctccccacacccacctgcttctcactcgggaggatgggccccagagtcaccctccagggcaggagcccgaatggctccatagccatgcccccacccaccgggagaagtggattcagtgactgtcaaagcaacccgggctgtgtcctgcagctgccctcgtgagttttgcccaaaagtcacaaagaagcaatcttcgtggttgattagtgggttcaggtcatctccagtctgtcctcgggagctgtgggttcccactcgctccagtgagacttggcattttctgcacataaagaagagtcgtgtggg

SEQ ID NO: 21681 - DNA, 1709 bp, Homo sapiens
aaactcaccatttcagcccggatggtgaagattccagcttgagagaccagctcgggtctgaagtgtttctctatctactgtgctgagatctctccttctcgaaccctgctatgcctttgcatacgctgttttctccacctgccacgttctcaccccttcttcttccactgcaaactcctatgcagccgtcaaggccccattctcctctggaaagccttcccgatccccttggcaacaaccaccaccaatatttattcactgagcccactttgtgccaagcattgttctagacacggagaggaggaagctcctgccggctgagcgggcctggaggaagtgagcagcggggctcctgcctcccggcctggtccccgaagaccccagaagaacccggaacttgcttccattcggaatccagggaccaccctttgcactcagtaggcctttgttttcctgcgtggaaagcggttgggcttgggaggcgatggagccggagttcttgtacgacctgctgcagctccccaagggggtggagcccccagcggaggaggagctctcaaaaggaggaaagaagaaatacctgccacccacttcccggaaggaccccaaatttgaagaactgcagaaggtgttgatggagtggatcaatgccactcttctccccgagcacattgtggtccgcagcctggaggaggacatgttcgacgggctcatcctacaccacctattccagaggctggcggcgctcaagctggaagcagaggacatcgccctgacagccacaagccagaagcacaagctcacagtggtgctggaggccgtgaaccggagtctgcagctggaggagtggcaggccaagtggagcgtggagagcatcttcaacaaggacctgttgtctaccctgcacctccttgtggccctggccaagcgcttccagcccgacctctccctcccaaccaacgtccaggtggaggtcatcactatcgagagcaccaaaagtggtctgaagtcagagaagttggtggaacagctcactgaatacagcacagacaaggacgagcctccaaaggacgtctttgatgaattatttaagctggctccggagaaagtgaacgcagtgaaagaggccatcgtgaactttgtcaaccagaagctggaccgcctgggcctgtctgtgcagaatctggacacccagtttgcagatggggtcatcttactcttgctgattggacaacttgaaggcttcttcctgcacttaaaggaattctacctcactcccaactctcctgcagaaatgctgcacaacgtcaccctggcgctggagctgctgaaggacgagggcctgctcagctgccctgtcagccctgaagatatcgtgaacaaggatgccaagagcacactgagggtgctctatggtctgttctgcaagcacacgcagaaggcacacagggacaggacgccccatggagccccgaattgaccctcactgcctccaaagcccagagcctgcctgtcagcccagctggagggcccgaggctgcagggtgtcctcccacagtcccgctgtttcctgtgcattcgtgacccgcttccctcccaccctgtctcctgtctccatcgttggattatctttgaacccccttgtgtggatcattttgagccgcctggccttgctcagtttattttaataaaagtatttctgggaggga

SEQ ID NO: 21682 - DNA, 907 bp, Homo sapiens
atggatggtgccagcgaaggaacaggtgccagggcgttgtgactccacccagcgctgcttcccgggaccttccaattggacaggagctgggggaagagctggttcacagccctttgtgggggatgggactttgggaaccccaaacttctgctgggaccacaaggagaagagggcagcagagtcacagctgcaggcttgggaggcgatggagccggagttcttgtacgacctgctgcagctccccaagggggtggagcccccagcggaggaggagctctcaaaaggaggaaagaagaaatacctgccacccacttcccggaaggaccccaaatttgaagaactgcagaagcacacctggcccagccctgtgactggcactggggacaccatctgtggtcttgcccggaagacctggtgaggtgctgacatgtcgtctcagctcggtctcctccacaggctgatccagagacaaggatttggatgccagtagttgagttgggaggttatcccaggggtcatgggagggaaggggccaacacatggttagtgatggagctggtcatggttctgggggctcaagcctgctgggtaccctggagccagcatagagcaagttcagtgcattcctgcccaaggggcgatggagctggggtatttatacaccaccacccctgccccgacaacctcctgacaacctttagtgaacagctgctccctgagaaagggctgggccttgattccctggcactctgaccttttgagcacagcagagtggggacagtttcgagcagagctgcaggtgggagctgggccagtaggcaacagtcaaggagtgggcagggtaccagcagcccccgcattagcttcctagggctactgtaacatgtgaccacagactgaatggctt

SEQ ID NO: 21683 - DNA, 4572 bp, Homo sapiens
gtcgctgtgcgattggtcggtgggataaaagcgcggaagggctcctttccgtggtgtgtagccggcttggcgtgaccctcgcctgatccagttgttagagttggaagcttggcagttggcctcccttcttcccatggaggacgggggcttaacagcctttgaagaggaccagagatgcctttcccagagcctccccttgccagtgtcagcagagggcccagctgcacagaccactgctgagcccagcaggtcgttttcctcagcccacagacacctgagcagaaggaatgggctttccagactctgccagagcaggacagcgctctctgaagacagatggagctcctattgtctatcatcactggctgcccagaatatttgtacaagtaaactgcactgccctgctgcccctgagcacacggacccgtccgaaccgcggggcagtgtgtcctgctgctccctgctgcggggactgtcctcagggtggtcctcacctctgcttccggcccctgtgtgcaaccctaacaaggccatcttcacggtggatgccaagaccacagagatcctggttgctaacgacaaagcttgcgggctcctggggtacagcagccaggacctgattggccagaagctcacgcagttctttctgaggtcagattctgatgtggtggaggccctcagcgaggagcacatggaggccgacggccacgctgcggtggtgtttggcacggtggtggacatcatcagccgtagtggggagaagattccagtgtctgtgtggatgaagaggatgcggcaggagcgccgcctatgctgcgtggtggtcctggagcccgtggagagggtctcgacctgggtcgctttccagagcgatggcaccgtcacgtcatgtgacagtctctttgctcatcttcacgggtacgtgtctggggaggacgtggctgggcagcatatcacagacctgatcccttctgtgcagctccctccttctggccagcacatcccaaagaatctcaagattcagaggtctgttggaagagccagggacggtaccaccttccctctgagcttaaagctgaaatcccaacccagcagcgaggaggcgaccaccggtgaggcggcccctgtgagcggctaccgggcatctgtctgggtgttctgcaccatcagtggcctcatcaccctcctgccggatgggaccatccacggcatcaaccacagcttcgcgctgacactgtttggttacggaaagacggagctcctgggcaagaatatcactttcctgattcctggtttctacagctacatggaccttgcgtacaacagctcattacagctcccagacctggccagctgcctggacgtcggcaatgagagtgggtgtggggagagaaccttggacccgtggcagggccaggacccagctgaggggggccaggatccaaggattaatgtcgtgcttgctggtggccacgttgtgccccgagatgagatccggaagctgatggaaagccaagacatcttcaccgggactcagactgagctgattgctggaggccagctcctttcctgcctctcacctcagcctgctccaggggtggacaatgtcccagaaggaagcctgccagtgcacggtgaacaggcgctgcccaaggaccagcaaatcactgccttggggagagaggaacctgtggcaatagagagccccggacaggatcttctgggagaaagcaggtctgaaccagtggatgtgaagccatttgcttcctgcgaagattctgaagctccagtcccagctgaggatgggggcagtgatgctggcatgtgtggcctgtgtcagaaggcccagctagagcggatgggagtcagtggtcccagcggttcagacctttgggctggggctgccgtggccaagccccaggccaagggtcagctggcggggggcagcctcctgatgcactgcccttgctatgggagtgaatggggcttgtggtggcgaagccaggacttggcccccagcccctctgggatggcaggcctctcgtttgggacacctactctagatgagccgtggctgggagtggaaaacgaccgagaagagctgcagacctgcttgattaaggagcagctgtcccagttgagccttgcaggagccctggatgtcccccacgccgaactcgttccgacagagtgccaggctgtcaccgctcctgtgtcgtcctgcgatctgggaggcagagacctgtgcggtggctgcacgggcagctcctcagcctgctatgccttggccacggacctccctgggggcctggaagcagtggaggcccaggaggttgatgtgaattcgttttcctggaacctcaaggaactctttttcagtgaccagacagaccaaacgtcatcaaattgttcctgtgctacgtctgaactcagagagacaccctcttccttggcagtgggctccgatccagatgtaggcagtctccaggaacaggggtcgtgtgtcctggatgacagggagctgttactactgaccggcacctgtgttgaccttggccaaggccgacggttccgggagagctgtgtgggacatgatccaacagaaccgcttgaggtttgtttggtgtcctctgagcattatgcagcaagcgacagagaaagcccaggacacgttccttccacgttggatgctggccctgaggacacgtgcccatcagcagaggagccaaggctgaacgtccaggtcacctccacgcccgtgatcgtgatgcgcggggctgctggcctgcagcgggagatccaggagggtgcctactccgggagctgctaccatcgagatggcttacggctgagtatacagtttgaggtgaggcgggtggagctccagggccccacacctctgttctgctgctggctggtgaaagacctcctccacagccaacgcgactcagccgccaggacccgcctgttccttgccagcctgcccggctccacccactctaccgctgctgagctcaccggacccagcctggtggaagtgctcagagccagaccctggtttgaggagccccccaaggctgtggaactggaggggttggcggcctgtgagggcgagtactcccaaaagtacagtaccatgagcccgctgggcagtggggccttcggcttcgtgtggactgctgtggacaaggaaaaaaacaaggaggtggtggtgaagtttattaagaaggagaaggtcttggaggattgttggattgaggatcccaaacttgggaaagttactttagagatcgcaattctatccagggtggagcacgccaatatcatcaaggtattggatatatttgaaaaccaagggttcttccagcttgtgatggagaagcacggctccggcctagacctcttcgctttcatcgaccgccaccccaggctggatgagcccctggcgagctacatcttccgacaactagtgtcagcagtgggatacctgcgcttgaaggacatcatccaccgtgacatcaaggatgagaacatcgtgatcgccgaggacttcacaatcaagctgatagactttggctcggccgcctacttggaaaggggaaaattattttatactttttgtgggaccatcgagtactgtgcaccggaagttctcatggggaatccctacagagggccggagctggagatgtggtctctgggagtcactctgtacacgctggtctttgaggagaaccccttctgtgagctggaggagaccgtggaggctgccatacacccgccatacctggtgtccaaagaactcatgagccttgtgtctgggctgctgcagccagtccctgagagacgcaccaccttggagaagctggtgacagacccgtgggtaacacagcctgtgaatcttgctgactatacatgggaagaggtgtttcgagtaaacaagccagaaagtggagttctgtccgctgcgagcctggagatggggaacaggagcctgagtgatgtggcccaggctcaggagctttgtgggggccccgttccaggcgaggctcctaatggccaaggctgtttgcatcccggggatccccgtctgctgaccagctaaacaccaatttcttcctgcttttctccacttggtttggaaaatcacacagttttcaggctccatctgtttggagaaaatacattctgaagcatccccaattcaccttctaaaaactcatgtgcaggtttgataaacaccagaacagaagacagtgatgctgtattattttagatttattacatagatttggaattcacttttttcatgacctagaaaaaaacattccagtgttcaactgttttatattattaaagggcttttaatttgtgaacttctgaaggcatgagtgttttctctttctacttttgtatatgtgcatgttttgtttcctctgacttggtatatgctcatctgagtgacggatatgtgaaatttgtagaactggttagtcaaatggccagactatttcattaatttatttcctcaaatgcttttcaaattaaagcacctttgttagtaaacagtta

SEQ ID NO: 21684 - DNA, 4326 bp, Homo sapiens
gcgtgaccctcgcctgatccagttgttagagttggaagcttggcagttggcctcccttcttcccatggaggacgggggcttaacagcctttgaagaggaccagagatgcctttcccagagcctccccttgccagtgtcagcagagggcccagctgcacagaccactgctgagcccagcaggtcgttttcctcagcccacagacacctgagcagaaggaatgggctttccagactctgccagagcaggacagcgctctctgaagacagatggagctcctattgtctatcatcactggctgcccagaatatttgtacaagtaaactgcactgccctgctgcccctgagcacacggacccgtccgaaccgcggggcagtgtgtcctgctgctccctgctgcggggactgtcctcagggtggtcctcacctctgcttccggcccctgtgtgcaaccctaacaaggccatcttcacggtggatgccaagaccacagagatcctggttgctaacgacaaagcttgcgggctcctggggtacagcagccaggacctgattggccagaagctcacgcagttctttctgaggtcagattctgatgtggtggaggccctcagcgaggagcacatggaggccgacggccacgctgcggtggtgtttggcacggtggtggacatcatcagccgtagtggggagaagattccagtgtctgtgtggatgaagaggatgcggcaggagcgccgcctatgctgcgtggtggtcctggagcccgtggagagggtctcgacctgggtcgctttccagagcgatggcaccgtcacgtcatgtgacagtctctttgctcatcttcacgggtacgtgtctggggaggacgtggctgggcagcatatcacagacctgatcccttctgtgcagctccctccttctggccagcacatcccaaagaatctcaagattcagaggtctgttggaagagccagggacggtaccaccttccctctgagcttaaagctgaaatcccaacccagcagcgaggaggcgaccaccggtgaggcggcccctgtgagcggctaccgggcatctgtctgggtgttctgcaccatcagtggcctcatcaccctcctgccggatgggaccatccacggcatcaaccacagcttcgcgctgacactgtttggttacggaaagacggagctcctgggcaagaatatcactttcctgattcctggtttctacagctacatggaccttgcgtacaacagctcattacagctcccagacctggccagctgcctggacgtcggcaatgagagtgggtgtggggagagaaccttggacccgtggcagggccaggacccagctgaggggggccaggatccaaggattaatgtcgtgcttgctggtggccacgttgtgccccgagatgagatccggaagctgatggaaagccaagacatcttcaccgggactcagactgagctgattgctggaggccagctcctttcctgcctctcacctcagcctgctccaggggtggacaatgtcccagaaggaagcctgccagtgcacggtgaacaggcgctgcccaaggaccagcaaatcactgccttggggagagaggaacctgtggcaatagagagccccggacaggatcttctgggagaaagcaggtctgaaccagtggatgtgaagccatttgcttcctgcgaagattctgaagctccagtcccagctgaggatgggggcagtgatgctggcatgtgtggcctgtgtcagaaggcccagctagagcggatgggagtcagtggtcccagcggttcagacctttgggctggggctgccgtggccaagccccaggccaagggtcagctggcggggggcagcctcctgatgcactgcccttgctatgggagtgaatggggcttgtggtggcgaagccaggacttggcccccagcccctctgggatggcaggcctctcgtttgggacacctactctagatgagccgtggctgggagtggaaaacgaccgagaagagctgcagacctgcttgattaaggagcagctgtcccagttgagccttgcaggagccctggatgtcccccacgccgaactcgttccgacagagtgccaggctgtcaccgctcctgtgtcgtcctgcgatctgggaggcagagacctgtgcggtggctgcacgggcagctcctcagcctgctatgccttggccacggacctccctgggggcctggaagcagtggaggcccaggaggttgatgtgaattcgttttcctggaacctcaaggaactctttttcagtgaccagacagaccaaacgtcatcaaattgttcctgtgctacgtctgaactcagagagacaccctcttccttggcagtgggctccgatccagatgtaggcagtctccaggaacaggggtcgtgtgtcctggatgacagggagctgttactactgaccggcacctgtgttgaccttggccaaggccgacggttccgggagagctgtgtgggacatgatccaacagaaccgcttgaggtttgtttggtgtcctctgagcattatgcagcaagcgacagagaaagcccaggacacgttccttccacgttggatgctggccctgaggacacgtgcccatcagcagaggagccaaggctgaacgtccaggtcacctccacgcccgtgatcgtgatgcgcggggctgctggcctgcagcgggagatccaggagggtgcctactccgggagctgctaccatcgagatggcttacggctgagtatacagtttgaggtgaggcgggtggagctccagggccccacacctctgttctgctgctggctggtgaaagacctcctccacagccaacgcgactcagccgccaggacccgcctgttccttgccagcctgcccggctccacccactctaccgctgctgagctcaccggacccagcctggtggaagtgctcagagccagaccctggtttgaggagccccccaaggctgtggaactggaggggttggcggcctgtgagggcgagtactcccaaaagtacagtaccatgagcccgctgggcagtggggccttcggcttcgtgtggactgctgtggacaaggaaaaaaacaaggaggtggtggtgaagtttattaagaaggagaaggtcttggaggattgttggattgaggatcccaaacttgggaaagttactttagagatcgcaattctatccagggtggagcacgccaatatcatcaaggtattggatatatttgaaaaccaagggttcttccagcttgtgatggagaagcacggctccggcctagacctcttcgctttcatcgaccgccaccccaggctggatgagcccctggcgagctacatcttccgacaagtgagagcaggccagagccgtctagtgtcagcagtgggatacctgcgcttgaaggacatcatccaccgtgacatcaaggatgagaacatcgtgatcgccgaggacttcacaatcaagctgatagactttggctcggccgcctacttggaaaggggaaaattattttatactttttgtgggaccatcgagtactgtgcaccggaagttctcatggggaatccctacagagggccggagctggagatgtggtctctgggagtcactctgtacacgctggtctttgaggagaaccccttctgtgagctggaggagaccgtggaggctgccatacacccgccatacctggtgtccaaagaactcatgagccttgtgtctgggctgctgcagccagtccctgagagacgcaccaccttggagaagctggtgacagacccgtgggtaacacagcctgtgaatcttgctgactatacatgggaagaggtgtttcgagtaaacaagccagaaagtggagttctgtccgctgcgagcctggagatggggaacaggagcctgagtgatgtggcccaggctcaggagctttgtgggggccccgttccaggcgaggctcctaatggccaaggctgtttgcatcccggggatccccgtctgctgaccagctaaacaccaatttcttcctgcttttctccacttggtttggaaaatcacacagttttcaggctccatctgtttggagaaaatacattctgaagcatccccaattcaccttctaaaaactcatgtgcaggtttgataaacaccagaacagaagacagtgatgctgtattattttagatttattacatagatttggaattcacttttttcatgacctagaaaaaaacattccagtgttcaactgttttatattattaaagggcttttaatttgtg

SEQ ID NO: 21685 - DNA, 4942 bp, Homo sapiens
gagaagctgggaaggaaagcagagggagtcgaagcgggacgcacagagccgtagctgcaggcagacggagtggacgtctaggcagagtggagagacgccctgggcttgagagttgacttatgtcactgtctcgacctcggaggcgtggaggggccgcgggccaggcggatctttccgtggctgcaaggtgcgggccagtcctacgtgcatccctgacctctgcgagcctcgctggctgcgtctgtacaatgggccgaacggcaagagcaacaacattctcccggcgtccccgcgcggattttacccatgcgaaatgccgccttctcttgacgctcggagcaggcgggcaggtgcggggcacttgcgctggtggggccgctagccagctggctggctccggggcgccagctgggctccccttgcaagtcgttcccagcccagtgcggacgctgcagccttcgtctaccctgcggagccacccggcccatgaacgagccgccccgcgtcctccgccttcagaaagaggcctccaagaggcgagctctgcgctactcacccattttgatcgcgagtcgggaggaaaccgcatctgcccggcccgggggcggaggcgcccattattcctttggctcctccgaagcgccgtaggggtgtttgttgttagagttggaagcttggcagttggcctcccttcttcccatggaggacgggggcttaacagcctttgaagaggaccagagatgcctttcccagagcctccccttgccagtgtcagcagagggcccagctgcacagaccactgctgagcccagcaggtcgttttcctcagcccacagacacctgagcagaaggaatgggctttccagactctgccagagcaggacagcgctctctgaagacagatggagctcctattgtctatcatcactggctgcccagaatatttgtacaagtaaactgcactgccctgctgcccctgagcacacggacccgtccgaaccgcggggcagtgtgtcctgctgctccctgctgcggggactgtcctcagggtggtcctcacctctgcttccggcccctgtgtgcaaccctaacaaggccatcttcacggtggatgccaagaccacagagatcctggttgctaacgacaaagcttgcgggctcctggggtacagcagccaggacctgattggccagaagctcacgcagttctttctgaggtcagattctgatgtggtggaggccctcagcgaggagcacatggaggccgacggccacgctgcggtggtgtttggcacggtggtggacatcatcagccgtagtggggagaagattccagtgtctgtgtggatgaagaggatgcggcaggagcgccgcctatgctgcgtggtggtcctggagcccgtggagagggtctcgacctgggtcgctttccagagcgatggcaccgtcacgtcatgtgacagtctctttgctcatcttcacgggtacgtgtctggggaggacgtggctgggcagcatatcacagacctgatcccttctgtgcagctccctccttctggccagcacatcccaaagaatctcaagattcagaggtctgttggaagagccagggacggtaccaccttccctctgagcttaaagctgaaatcccaacccagcagcgaggaggcgaccaccggtgaggcggcccctgtgagcggctaccgggcatctgtctgggtgttctgcaccatcagtggcctcatcaccctcctgccggatgggaccatccacggcatcaaccacagcttcgcgctgacactgtttggttacggaaagacggagctcctgggcaagaatatcactttcctgattcctggtttctacagctacatggaccttgcgtacaacagctcattacagctcccagacctggccagctgcctggacgtcggcaatgagagtgggtgtggggagagaaccttggacccgtggcagggccaggacccagctgaggggggccaggatccaaggattaatgtcgtgcttgctggtggccacgttgtgccccgagatgagatccggaagctgatggaaagccaagacatcttcaccgggactcagactgagctgattgctggaggccagctcctttcctgcctctcacctcagcctgctccaggggtggacaatgtcccagaaggaagcctgccagtgcacggtgaacaggcgctgcccaaggaccagcaaatcactgccttggggagagaggaacctgtggcaatagagagccccggacaggatcttctgggagaaagcaggtctgaaccagtggatgtgaagccatttgcttcctgcgaagattctgaagctccagtcccagctgaggatgggggcagtgatgctggcatgtgtggcctgtgtcagaaggcccagctagagcggatgggagtcagtggtcccagcggttcagacctttgggctggggctgccgtggccaagccccaggccaagggtcagctggcggggggcagcctcctgatgcactgcccttgctatgggagtgaatggggcttgtggtggcgaagccaggacttggcccccagcccctctgggatggcaggcctctcgtttgggacacctactctagatgagccgtggctgggagtggaaaacgaccgagaagagctgcagacctgcttgattaaggagcagctgtcccagttgagccttgcaggagccctggatgtcccccacgccgaactcgttccgacagagtgccaggctgtcaccgctcctgtgtcgtcctgcgatctgggaggcagagacctgtgcggtggctgcacgggcagctcctcagcctgctatgccttggccacggacctccctgggggcctggaagcagtggaggcccaggaggttgatgtgaattcgttttcctggaacctcaaggaactctttttcagtgaccagacagaccaaacgtcatcaaattgttcctgtgctacgtctgaactcagagagacaccctcttccttggcagtgggctccgatccagatgtaggcagtctccaggaacaggggtcgtgtgtcctggatgacagggagctgttactactgaccggcacctgtgttgaccttggccaaggccgacggttccgggagagctgtgtgggacatgatccaacagaaccgcttgaggtttgtttggtgtcctctgagcattatgcagcaagcgacagagaaagcccaggacacgttccttccacgttggatgctggccctgaggacacgtgcccatcagcagaggagccaaggctgaacgtccaggtcacctccacgcccgtgatcgtgatgcgcggggctgctggcctgcagcgggagatccaggagggtgcctactccgggagctgctaccatcgagatggcttacggctgagtatacagtttgaggtgaggcgggtggagctccagggccccacacctctgttctgctgctggctggtgaaagacctcctccacagccaacgcgactcagccgccaggacccgcctgttccttgccagcctgcccggctccacccactctaccgctgctgagctcaccggacccagcctggtggaagtgctcagagccagaccctggtttgaggagccccccaaggctgtggaactggaggggttggcggcctgtgagggcgagtactcccaaaagtacagtaccatgagcccgctgggcagtggggccttcggcttcgtgtggactgctgtggacaaggaaaaaaacaaggaggtggtggtgaagtttattaagaaggagaaggtcttggaggattgttggattgaggatcccaaacttgggaaagttactttagagatcgcaattctatccagggtggagcacgccaatatcatcaaggtattggatatatttgaaaaccaagggttcttccagcttgtgatggagaagcacggctccggcctagacctcttcgctttcatcgaccgccaccccaggctggatgagcccctggcgagctacatcttccgacaactagtgtcagcagtgggatacctgcgcttgaaggacatcatccaccgtgacatcaaggatgagaacatcgtgatcgccgaggacttcacaatcaagctgatagactttggctcggccgcctacttggaaaggggaaaattattttatactttttgtgggaccatcgagtactgtgcaccggaagttctcatggggaatccctacagagggccggagctggagatgtggtctctgggagtcactctgtacacgctggtctttgaggagaaccccttctgtgagctggaggagaccgtggaggctgccatacacccgccatacctggtgtccaaagaactcatgagccttgtgtctgggctgctgcagccagtccctgagagacgcaccaccttggagaagctggtgacagacccgtgggtaacacagcctgtgaatcttgctgactatacatgggaagaggtgtttcgagtaaacaagccagaaagtggagttctgtccgctgcgagcctggagatggggaacaggagcctgagtgatgtggcccaggctcaggagctttgtgggggccccgttccaggcgaggctcctaatggccaaggctgtttgcatcccggggatccccgtctgctgaccagctaaacaccaatttcttcctgcttttctccacttggtttggaaaatcacacagttttcaggctccatctgtttggagaaaatacattctgaagcatccccaattcaccttctaaaaactcatgtgcaggtttgataaacaccagaacagaagacagtgatgctgtattattttagatttattacatagatttggaattcacttttttcatgacctagaaaaaaacattccagtgttcaactgttttatattattaaagggcttttaatttgtgaa

SEQ ID NO: 21686 - DNA, 565 bp, Homo sapiens
gtgtagccggcttggcgtgaccctcgcctgatccaggttgtgtcgccaggctggagggcagtggtgtcatctcggctcattacaacctccacctcccaggttcaagcgattctcctgcctctgcctccagagtagctgggaatacagttgttagagttggaagcttggcagttggcctcccttcttcccatggaggacgggggcttaacagcctttgaagaggaccagagatgcctttcccagagcctccccttgccagtgtcagcagagggcccagctgcacagaccactgctgagcccagcaggtcgttttcctcagcccacagacacctgagcagaaggaatgggctttccagactctgccagagcaggacagcgctctctgaagacagatggagctcctattgtctatcatcactggctgcccagaatatttgtacaagtaaactgcactgccctgctgcccctgagcacacggacccgtccgaaccgcggggcagtgtgtcctgctgctccctgctgcggggactgtcctcagggtggtcctcacctctgcttccggccc

SEQ ID NO: 21687 - DNA, 3652 bp, Homo sapiens
gataaaagcgcggaagggctcctttccgtggtgtgtagccggcttggcgtgaccctcgcctgatccaggtggacatcatcagccgtagtggggagaagattccagtgtctgtgtggatgaagaggatgcggcaggagcgccgcctatgctgcgtggtggtcctggagcccgtggagagggtctcgacctgggtcgctttccagagcgatggcaccgtcacgtcatgtgacagtctctttgctcatcttcacgggtacgtgtctggggaggacgtggctgggcagcatatcacagacctgatcccttctgtgcagctccctccttctggccagcacatcccaaagaatctcaagattcagaggtctgttggaagagccagggacggtaccaccttccctctgagcttaaagctgaaatcccaacccagcagcgaggaggcgaccaccggtgaggcggcccctgtgagcggctaccgggcatctgtctgggtgttctgcaccatcagtggcctcatcaccctcctgccggatgggaccatccacggcatcaaccacagcttcgcgctgacactgtttggttacggaaagacggagctcctgggcaagaatatcactttcctgattcctggtttctacagctacatggaccttgcgtacaacagctcattacagctcccagacctggccagctgcctggacgtcggcaatgagagtgggtgtggggagagaaccttggacccgtggcagggccaggacccagctgaggggggccaggatccaaggattaatgtcgtgcttgctggtggccacgttgtgccccgagatgagatccggaagctgatggaaagccaagacatcttcaccgggactcagactgagctgattgctggaggccagctcctttcctgcctctcacctcagcctgctccaggggtggacaatgtcccagaaggaagcctgccagtgcacggtgaacaggcgctgcccaaggaccagcaaatcactgccttggggagagaggaacctgtggcaatagagagccccggacaggatcttctgggagaaagcaggtctgaaccagtggatgtgaagccatttgcttcctgcgaagattctgaagctccagtcccagctgaggatgggggcagtgatgctggcatgtgtggcctgtgtcagaaggcccagctagagcggatgggagtcagtggtcccagcggttcagacctttgggctggggctgccgtggccaagccccaggccaagggtcagctggcggggggcagcctcctgatgcactgcccttgctatgggagtgaatggggcttgtggtggcgaagccaggacttggcccccagcccctctgggatggcaggcctctcgtttgggacacctactctagatgagccgtggctgggagtggaaaacgaccgagaagagctgcagacctgcttgattaaggagcagctgtcccagttgagccttgcaggagccctggatgtcccccacgccgaactcgttccgacagagtgccaggctgtcaccgctcctgtgtcgtcctgcgatctgggaggcagagacctgtgcggtggctgcacgggcagctcctcagcctgctatgccttggccacggacctccctgggggcctggaagcagtggaggcccaggaggttgatgtgaattcgttttcctggaacctcaaggaactctttttcagtgaccagacagaccaaacgtcatcaaattgttcctgtgctacgtctgaactcagagagacaccctcttccttggcagtgggctccgatccagatgtaggcagtctccaggaacaggggtcgtgtgtcctggatgacagggagctgttactactgaccggcacctgtgttgaccttggccaaggccgacggttccgggagagctgtgtgggacatgatccaacagaaccgcttgaggtttgtttggtgtcctctgagcattatgcagcaagcgacagagaaagcccaggacacgttccttccacgttggatgctggccctgaggacacgtgcccatcagcagaggagccaaggctgaacgtccaggtcacctccacgcccgtgatcgtgatgcgcggggctgctggcctgcagcgggagatccaggagggtgcctactccgggagctgctaccatcgagatggcttacggctgagtatacagtttgaggtgaggcgggtggagctccagggccccacacctctgttctgctgctggctggtgaaagacctcctccacagccaacgcgactcagccgccaggacccgcctgttccttgccagcctgcccggctccacccactctaccgctgctgagctcaccggacccagcctggtggaagtgctcagagccagaccctggtttgaggagccccccaaggctgtggaactggaggggttggcggcctgtgagggcgagtactcccaaaagtacagtaccatgagcccgctgggcagtggggccttcggcttcgtgtggactgctgtggacaaggaaaaaaacaaggaggtggtggtgaagtttattaagaaggagaaggtcttggaggattgttggattgaggatcccaaacttgggaaagttactttagagatcgcaattctatccagggtggagcacgccaatatcatcaaggtattggatatatttgaaaaccaagggttcttccagcttgtgatggagaagcacggctccggcctagacctcttcgctttcatcgaccgccaccccaggctggatgagcccctggcgagctacatcttccgacaactagtgtcagcagtgggatacctgcgcttgaaggacatcatccaccgtgacatcaaggatgagaacatcgtgatcgccgaggacttcacaatcaagctgatagactttggctcggccgcctacttggaaaggggaaaattattttatactttttgtgggaccatcgagtactgtgcaccggaagttctcatggggaatccctacagagggccggagctggagatgtggtctctgggagtcactctgtacacgctggtctttgaggagaaccccttctgtgagctggaggagaccgtggaggctgccatacacccgccatacctggtgtccaaagaactcatgagccttgtgtctgggctgctgcagccagtccctgagagacgcaccaccttggagaagctggtgacagacccgtgggtaacacagcctgtgaatcttgctgactatacatgggaagaggtgtttcgagtaaacaagccagaaagtggagttctgtccgctgcgagcctggagatggggaacaggagcctgagtgatgtggcccaggctcaggagctttgtgggggccccgttccaggcgaggctcctaatggccaaggctgtttgcatcccggggatccccgtctgctgaccagctaaacaccaatttcttcctgcttttctccacttggtttggaaaatcacacagttttcaggctccatctgtttggagaaaatacattctgaagcatccccaattcaccttctaaaaactcatgtgcaggtttgataaacaccagaacagaagacagtgatgctgtattattttagatttattacatagatttggaattcacttttttcatgaccta

SEQ ID NO: 21688 - DNA, 4000 bp, Homo sapiens
tgttagagttggaagcttggcagttggcctcccttcttcccatggaggacgggggcttaacagcctttgaagaggaccagagatgcctttcccagagcctccccttgccagtgtcagcagagggcccagctgcacagaccactgctgagcccagcaggtcgttttcctcagcccacagacacctgagcagaaggaatgggctttccagactctgccagagcaggacagcgctctctggtggacatcatcagccgtagtggggagaagattccagtgtctgtgtggatgaagaggatgcggcaggagcgccgcctatgctgcgtggtggtcctggagcccgtggagagggtctcgacctgggtcgctttccagagcgatggcaccgtcacgtcatgtgacagtctctttgctcatcttcacgggtacgtgtctggggaggacgtggctgggcagcatatcacagacctgatcccttctgtgcagctccctccttctggccagcacatcccaaagaatctcaagattcagaggtctgttggaagagccagggacggtaccaccttccctctgagcttaaagctgaaatcccaacccagcagcgaggaggcgaccaccggtgaggcggcccctgtgagcggctaccgggcatctgtctgggtgttctgcaccatcagtggcctcatcaccctcctgccggatgggaccatccacggcatcaaccacagcttcgcgctgacactgtttggttacggaaagacggagctcctgggcaagaatatcactttcctgattcctggtttctacagctacatggaccttgcgtacaacagctcattacagctcccagacctggccagctgcctggacgtcggcaatgagagtgggtgtggggagagaaccttggacccgtggcagggccaggacccagctgaggggggccaggatccaaggattaatgtcgtgcttgctggtggccacgttgtgccccgagatgagatccggaagctgatggaaagccaagacatcttcaccgggactcagactgagctgattgctggaggccagctcctttcctgcctctcacctcagcctgctccaggggtggacaatgtcccagaaggaagcctgccagtgcacggtgaacaggcgctgcccaaggaccagcaaatcactgccttggggagagaggaacctgtggcaatagagagccccggacaggatcttctgggagaaagcaggtctgaaccagtggatgtgaagccatttgcttcctgcgaagattctgaagctccagtcccagctgaggatgggggcagtgatgctggcatgtgtggcctgtgtcagaaggcccagctagagcggatgggagtcagtggtcccagcggttcagacctttgggctggggctgccgtggccaagccccaggccaagggtcagctggcggggggcagcctcctgatgcactgcccttgctatgggagtgaatggggcttgtggtggcgaagccaggacttggcccccagcccctctgggatggcaggcctctcgtttgggacacctactctagatgagccgtggctgggagtggaaaacgaccgagaagagctgcagacctgcttgattaaggagcagctgtcccagttgagccttgcaggagccctggatgtcccccacgccgaactcgttccgacagagtgccaggctgtcaccgctcctgtgtcgtcctgcgatctgggaggcagagacctgtgcggtggctgcacgggcagctcctcagcctgctatgccttggccacggacctccctgggggcctggaagcagtggaggcccaggaggttgatgtgaattcgttttcctggaacctcaaggaactctttttcagtgaccagacagaccaaacgtcatcaaattgttcctgtgctacgtctgaactcagagagacaccctcttccttggcagtgggctccgatccagatgtaggcagtctccaggaacaggggtcgtgtgtcctggatgacagggagctgttactactgaccggcacctgtgttgaccttggccaaggccgacggttccgggagagctgtgtgggacatgatccaacagaaccgcttgaggtttgtttggtgtcctctgagcattatgcagcaagcgacagagaaagcccaggacacgttccttccacgttggatgctggccctgaggacacgtgcccatcagcagaggagccaaggctgaacgtccaggtcacctccacgcccgtgatcgtgatgcgcggggctgctggcctgcagcgggagatccaggagggtgcctactccgggagctgctaccatcgagatggcttacggctgagtatacagtttgaggtgaggcgggtggagctccagggccccacacctctgttctgctgctggctggtgaaagacctcctccacagccaacgcgactcagccgccaggacccgcctgttccttgccagcctgcccggctccacccactctaccgctgctgagctcaccggacccagcctggtggaagtgctcagagccagaccctggtttgaggagccccccaaggctgtggaactggaggggttggcggcctgtgagggcgagtactcccaaaagtacagtaccatgagcccgctgggcagtggggccttcggcttcgtgtggactgctgtggacaaggaaaaaaacaaggaggtggtggtgaagtttattaagaaggagaaggtcttggaggattgttggattgaggatcccaaacttgggaaagttactttagagatcgcaattctatccagggtggagcacgccaatatcatcaaggtattggatatatttgaaaaccaagggttcttccagcttgtgatggagaagcacggctccggcctagacctcttcgctttcatcgaccgccaccccaggctggatgagcccctggcgagctacatcttccgacaactagtgtcagcagtgggatacctgcgcttgaaggacatcatccaccgtgacatcaaggatgagaacatcgtgatcgccgaggacttcacaatcaagctgatagactttggctcggccgcctacttggaaaggggaaaattattttatactttttgtgggaccatcgagtactgtgcaccggaagttctcatggggaatccctacagagggccggagctggagatgtggtctctgggagtcactctgtacacgctggtctttgaggagaaccccttctgtgagctggaggagaccgtggaggctgccatacacccgccatacctggtgtccaaagaactcatgagccttgtgtctgggctgctgcagccagtccctgagagacgcaccaccttggagaagctggtgacagacccgtgggtaacacagcctgtgaatcttgctgactatacatgggaagaggtgtttcgagtaaacaagccagaaagtggagttctgtccgctgcgagcctggagatggggaacaggagcctgagtgatgtggcccaggctcaggagctttgtgggggccccgttccaggcgaggctcctaatggccaaggctgtttgcatcccggggatccccgtctgctgaccagctaaacaccaatttcttcctgcttttctccacttggtttggaaaatcacacagttttcaggctccatctgtttggagaaaatacattctgaagcatccccaattcaccttctaaaaactcatgtgcaggtttgataaacaccagaacagaagacagtgatgctgtattattttagatttattacatagatttggaattcacttttttcatgacctagaaaaaaacattccagtgttcaactgttttatattattaaagggcttttaatttgtgaacttctgaaggcatgagtgttttctctttctacttttgtatatgtgcatgttttgtttcctctgacttggtatatgctcatctgagtgacggatatgtgaaatttgtagaactggttagtc

SEQ ID NO: 21689 - DNA, 5161 bp, Homo sapiens
ctcctttccgtggtgtgtagccggcttggcgtgaccctcgcctgatccagttgttagagttggaagcttggcagttggcctcccttcttcccatggaggacgggggcttaacagcctttgaagaggaccagagatgcctttcccagagcctccccttgccagtgtcagcagagggcccagctgcacagaccactgctgagcccagcaggtcgttttcctcagcccacagacacctgagcagaaggaatgggctttccagactctgccagagcaggacagcgctctctgaagacagatggagctcctattgtctatcatcactggctgcccagaatatttgtacaagtaaactgcactgccctgctgcccctgagcacacggacccgtccgaaccgcggggcagtgtgtcctgctgctccctgctgcggggactgtcctcagggtggtcctcacctctgcttccggcccctgtgtgcaaccctaacaaggccatcttcacggtggatgccaagaccacagagatcctggttgctaacgacaaagcttgcgggctcctggggtacagcagccaggacctgattggccagaagctcacgcagttctttctgaggtcagattctgatgtggtggaggccctcagcgaggagcacatggaggccgacggccacgctgcggtggtgtttggcacggtggtggacatcatcagccgtagtggggagaagattccagtgtctgtgtggatgaagaggatgcggcaggagcgccgcctatgctgcgtggtggtcctggagcccgtggagagggtctcgacctgggtcgctttccagagcgatggcaccgtcacgtcatgtgacagtctctttgctcatcttcacgggtacgtgtctggggaggacgtggctgggcagcatatcacagacctgatcccttctgtgcagctccctccttctggccagcacatcccaaagaatctcaagattcagaggtctgttggaagagccagggacggtaccaccttccctctgagcttaaagctgaaatcccaacccagcagcgaggaggcgaccaccggtgaggcggcccctgtgagcggctaccgggcatctgtctgggtgttctgcaccatcagtggcctcatcaccctcctgccggatgggaccatccacggcatcaaccacagcttcgcgctgacactgtttggttacggaaagacggagctcctgggcaagaatatcactttcctgattcctggtttctacagctacatggaccttgcgtacaacagctcattacagctcccagacctggccagctgcctggacgtcggcaatgagagtgggtgtggggagagaaccttggacccgtggcagggccaggacccagctgaggggggccaggatccaaggattaatgtcgtgcttgctggtggccacgttgtgccccgagatgagatccggaagctgatggaaagccaagacatcttcaccgggactcagactgagctgattgctggaggccagctcctttcctgcctctcacctcagcctgctccaggggtggacaatgtcccagaaggaagcctgccagtgcacggtgaacaggcgctgcccaaggaccagcaaatcactgccttggggagagaggaacctgtggcaatagagagccccggacaggatcttctgggagaaagcaggtctgaaccagtggatgtgaagccatttgcttcctgcgaagattctgaagctccagtcccagctgaggatgggggcagtgatgctggcatgtgtggcctgtgtcagaaggcccagctagagcggatgggagtcagtggtcccagcggttcagacctttgggctggggctgccgtggccaagccccaggccaagggtcagctggcggggggcagcctcctgatgcactgcccttgctatgggagtgaatggggcttgtggtggcgaagccaggacttggcccccagcccctctgggatggcaggcctctcgtttgggacacctactctagatgagccgtggctgggagtggaaaacgaccgagaagagctgcagacctgcttgattaaggagcagctgtcccagttgagccttgcaggagccctggatgtcccccacgccgaactcgttccgacagagtgccaggctgtcaccgctcctgtgtcgtcctgcgatctgggaggcagagacctgtgcggtggctgcacgggcagctcctcagcctgctatgccttggccacggacctccctgggggcctggaagcagtggaggcccaggaggttgatgtgaattcgttttcctggaacctcaaggaactctttttcagtgaccagacagaccaaacgtcatcaaattgttcctgtgctacgtctgaactcagagagacaccctcttccttggcagtgggctccgatccagatgtaggcagtctccaggaacaggggtcgtgtgtcctggatgacagggagctgttactactgaccggcacctgtgttgaccttggccaaggccgacggttccgggagagctgtgtgggacatgatccaacagaaccgcttgaggtttgtttggtgtcctctgagcattatgcagcaagcgacagagaaagcccaggacacgttccttccacgttggatgctggccctgaggacacgtgcccatcagcagaggagccaaggctgaacgtccaggtcacctccacgcccgtgatcgtgatgcgcggggctgctggcctgcagcgggagatccaggagggtgcctactccgggagctgctaccatcgagatggcttacggctgagtatacagtttgaggtgaggcgggtggagctccagggccccacacctctgttctgctgctggctggtgaaagacctcctccacagccaacgcgactcagccgccaggacccgcctgttccttgccagcctgcccggctccacccactctaccgctgctgagctcaccggacccagcctggtggaagtgctcagagccagaccctggtttgaggagccccccaaggctgtggaactggaggggttggcggcctgtgagggcgagtactcccaaaagtacagtaccatgagcccgctgggcagtggggccttcggcttcgtgtggactgctgtggacaaggaaaaaaacaaggaggtggtggtgaagtttattaagaaggagaaggtcttggaggattgttggattgaggatcccaaacttgggaaagttactttagagatcgcaattctatccagggtggagcacgccaatatcatcaaggtattggatatatttgaaaaccaagggttcttccagcttgtgatggagaagcacggctccggcctagacctcttcgctttcatcgaccgccaccccaggctggatgagcccctggcgagctacatcttccgacaagtgagagcaggccagagccgtgttagtgtgaacgcaggcctgggtgcctgggtccggtggctgcaaagatcagtgatccatactcggttctctctctgagctggatctagccttctgtgtggggatttcatggagtaggatatatattttgagaagaaaattctatgattgaagtagagaaagtgaggttgggaaggaaggatgaggccagatacagtcctggaatgactgagaaagtatgtttaatggttaaggtttatttacatacataaaatatccacaacaatcataaaaattaaccagtaagggttaggatgcagccagagagcgtctcaaaggcatgtgtgcggcacagcggcctgcaggttgtaagtgcccactaaatggtggctgttgaggtaattaaccagcaaaactgagatcctgacattctcacttttcagtaagtatttgtcttgatctgtttcgtgtctaattacatattgaacttcggccattattttattggaatgggagagtgatgatccaaataggaaggcaccctagcagagggacagggggaagaaacggtaactcgtgttgggttttaaggagagggtggcggttccatcctgtactgctcccagctcccccagaagaactggagaaataccagcaaagggctgtgtagacaactcacatttgctcttggattgtttgctggggacaactcgatttctaatgacagcttccgtgaatcaacatttcttccttaaagctacacactctcgggttgttgggtttccgaagtttagtttctcaggctcctacttgtaagtttcagatattatggttctgcaaaaaagggtcacctctctccctcttcctgtgttggaaggtgacgtcctccctttagtttgtggccaacacttgtttctgaaactttttacagcaaacagagtatctgtatgaggttatgttgagggtcgcttgttaaaagctgctgcctgacagctgttaattctggggctagtgagacacataattatggtgtttatactctaaaatttttgccaaaagaatctctaccccttttgtaaatatatagacataaatgttattctatgtaaatacagatgcacaattttataaagtatatgatcgcacatcaatgtatgtaggaatcatgctggttctcagggcattgcctgtcagctccagattcatcaggacctgctcagcagcggggtcggggagctgggcctgggaacagccctggcttggttcaggccgctccagggcagcatggccagtccagggcacagaagcatctgcaggaagagcagctttcttcaagtcgctctttagccctttgtggttaatctctcagtactagttaataaatcttaatgaaactttccatgttcaagttcatgtgtgatttctgtctcctgattggatcctgactgatttgtatatatctacatatatatgtaagtatgtatgcatgcatgcttgtatatgtgtatttatgtgtgtacctatgtacaagtatatgttatgtgtataggtatgcacacgtgtgtatgcaggtgtgtatatatgtgcacatgtatgtatctaaatgtatgtataaatatgcaggtatgtatatataaatatgcaggtatgtatatataaatatgcaggtatgtatatgtttgtatatatgtgtataaatatgcgtatatttattaaatgtaagttaatcgggctta

SEQ ID NO: 21690 - DNA, 2332 bp, Homo sapiens
gggcagtccacaatggaaggcttcttggaggaggagatgattgagctgcttctactaagatgagtatctcagagtcctcaacgtgggtgtggccgaggtgaagaaatccttcctggggcccttgtccccgtcctgtaagatggtgcagatgatgaggcagtttctgtaccgggtcctgcccgaggactcctacaaggtcaccacggggaagctccatgtgagcctcacccgcttaacggacggggagaatgtggtggtttcagagttcacgtccaaggaggagctcattgaggccctatactgcagctgcttcgtcccggtgtactgtggcctcatccccccgacttaccgcggtgtgaggtacatcgatgggggcttcacgggcatgcagccctgtgccttctggaccgacgccatcaccatctccaccttcagtgggcagcaggacatctgtccccgggactgcccggccatcttccacgacttccgcatgttcaactgctccttccagttctccctggagaacatcgccaggatgacccacgcattgttccccccggacctggtgatcctgcacgattactactaccgagggtacgaggatgcagttttgtacttgaggcggctgaatgctgtttatcttaattcttcctccaagagagtgattttcccccgggtggaagtgtactgccagatagaactcgcccttggcaatgagtgccctgaacgcagtcaaccaagccttcgagcacggcaggccagtctggaaggagccacacaacctcacaaggagtgggttcccaaaggggatggaaggggcagccatggtccgcctgtgtcccaacctgtgcagacacttgaattcacatgcgagtcacctgtttcagcaccagtctctccacttgagcagccacctgcacagccactggcctcttcaactccactttctctaagtggcatgccacctgtatcattcccagctgtgcacaagccacccagctccacacctggttcatcactgcccaccccaccacctggactgtcacctctgtcacctcagcagcaggtacaaccgtctggatcaccagccagatccctacactctcaggcacccacttcacccaggccatccctggggccttcaactgtgggggcacctcaaacactgccccgaagttctctttcagccttccctgctcagccacctgtggaggaactaggccaagaacagccccaagctgtagctcttcttgtctcttcaaaaccaaaaagcgccgtgcctctggttcatgtgaaggaaaccgtcagcaagccttatgtaacggagagccctgctgaagactcaaactgggtgaataaggtcttcaagaagaacaagcaaaagacaagtggcaccagaaaaggcttcccaagacattcgggatccaaaaaaccaagcagcaaagtgcagtgagcatgtctaatgttccttaaatcccacggagaggagcagctttgggaactgtgttcagagagattccgaggaatagaggagagtgtaagggagtagggggtgcagtgggagattgggctttggaacagacacatccgacataaaattcctgctctgccacagctccactcagggatcatggttgggacacttgctctccctgagcctccatttcctgtaaaatggggatgataccacttcataaagttgtgagagttaaatgtgatcgatgatgtaaattgcttcatagaatgcagaatgtgtaatagctcacaataagtaggtattatgtttacatattatgtttgtatttatgctacttaaatacaaaactggacaggccaggcatggtggctcatgcctgtaatcccagcactttgggaggctgaggtaggtggaaaacctgaggtcaggagttcaagaacagcctgaccaacatggtgaaactccatctctactaaaaatacaaaaattaaccaggcttgatggtgtgcacctgtaatctcagctactcgggaggctgaggcaagagaatcgcttgaacccaggaggcagaggttgcagtgcaccaagactgcgccattgcactccagcccgggcaacaagagcgaaaccccatctcgaaaaaaaacaaaacaaaactagacaagtgagtgcctacgtgacactcaaatgttgccagcatacagttaagggccctagtcaatgtaggcctgcttcttatagctttttgactatattatgctgtctttgacttagtcagtcaacacttattgagcacctactaagtgccaaacactctcctggactctggcaaaataaaaaatgaattaaaactct

SEQ ID NO: 21691 - DNA, 2478 bp, Homo sapiens
atggaagaacaggtgttcaagggggacccggacacccctcactccatctccttctcgggcagtggattcctctccttctaccaggcgggggctgtggacgccctgcgggacctggccccccggatgctggaaacagcccaccgctttgcggggacatcggcaggtgctgtgatcgccgccctggccatctgcgggattgaaatggatgagtatctcagagtcctcaacgtgggtgtggccgaggtgaagaaatccttcctggggcccttgtccccgtcctgtaagatggtgcagatgatgaggcagtttctgtaccgggtcctgcccgaggactcctacaaggtcaccacggggaagctccatgtgagcctcacccgcttaacggacggggagaatgtggtggtttcagagttcacgtccaaggaggagctcattgaggccctatactgcagctgcttcgtcccggtgtactgtggcctcatccccccgacttaccgcggtgtgaggtacatcgatgggggcttcacgggcatgcagccctgtgccttctggaccgacgccatcaccatctccaccttcagtgggcagcaggacatctgtccccgggactgcccggccatcttccacgacttccgcatgttcaactgctccttccagttctccctggagaacatcgccaggatgacccacgcattgttccccccggacctggtgatcctgcacgattactactaccgagggtacgaggatgcagttttgtacttgaggcggctgaatgctgtttatcttaattcttcctccaagagagtgattttcccccgggtggaagtgtactgccagatagaactcgcccttggcaatgagtgccctgaacgcagtcaaccaagccttcgagcacggcaggccagtctggaaggagccacacaacctcacaaggagtgggttcccaaaggggatggaaggggcagccatggtccgcctgtgtcccaacctgtgcagacacttgaattcacatgcgagtcacctgtttcagcaccagtctctccacttgagcagccacctgcacagccactggcctcttcaactccactttctctaagtggcatgccacctgtatcattcccagctgtgcacaagccacccagctccacacctggttcatcactgcccaccccaccacctggactgtcacctctgtcacctcagcagcaggtacaaccgtctggatcaccagccagatccctacactctcaggcacccacttcacccaggccatccctggggccttcaactgtgggggcacctcaaacactgccccgaagttctctttcagccttccctgctcagccacctgtggaggaactaggccaagaacagccccaagctgtagctcttcttgtctcttcaaaaccaaaaagcgccgtgcctctggttcatgtgaaggaaaccgtcagcaagccttatgtaacggagagccctgctgaagactcaaactgggtgaataaggtcttcaagaagaacaagcaaaagacaagtggcaccagaaaaggcttcccaagacattcgggatccaaaaaaccaagcagcaaagtgcagtgagcatgtctaatgttccttaaatcccacggagaggagcagctttgggaactgtgttcagagagattccgaggaatagaggagagtgtaagggagtagggggtgcagtgggagattgggctttggaacagacacatccgacataaaattcctgctctgccacagctccactcagggatcatggttgggacacttgctctccctgagcctccatttcctgtaaaatggggatgataccacttcataaagttgtgagagttaaatgtgatcgatgatgtaaattgcttcatagaatgcagaatgtgtaatagctcacaataagtaggtattatgtttacatattatgtttgtatttatgctacttaaatacaaaactggacaggccaggcatggtggctcatgcctgtaatcccagcactttgggaggctgaggtaggtggaaaacctgaggtcaggagttcaagaacagcctgaccaacatggtgaaactccatctctactaaaaatacaaaaattaaccaggcttgatggtgtgcacctgtaatctcagctactcgggaggctgaggcaagagaatcgcttgaacccaggaggcagaggttgcagtgcaccaagactgcgccattgcactccagcccgggcaacaagagcgaaaccccatctcgaaaaaaaacaaaacaaaactagacaagtgagtgcctacgtgacactcaaatgttgccagcatacagttaagggccctagtcaatgtaggcctgcttcttatagctttttgactatattatgctgtctttgacttagtcagtcaacacttattgagcacctactaagtgccaaacactctcctggactctggcaaaataaaaaatgaattaaaactct

SEQ ID NO: 21692 - DNA, 1602 bp, Homo sapiens
atggaagaacaggtgttcaagggggacccggacacccctcactccatctccttctcgggcagtggattcctctccttctaccaggcgggggctgtggacgccctgcgggacctggccccccggatgctggaaacagcccaccgctttgcggggacatcggcaggtgctgtgatcgccgccctggccatctgcgggattgaaatggatgagtatctcagagtcctcaacgtgggtgtggccgaggtgaagaaatccttcctggggcccttgtccccgtcctgtaagatggtgcagatgatgaggcagtttctgtaccgggtcctgcccgaggactcctacaaggtcaccacggggaagctccatgtgagcctcacccgcttaacggacggggagaatgtggtggtttcagagttcacgtccaaggaggagctcattgaggcagccctatactgcagctgcttcgtcccggtgtactgtggcctcatccccccgacttaccgcggtgtgaggtacatcgatgggggcttcacgggcatgcagccctgtgccttctggaccgacgccatcaccatctccaccttcagtgggcagcaggacatctgtccccgggactgcccggccatcttccacgacttccgcatgttcaactgctccttccagttctccctggagaacatcgccaggatgacccacgcattgttccccccggacctggtgatcctgcacgattactactaccgagggtacgaggatgcagttttgtacttgaggcggctgaatgctgtttatcttaattcttcctccaagagagtgattttcccccgggtggaagtgtactgccagatagaactcgcccttggcaatgagtgccctgaacgcagtcaaccaagccttcgagcacggcaggccagtctggaaggagccacacaacctcacaaggagtgggttcccaaaggggatggaaggggcagccatggtccgcctgtgtcccaacctgtgcagacacttgaattcacatgcgagtcacctgtttcagcaccagtctctccacttgagcagccacctgcacagccactggcctcttcaactccactttctctaagtggcatgccacctgtatcattcccagctgtgcacaagccacccagctccacacctggttcatcactgcccaccccaccacctggactgtcacctctgtcacctcagcagcaggtacaaccgtctggatcaccagccagatccctacactctcaggcacccacttcacccaggccatccctggggccttcaactgtgggggcacctcaaacactgccccgaagttctctttcagccttccctgctcagccacctgtggaggaactaggccaagaacagccccaagctgtagctcttcttgtctcttcaaaaccaaaaagcgccgtgcctctggttcatgtgaaggaaaccgtcagcaagccttatgtaacggagagccctgctgaagactcaaactgggtgaataaggtcttcaagaagaacaagcaaaagacaagtggcaccagaaaaggcttcccaagacattcgggatccaaaaaaccaagcagcaaagtgcagtga

SEQ ID NO: 21693 - DNA, 1518 bp, Homo sapiens
gggcagtccacaatggaaggcttcttggaggaggagatgattgagctgcttctactaagatgagtatctcagagtcctcaacgtgggtgtggccgaggtgaagaaatccttcctggggcccttgtccccgtcctgtaagatggtgcagatgatgaggcagtttctgtaccgggtcctgcccgaggactcctacaaggtcaccacggggaagctccatgtgagcctcacccgcttaacggacggggagaatgtggtggtttcagagttcacgtccaaggaggagctcattgaggccctatactgcagctgcttcgtcccggtgtactgtggcctcatccccccgacttaccgcggtgtgtgggcatttctcactctgcccccacagaggtacatcgatgggggcttcacgggcatgcagccctgtgccttctggaccgacgccatcaccatctccaccttcagtgggcagcaggacatctgtccccgggactgcccggccatcttccacgacttccgcatgttcaactgctccttccagttctccctggagaacatcgccaggatgacccacgcattgttccccccggacctggtgatcctgcacgattactactaccgagggtacgaggatgcagttttgtacttgaggcggctgaatgctgtttatcttaattcttcctccaagagagtgattttcccccgggtggaagtgtactgccagatagaactcgcccttggcaatgagtgccctgaacgcagtcaaccaagccttcgagcacggcaggccagtctggaaggagccacacaacctcacaaggagtgggttcccaaaggggatggaaggggcagccatggtccgcctgtgtcccaacctgtgcagacacttgaattcacatgcgagtcacctgtttcagcaccagtctctccacttgagcagccacctgcacagccactggcctcttcaactccactttctctaagtggcatgccacctgtatcattcccagctgtgcacaagccacccagctccacacctggttcatcactgcccaccccaccacctggactgtcacctctgtcacctcagcagcaggtacaaccgtctggatcaccagccagatccctacactctcaggcacccacttcacccaggccatccctggggccttcaactgtgggggcacctcaaacactgccccgaagttctctttcagccttccctgctcagccacctgtggaggaactaggccaagaacagccccaagctgtagctcttcttgtctcttcaaaaccaaaaagcgccgtgcctctggttcatgtgaaggaaaccgtcagcaagccttatgtaacggagagccctgctgaagactcaaactgggtgaataaggtcttcaagaagaacaagcaaaagacaagtggcaccagaaaaggcttcccaagacattcgggatccaaaaaaccaagcagcaaagtgcagtgagcatgtctaatgttccttaaatcccacggagaggagca

SEQ ID NO: 21694 - DNA, 2428 bp, Homo sapiens
gcggccccagtcagacgcaggcagccccaaagcctgaacaggcagggccagacccagcttcttcgcctccgccagcggggaccccgagctagagccgcagcgggacctgcccggcccccggctccagcgagcgagcggcgagcaggcggctcacagaggcctggccgcccacggaacccggggcccggcggccgccgccgcgatgtttccccgcgagaagacgtggaacatctcgttcgcgggctgcggcttcctcggcgtctactacgtcggcgtggcctcctgcctccgcgagcacgcgcccttcctggtggccaacgccacgcacatctacggcgcctcggccggggcgctcacggccacggcgctggtcaccggggtctgcctgggtgaggctggtgccaagttcattgaggtatctaaagaggcccggaagcggttcctgggccccctgcacccctccttcaacctggtaaagatcatccgcagtttcctgctgaaggtcctgcctgctgatagccatgagcatgccagtgggcgcctgggcatctccctgacccgcgtgtcagacggcgagaatgtcattatatcccacttcaactccaaggacgagctcatccaggccaatgtctgcagcggtttcatccccgtgtactgtgggctcatccctccctccctccagggggtgcgctacgtggatggtggcatttcagacaacctgccactctatgagcttaagaacaccatcacagtgtcccccttctcgggcgagagtgacatctgtccgcaggacagctccaccaacatccacgagctgcgggtcaccaacaccagcatccagttcaacctgcgcaacctctaccgcctctccaaggccctcttcccgccggagcccctggtgctgcgagagatgtgcaagcagggataccgggatggcctgcgctttctgcagcggaacggcctcctgaaccggcccaaccccttgctggcgttgccccccgcccgcccccacggcccagaggacaaggaccaggcagtggagagcgcccaagcggaggattactcgcagctgcccggagaagatcacatcctggagcacctgcccgcccggctcaatgaggccctgctggaggcctgcgtggagcccacggacctgctgaccaccctctccaacatgctgcctgtgcgtctggccacggccatgatggtgccctacacgctgccgctggagagcgctctgtccttcaccatccgcttgctggagtggctgcccgacgttcccgaggacatccggtggatgaaggagcagacgggcagcatctgccagtacctggtgatgcgcgccaagaggaagctgggcaggcacctgccctccaggctgccggagcaggtggagctgcgccgcgtccagtcgctgccgtccgtgccgctgtcctgcgccgcctacagagaggcactgcccggctggatgcgcaacaacctctcgctgggggacgcgctggccaagtgggaggagtgccagcgccagctgctgctcggcctcttctgcaccaacgtggccttcccgcccgaagctctgcgcatgcgcgcacccgccgacccggctcccgcccccgcggacccagcatccccgcagcaccagctggccgggcctgcccccttgctgagcacccctgctcccgaggcccggcccgtgatcggggccctggggctgtgagaccccgaccctctcgaggaaccctgcctgagacgcctccattaccactgcgcagtgagatgaggggactcacagttgccaagaggggtctttgccgtgggccccctcgccagccactcaccagctgcatgcactgagaggggaggtttccacacccctcccctgggccgctgaggccccgcgcacctgtgccttaatcttccctcccctgtgctgcccgagcacctcccccgcccctttactcctgagaactttgcagctgcccttccctccccgtttttcatggcctgctgaaatatgtgtgtgaagaattatttattttcgccaaagcacatgtaataaatgctgcagcccagcctctgcccactttgtgtgtatgtgaccgcctgcttacttgcagtgagagcctggtggccagggtctggccctaccttggctgaccagcctctccacagctgcaggccaggtctcccagcgtcgcactcctgggcctggcatttggaacctgccaggctggcctgggaacacccccctacaggcacatatgaacgtactgcattcctgccgacccccctgtctaggatgcatccacaccccccccaattttgcccagcagcctcctggctgacccttggccacagccttctgagggccaatggaaatatttgggaccaagattcttggtaaataaaaacgaaaatgtttgcaaaa

SEQ ID NO: 21695 - DNA, 2805 bp, Homo sapiens
atggtccgaggggggcggggctgacgtcgcgctgggaatgccctggccgagacactgaggcagggtagagagcgcttgcgggcgccgggcggagctgctgcggatcaggacccgagccgattcccgatcccgacccagatcctaacccgcgcccccgccccgccgccgccgccatgtacgacgcagagcgcggctggagcttgtccttcgcgggctgcggcttcctgggcttctaccacgtcggggcgacccgctgcctgagcgagcacgccccgcacctcctccgcgacgcgcgcatgttgttcggcgcttcggccggggcgttgcactgcgtcggcgtcctctccggtatcccgctggagcagactctgcaggtcctctcagatcttgtgcggaaggccaggagtcggaacattggcatcttccatccatccttcaacttaagcaagttcctccgacagggtctctgcaaatgcctcccggccaatgtccaccagctcatctccggcaaaataggcatctctcttaccagagtgtctgatggggaaaacgttctggtgtctgactttcggtccaaagacgaagtcgtggatgccttggtatgttcctgcttcatccccttctacagtggccttatccctccttccttcagaggcgtgcgatatgtggatggaggagtgagtgacaacgtacccttcattgatgccaaaacaaccatcaccgtgtcccccttctatggggagtacgacatctgccctaaagtcaagtccacgaactttcttcatgtggacatcaccaagctcagtctacgcctctgcacagggaacctctaccttctctcgagagcttttgtccccccggatctcaaggtgctgggagagatatgccttcgaggatatttggatgcattcaggttcttggaagagaagggcatctgcaacaggccccagccaggcctgaagtcatcctcagaagggatggatcctgaggtcgccatgcccagctgggcaaacatgagtctggattcttccccggagtcggctgccttggctgtgaggctggagggagatgagctgctagaccacctgcgtctcagcatcctgccctgggatgagagcatcctggacaccctctcgcccaggctcgctacagcactgagtgaagaaatgaaagacaaaggtggatacatgagcaagatttgcaacttgctacccattaggataatgtcttatgtaatgctgccctgtaccctgcctgtggaatctgccattgcgattgtccagagactggtgacatggcttccagatatgcccgacgatgtcctgtggttgcagtgggtgacctcacaggtgttcactcgagtgctgatgtgtctgctccccgcctccaggtcccaaatgccagtgagcagccaacaggcctccccatgcacacctgagcaggactggccctgctggactccctgctcccccaagggctgtccagcagagaccaaagcagaggccaccccgcggtccatcctcaggtccagcctgaacttcttcttgggcaataaagtacctgctggtgctgaggggctctccacctttcccagtttttcactagagaagagtctgtgagtcacttgaggaggcgagtctagcagattctttcagaggtgctaaagtttcccatctttgtgcagctacctccgcattgctgtgtagtgacccctgcctgtgacgtggaggatcccagcctctgagctgagttggttttatgaaaagctaggaagcaacctttcgcctgtgcagcggtccagcacttaactctaatacatcagcatgcgttaattcagctggttgggaaatgacaccaggaagcccagtgcagagggtcccttactgactgtttcgtggccctattaatggtcagactgttccagcatgaggttcttagaatgacaggtgtttggatgggtgggggccttgtgatggggggtaggctggcccatgtgtgatcttgtggggtggagggaagagaatagcatgatcccacttccccatgctgtgggaaggggtgcagttcgtccccaagaacgacactgcctgtcaggtggtctgcaaagatgataaccttgactactaaaaacgtctccatggcgggggtaacaagatgataatctacttaattttagaacacctttttcacctaactaaaataatgtttaaagagttttgtataaaaatgtaaggaagcgttgttacctgttgaattttgtattatgtgaatcagtgagatgttagtagaataagccttaaaaaaaaaaaaatcggttgggtgcagtggcacacggctgtaatcccagcactttgggaggccaaggttggcagatcacctgaggtcaggagttcaagaccagtctggccaacatagcaaaaccctgtctctactaaaaatacaaaaattatctgggcatggtggtgcatgcctgtaatcccagctattcggaaggctgaggcaggagaatcacttgaacccaggaggcggaggttgcggtgagctgagattgcaccatttcattccagcctgggcaacatgagtgaaagtctgactcaaaaaaaaaaaatttaaaaaacaaaataatctagtgtgcagggcattcacctcagccccccaggcaggagccaagcacagcaggagcttccgcctcctctccactggagcacacaacttgaacctggcttattttctgcagggaccagccccacatggtcagtgagtttctccccatgtgtggcgatgagagagtgtagaaataaagac

SEQ ID NO: 21696 - DNA, 2537 bp, Homo sapiens
accagccccagcccggctccctccagagcccacatttgggcccagccccgtccaaggctgcatcccggccctatcccgggtcacggagtgacccttcctcgtcccgatcaccccgcccggtccacccgccatgggcttcttagaggaggagggcagatggaacctgtccttctccggcgccggctacctgggcgcccaccacgtgggcgccaccgaatgcctgcgccagcgagccccgcgcctcctccagggcgcccgccgcatctacggttcctcgtctggggcgctcaacgcagtcagcatcgtctgcggcaagtcggtcgacttctgctgctcccacctcctgggcatggttgggcagttggagcggctgagcctaagcatcctgcacccggcctacgcgcccatcgagcacgtcaagcagcagctgcaggatgctctgccccccgacgcccacgtcctggcctcccagcggctgggcatttcgctgacccgctggcctgacggacgcaacttcttggtcactgacttcgccacctgcgatgagctcatccaggccttggtctgcaccttatactttcctttctactgcgggctgatcccccccgagttcagaggggagcgctacatcgatggggctctgagcaacaacttgccctttgcagactgcccctccaccatcacggtgtcgcccttccatgggacagtggacatctgcccccagagcacctcccccaacctgcatgagctgaacgtcttcaacttcagcttccaaatctccactgagaacttcttcctggggctcatatgtctcataccccccagcctcgaggtagtggccgacaactgcagacaaggctacctggatgccctgaggttcctggagagacgtggactcaccaaggaaccagtgctatggacgctggtgtctaaggaacccccagccccggctgacggaaactgggatgctggctgtgaccaacgctggaaggggggcctgtctctcaactggaaagtgccccatgtgcaagtcaaggatgtacccaactttgagcagctctcaccagagctggaggctgcactgaagaaagcatgtacgagggatcccagccggtgggcccgcttctggcactcggggcctggacaggtgctgacgtacctgctgctaccctgcacactgcccttcgagtacatctacttccgcagcagaaggttggtggtgtggctgcccgatgtgccggcggacttgtggtggatgcagggcctgctgaggaacatggccctcgaggttttctccaggaccaaggcccagctccttgggcccatcagccctccggccactcgcgtcctggaaacaagccccctccaaccccagatagctcctcatagagaggagctcgggcccacccaccaggcctgagggggccgagcagggccagcccagtgactggtgtcccttgattcctgctctggcctttgtcctgtgtgcccacatctgccccagcgggaagaggccctgccaatctccgtggagaccctgcagcttggagcccgttccttggggcgcagcctgtcagcatgtccccggtcactgtgtacccaggtcacctgccctccctcttgccccgtctcatcagggagagaaaggaggacagccacagagacacatgtcttactttcagaatttccacggggggactaggagggcagcattgctggggagaggggctcctgttctgccgtggagctgcccacggagcacctcacagaagattgagaaagtgcctgatgcccgcgtcagagaccagaggagccaactgagatgatggggtgggggtgctccccccagactttctcagtcctgcagcggcccttgggggtgacccccggcatctaccccactcaggaaaccttgacttctgaattcctatcaggtccagagggtggaaggccctggcaggaagcaggaggaggaggagaggggggtccaggtcttttcaggatcccagctgtgggtgcttctgttgggcccagtggcccctgctatccccacagcctcattcctgcagaaggtttgtgacgtagctgtgcctgtacctggggcagagaggatgccagggacaccaggcctctggcctctccacgagtcactgctctccccattggcagcacgggacccatgctgtgcccccggccaggccctgaggaaatgctcagcctcagtggagatggggaggttagagagatggaggcgtgagtgagaacgggaagcaaaggaatacacgtgggaactaaagagaaaaatgaccagcctgggcagcatagcaagaccctgtctctaaaaaaaataataaaaacttagctgggcatggtggtgcatgcctgtggtcctggctacttgggaggctgaggatggaggatcatttgagcccaggaggtcgaggctgcagtgaaccgtgatcacgccactgcaccccagcccaggcaacaaagtgagcccctgtctctaaataaataaagagacaataagccactca

SEQ ID NO: 21697 - DNA, 2000 bp, Homo sapiens
agcaccagccccagcccggctccctccagagcccacatttgggcccagccccgtccaaggctgcatcccggccctatcccgggtcacggagtgacccttcctcgtcccgatcaccccgcccggtccacccgccatgggcttcttagaggaggagggcagatggaacctgtccttctccggcgccggctacctgggcgcccaccacgtgggcgccaccgaatgcctgcgccagcgagccccgcgcctcctccagggcgcccgccgcatctacggttcctcgtctggggcgctcaacgcagtcagcatcgtctgcggcaagtcggtcgactgcccctccaccatcacggtgtcgcccttccatgggacagtggacatctgcccccagagcacctcccccaacctgcatgagctgaacgtcttcaacttcagcttccaaatctccactgagaacttcttcctggggctcatatgtctcataccccccagcctcgaggtagtggccgacaactgcagacaaggctacctggatgccctgaggttcctggagagacgtggactcaccaaggaaccagtgctatggacgctggtgtctaaggaacccccagccccggctgacggaaactgggatgctggctgtgaccaacgctggaaggggggcctgtctctcaactggaaagtgccccatgtgcaagtcaaggatgtacccaactttgagcagctctcaccagagctggaggctgcactgaagaaagcatgtacgagggatcccagccggtgggcccgcttctggcactcggggcctggacaggtgctgacgtacctgctgctaccctgcacactgcccttcgagtacatctacttccgcagcagaaggttggtggtgtggctgcccgatgtgccggcggacttgtggtggatgcagggcctgctgaggaacatggccctcgaggttttctccaggaccaaggcccagctccttgggcccatcagccctccggccactcgcgtcctggaaacaagccccctccaaccccagatagctcctcatagagaggagctcgggcccacccaccaggcctgagggggccgagcagggccagcccagtgactggtgtcccttgattcctgctctggcctttgtcctgtgtgcccacatctgccccagcgggaagaggccctgccaatctccgtggagaccctgcagcttggagcccgttccttggggcgcagcctgtcagcatgtccccggtcactgtgtacccaggtcacctgccctccctcttgccccgtctcatcagggagagaaaggaggacagccacagagacacatgtcttactttcagaatttccacggggggactaggagggcagcattgctggggagaggggctcctgttctgccgtggagctgcccacggagcacctcacagaagattgagaaagtgcctgatgcccgcgtcagagaccagaggagccaactgagatgatggggtgggggtgctccccccagactttctcagtcctgcagcggcccttgggggtgacccccggcatctaccccactcaggaaaccttgacttctgaattcctatcaggtccagagggtggaaggccctggcaggaagcaggaggaggaggagaggggggtccaggtcttttcaggatcccagctgtgggtgcttctgttgggcccagtggcccctgctatccccacagcctcattcctgcagaaggtttgtgacgtagctgtgcctgtacctggggcagagaggatgccagggacaccaggcctctggcctctccacgagtcactgctctccccattggcagcacgggacccatgctgtgcccccggccaggccctgaggaaatgctcagcctcagtggagatggggaggttagagagatggaggcgtgagtgagaacgggaagcaaaggaatacacgtgggaactaaagagaaaaatgaccagcctgggcagcatagcaagaccctgtctc

SEQ ID NO: 21698 - DNA, 921 bp, Homo sapiens
gctccctccagagcccacatttgggcccagccccgtccaaggctgcatcccggccctatcccgggtcacggagtgacccttcctcgtcccgatcaccccgcccggtccacccgccatgggcttcttagaggaggagggcagatggaacctgtccttctccggcgccggctacctgggcgcccaccacgtgggcgccaccgaatgcctgcgccagcgagccccgcgcctcctccagggcgcccgccgcatctacggttcctcgtctggggcgctcaacgcagtcagcatcgtctgcggcaagtcggtcgacttctgctgctcccacctcctgggcatggttgggcagttggagcggctgagcctaagcatcctgcacccggcctacgcgcccatcgagcacgtcaagcagcagctgcaggatgctctgccccccgacgcccacgtcctggcctcccagcggctgggcatttcgctgacccgctggcctgacggacgcaacttcttggtcactgacttcgccacctgcgatgagctcatccaggtagtggccgacaactgcagacaaggctacctggatgccctgaggttcctggagagacgtggactcaccaaggaaccagtgctatggacgctggtgtctaaggaacccccagccccggctgacggaaactgggatgctggctgtgaccaacgctggaaggggggcctgtctctcaactggaaagtgccccatgtgcaagtcaaggatgtacccaactttgagcagctctcaccagagctggaggctgcactgaagaaagcatgtacgagggatcccagccggtgggcccgcttctggcactcggggcctggacaggtgctgacgtacctgctgctaccctgcacactgcccttcgagtacatctacttccgcagcagaag

SEQ ID NO: 21699 - DNA, 2197 bp, Homo sapiens
agcaccagccccagcccggctccctccagagcccacatttgggcccagccccgtccaaggctgcatcccggccctatcccgggtcacggagtgacccttcctcgtcccgatcaccccgcccggtccacccgccatgggcttcttagaggaggagggcagatggaacctgtccttctccggcgccggctacctgggcgcccaccacgtgggcgccaccgaatgcctgcgccagcgagccccgcgcctcctccagggcgcccgccgcatctacggttcctcgtctggggcgctcaacgcagtcagcatcgtctgcggcaagtcggtcgactgcccctccaccatcacggtgtcgcccttccatgggacagtggacatctgcccccagagcacctcccccaacctgcatgagctgaacgtcttcaacttcagcttccaaatctccactgagaacttcttcctggggctcatatgtctcataccccccagcctcgaggtagtggccgacaactgcagacaaggctacctggatgccctgaggttcctggagagacgtggactcaccaaggaaccagtgctatggacgctggtgtctaaggaacccccagccccggctgacggaaactgggatgctggctgtgaccaacgctggaaggggggcctgtctctcaactggaaagtgccccatgtgcaagtcaaggatgtacccaactttgagcagctctcaccagagctggaggctgcactgaagaaagcatgtacgagggatcccagccggtgggcccgcttctggcactcggggcctggacaggtgctgacgtacctgctgctaccctgcacactgcccttcgagtacatctacttccgcagcagaaggttggtggtgtggctgcccgatgtgccggcggacttgtggtggatgcagggcctgctgaggaacatggccctcgaggttttctccaggaccaaggcccagctccttgggcccatcagccctccggccactcgcgtcctggaaacaagccccctccaaccccagatagctcctcatagagaggagctcgggcccacccaccaggcctgagggggccgagcagggccagcccagtgactggtgtcccttgattcctgctctggcctttgtcctgtgtgcccacatctgccccagcgggaagaggccctgccaatctccgtggagaccctgcagcttggagcccgttccttggggcgcagcctgtcagcatgtccccggtcactgtgtacccaggtcacctgccctccctcttgccccgtctcatcagggagagaaaggaggacagccacagagacacatgtcttactttcagaatttccacggggggactaggagggcagcattgctggggagaggggctcctgttctgccgtggagctgcccacggagcacctcacagaagattgagaaagtgcctgatgcccgcgtcagagaccagaggagccaactgagatgatggggtgggggtgctccccccagactttctcagtcctgcagcggcccttgggggtgacccccggcatctaccccactcaggaaaccttgacttctgaattcctatcaggtccagagggtggaaggccctggcaggaagcaggaggaggaggagaggggggtccaggtcttttcaggatcccagctgtgggtgcttctgttgggcccagtggcccctgctatccccacagcctcattcctgcagaaggtttgtgacgtagctgtgcctgtacctggggcagagaggatgccagggacaccaggcctctggcctctccacgagtcactgctctccccattggcagcacgggacccatgctgtgcccccggccaggccctgaggaaatgctcagcctcagtggagatggggaggttagagagatggaggcgtgagtgagaacgggaagcaaaggaatacacgtgggaactaaagagaaaaatgaccagcctgggcagcatagcaagaccctgtctctaaaaaaaataataaaaacttagctgggcatggtggtgcatgcctgtggtcctggctacttgggaggctgaggatggaggatcatttgagcccaggaggtcgaggctgcagtgaaccgtgatcacgccactgcaccccagcccaggcaacaaagtgagcccctgtctctaaataaataaagagacaataagccactc

SEQ ID NO: 21700 - DNA, 4472 bp, Homo sapiens
agtgaataatttaaaggggccgtgcctgcggagccgggcggaacgctagcggtgttggcgcggagtggaccccggctgcggcccctggcaatggcgccaccatcggtcccggagtcccagtgatgctctgtgccatagagcccccataacttcactactacgtgatagtaaatccccggcaaaaaccagcagcgccttgcaagcccacgccaccccaagcatcccaggactcttctgaaacgactccgggctaccagatcggccgtccagctggaatcaaccgatggaggctccgctgcaaactggaatggtgcttggcgtgatgatcggggccggagtggcggtggtggtcacggccgtgctcatcctcctggtggtgcggaggctgcgagtgccaaaaaccccagccccggatggcccccggtatcggttccggaagagggacaaagtgctcttctatggccggaagattatgcggaaggtgtcacaatccacctcctccctcgtggatacctctgtctccgccacctcccggccacgcatgaggaagaaactgaagatgctcaacattgccaagaagatcctgcgcatccagaaagagacgcccacgctgcagcggaaggagcccccgcccgcagtgctagaagctgacctgaccgagggcgacctggctaactcccatctgccctctgaagtgctttatatgctcaagaacgtccgggtgctgggccacttcgagaagccactcttcctggagctctgccgccacatggtcttccagcggctgggccagggtgactacgtcttccggccgggccagccagatgccagcatctacgtggtgcaggacgggctgctggagctctgtctgccagggcctgacgggaaggagtgtgtggtgaaggaagtggttcctggggacagcgtcaacagccttctcagcatcctggatgtcatcaccggtcaccagcatccccagcggaccgtgtctgcccgggcggcccgggactccacggtgctgcgcctgccggtggaagcattctccgcggtcttcaccaagtacccggagagcttggtgcgggtcgtgcagatcatcatggtgcggctgcagcgagtcaccttcctggcactgcacaactacctgggtctgaccaatgagctcttcagccacgagatccagcccctgcgtctgttccccagccccggcctcccaactcgcaccagccctgtgcggggctccaagagaatggtcagcacctcagctacagacgagcccagggagaccccagggcggccacccgatcccaccggggccccgctgcctggacctacaggggaccctgtgaagcccacatccctggaaaccccctcggcccctctgctgagccgctgcgtctccatgccaggggacatctcaggcttgcagggtggcccccgctccgacttcgacatggcctatgagcgtggccggatctccgtgtccctgcaggaagaggcctccggggggtccctggcagcccccgctcggacccccactcaggagcctcgtgagcagccggcaggcgcctgtgaatacagctactgtgaggatgagtcggccactggtggctgccctttcgggccctaccagggccgccagaccagcagcatcttcgaggcagcaaagcaggagctggccaagctgatgcggattgaggacccctccctcctgaacagcagagtcttgctgcaccacgccaaagctggcaccatcattgcccgccagggagaccaggacgtgagcctgcacttcgtgctctggggctgcctgcacgtgtaccagcgcatgatcgacaaggcggaggacgtgtgcctgttcgtagcgcagcccggggaactggtggggcagctggcggtgctcactggcgaacctctcatcttcacactgcgagcccaacgcgactgcaccttcctgcggatctccaagtccgacttctatgagatcatgcgcgcacagcccagtgtggtgctgagtgcggcgcacacggtggcagccaggatgtcgcccttcgtgcgccagatggacttcgccatcgactggactgcagtggaggcgggacgcgcgctgtacaggcagggcgaccgctccgactgcacttacatcgtgctcaatgggcggctgcgtagcgtgatccagcgaggcagtggcaagaaggagctggtgggcgagtacggccgcggcgacctcatcggcgtggtggaggcactgacccggcagccgcgagccacgacggtgcacgcggtgcgcgacacggagctggccaagcttcccgagggcaccttgggtcacatcaaacgccggtacccgcaggtcgtgacccgccttatccacctactgagccagaaaattctagggaatttgcagcagctgcaaggacccttcccagcaggctctgggttgggtgtgcccccacactcggaactcaccaacccagccagcaacctggcaactgtggcaatcctgcctgtgtgtgctgaggtccccatggtggccttcacgctggagctgcagcacgccctgcaggccatcggtccgacgctactccttaacagtgacatcatccgggcacgcctgggggcctccgcactggatagcatccaagagttccggctgtcagggtggctggcccagcaggaggatgcacaccgtatcgtactctaccagacggacgcctcgctgacgccctggaccgtgcgctgcctgcgacaggccgactgcatcctcattgtgggcctgggggaccaggagcctaccctcggccagctggagcagatgctggagaacacggctgtgcgcgcccttaagcagctagtcctgctccaccgagaggagggcgcgggccccacgcgcaccgtggagtggctaaatatgcgcagctggtgctcggggcacctgcacctgcgctgtccgcgccgcctcttttcgcgccgcagccctgccaagctgcatgagctctacgagaaggttttctccaggcgcgcggaccggcacagcgacttctcccgcttggcgagggtgctcacggggaacaccattgcccttgtgctaggcgggggcggggccaggggctgctcgcacatcggagtactaaaggcattagaggaggcgggggtccccgtggacctggtgggcggcacgtccattggctctttcatcggagcgttgtacgcggaggagcgcagcgccagccgcacgaagcagcgggcccgggagtgggccaagagcatgacttcggtgctggaacctgtgttggacctcacgtacccagtcacctccatgttcactgggtctgcctttaaccgcagcatccatcgggtcttccaggataagcagattgaggacctgtggctgccttacttcaacgtgaccacagatatcaccgcctcagccatgcgagtccacaaagatggctccctgtggcggtacgtgcgcgccagcatgacgctgtcgggctacctgcccccgctgtgcgaccccaaggacgggcacctactcatggatggcggctacatcaacaatctgccagcggacatcgcccgcagcatgggtgccaaaacggtcatcgccattgacgtggggagccaggatgagacggacctcagcacctacggggacagcctgtccggctggtggctgctgtggaagcggctgaatccctgggctgacaaggtaaaggttccagacatggctgaaatccagtcccgcctggcctacgtgtcctgtgtgcggcagctagaggttgtcaagtccagctcctactgcgagtacctgcgcccgcccatcgactgcttcaagaccatggactttgggaagttcgaccagatctatgatgtgggctaccagtacgggaaggcggtgtttggaggctggagccgtggcaacgtcattgagaaaatgctcacagaccggcggtctacagaccttaatgagagccgccgtgcagacgtgcttgccttcccaagctctggcttcactgacttggcagagattgtgtcccggattgagccccccacgagctatgtctctgatggctgtgctgacggagaggagtcagattgtctgacagagtatgaggaggacgccggacccgactgctcgagggatgaaggggggtcccccgagggcgcaagccccagcactgcctccgagatggaggaggagaagtcgattctccggcaacgacgctgtctgccccaggagccgcccggctcagccacagatgcctgaggacctcgacaggggtcaccccctccctcccacccctggactgggctgggggtggccccgtgggggtagctcactccccctcctgctgctatgcctgtgacccccgcggcccacacactggactgacctgccctgagcggggatgcagtgttgcactgatgacttgaccagcccctcccccaataaactcgcctcttggaaatgg

SEQ ID NO: 21701 - DNA, 4573 bp, Homo sapiens
gcatccccacccactaatcccagcgtctctggttacgcctcccagcaatggcgccaccatcggtcccggagtcccagtgatgctctgtgccatagagcccccataacttcactactacgtgatagtaaatccccggcaaaaaccagcagcgccttgcaagcccacgccaccccaagcatcccaggactcttctgaaacgactccgggctaccagatcggccgtccagctggaatcaaccgatggaggctccgctgcaaactggaatgatggggacatcgagtcacgggctggctacgaactcctcgggggcgaaggtggcggagagggatgggttccaggacgtcctggcgcccggggaaggctcggcgggacggatttgcggtgcgcagccagtgccgttcgtccctcaggtgcttggcgtgatgatcggggccggagtggcggtggtggtcacggccgtgctcatcctcctggtggtgcggaggctgcgagtgccaaaaaccccagccccggatggcccccggtatcggttccggaagagggacaaagtgctcttctatggccggaagattatgcggaaggtgtcacaatccacctcctccctcgtggatacctctgtctccgccacctcccggccacgcatgaggaagaaactgaagatgctcaacattgccaagaagatcctgcgcatccagaaagagacgcccacgctgcagcggaaggagcccccgcccgcagtgctagaagctgacctgaccgagggcgacctggctaactcccatctgccctctgaagtgctttatatgctcaagaacgtccgggtgctgggccacttcgagaagccactcttcctggagctctgccgccacatggtcttccagcggctgggccagggtgactacgtcttccggccgggccagccagatgccagcatctacgtggtgcaggacgggctgctggagctctgtctgccagggcctgacgggaaggagtgtgtggtgaaggaagtggttcctggggacagcgtcaacagccttctcagcatcctggatgtcatcaccggtcaccagcatccccagcggaccgtgtctgcccgggcggcccgggactccacggtgctgcgcctgccggtggaagcattctccgcggtcttcaccaagtacccggagagcttggtgcgggtcgtgcagatcatcatggtgcggctgcagcgagtcaccttcctggcactgcacaactacctgggtctgaccaatgagctcttcagccacgagatccagcccctgcgtctgttccccagccccggcctcccaactcgcaccagccctgtgcggggctccaagagaatggtcagcacctcagctacagacgagcccagggagaccccagggcggccacccgatcccaccggggccccgctgcctggacctacaggggaccctgtgaagcccacatccctggaaaccccctcggcccctctgctgagccgctgcgtctccatgccaggggacatctcaggcttgcagggtggcccccgctccgacttcgacatggcctatgagcgtggccggatctccgtgtccctgcaggaagaggcctccggggggtccctggcagcccccgctcggacccccactcaggagcctcgtgagcagccggcaggcgcctgtgaatacagctactgtgaggatgagtcggccactggtggctgccctttcgggccctaccagggccgccagaccagcagcatcttcgaggcagcaaagcaggagctggccaagctgatgcggattgaggacccctccctcctgaacagcagagtcttgctgcaccacgccaaagctggcaccatcattgcccgccagggagaccaggacgtgagcctgcacttcgtgctctggggctgcctgcacgtgtaccagcgcatgatcgacaaggcggaggacgtgtgcctgttcgtagcgcagcccggggaactggtggggcagctggcggtgctcactggcgaacctctcatcttcacactgcgagcccaacgcgactgcaccttcctgcggatctccaagtccgacttctatgagatcatgcgcgcacagcccagtgtggtgctgagtgcggcgcacacggtggcagccaggatgtcgcccttcgtgcgccagatggacttcgccatcgactggactgcagtggaggcgggacgcgcgctgtacaggcagggcgaccgctccgactgcacttacatcgtgctcaatgggcggctgcgtagcgtgatccagcgaggcagtggcaagaaggagctggtgggcgagtacggccgcggcgacctcatcggcgtggtggaggcactgacccggcagccgcgagccacgacggtgcacgcggtgcgcgacacggagctggccaagcttcccgagggcaccttgggtcacatcaaacgccggtacccgcaggtcgtgacccgccttatccacctactgagccagaaaattctagggaatttgcagcagctgcaaggacccttcccagcaggctctgggttgggtgtgcccccacactcggaactcaccaacccagccagcaacctggcaactgtggcaatcctgcctgtgtgtgctgaggtccccatggtggccttcacgctggagctgcagcacgccctgcaggccatcggtccgacgctactccttaacagtgacatcatccgggcacgcctgggggcctccgcactggatagcatccaagagttccggctgtcagggtggctggcccagcaggaggatgcacaccgtatcgtactctaccagacggacgcctcgctgacgccctggaccgtgcgctgcctgcgacaggccgactgcatcctcattgtgggcctgggggaccaggagcctaccctcggccagctggagcagatgctggagaacacggctgtgcgcgcccttaagcagctagtcctgctccaccgagaggagggcgcgggccccacgcgcaccgtggagtggctaaatatgcgcagctggtgctcggggcacctgcacctgcgctgtccgcgccgcctcttttcgcgccgcagccctgccaagctgcatgagctctacgagaaggttttctccaggcgcgcggaccggcacagcgacttctcccgcttggcgagggtgctcacggggaacaccattgcccttgtgctaggcgggggcggggccaggggctgctcgcacatcggagtactaaaggcattagaggaggcgggggtccccgtggacctggtgggcggcacgtccattggctctttcatcggagcgttgtacgcggaggagcgcagcgccagccgcacgaagcagcgggcccgggagtgggccaagagcatgacttcggtgctggaacctgtgttggacctcacgtacccagtcacctccatgttcactgggtctgcctttaaccgcagcatccatcgggtcttccaggataagcagattgaggacctgtggctgccttacttcaacgtgaccacagatatcaccgcctcagccatgcgagtccacaaagatggctccctgtggcggtacgtgcgcgccagcatgacgctgtcgggctacctgcccccgctgtgcgaccccaaggacgggcacctactcatggatggcggctacatcaacaatctgccagcggacatcgcccgcagcatgggtgccaaaacggtcatcgccattgacgtggggagccaggatgagacggacctcagcacctacggggacagcctgtccggctggtggctgctgtggaagcggctgaatccctgggctgacaaggtaaaggttccagacatggctgaaatccagtcccgcctggcctacgtgtcctgtgtgcggcagctagaggttgtcaagtccagctcctactgcgagtacctgcgcccgcccatcgactgcttcaagaccatggactttgggaagttcgaccagatctatgatgtgggctaccagtacgggaaggcggtgtttggaggctggagccgtggcaacgtcattgagaaaatgctcacagaccggcggtctacagaccttaatgagagccgccgtgcagacgtgcttgccttcccaagctctggcttcactgacttggcagagattgtgtcccggattgagccccccacgagctatgtctctgatggctgtgctgacggagaggagtcagattgtctgacagagtatgaggaggacgccggacccgactgctcgagggatgaaggggggtcccccgagggcgcaagccccagcactgcctccgagatggaggaggagaagtcgattctccggcaacgacgctgtctgccccaggagccgcccggctcagccacagatgcctgaggacctcgacaggggtcaccccctccctcccacccctggactgggctgggggtggccccgtgggggtagctcactccccctcctgctgctatgcctgtgacccccgcggcccacacactggactgacctgccctgagcggggatgcagtgttgcactgatgacttgaccagcccctcccccaataaactcgcctcttggaaatgg

SEQ ID NO: 21702 - DNA, 4460 bp, Homo sapiens
caatggcgccaccatcggtcccggagtcccagtgatgctctgtgccatagagcccccataacttcactactacgtgatagtaaatccccggcaaaaaccagcagcgccttgcaagcccacgccaccccaagcatcccaggactcttctgaaacagggcagtgacccgggaggaagtcaccaggtgcagaggaccgtgccctgtggggacctgcctgcaggctgctgacagactccgggctaccagatcggccgtccagctggaatcaaccgatggaggctccgctgcaaactggaatggtgcttggcgtgatgatcggggccggagtggcggtggtggtcacggccgtgctcatcctcctggtggtgcggaggctgcgagtgccaaaaaccccagccccggatggcccccggtatcggttccggaagagggacaaagtgctcttctatggccggaagattatgcggaaggtgtcacaatccacctcctccctcgtggatacctctgtctccgccacctcccggccacgcatgaggaagaaactgaagatgctcaacattgccaagaagatcctgcgcatccagaaagagacgcccacgctgcagcggaaggagcccccgcccgcagtgctagaagctgacctgaccgagggcgacctggctaactcccatctgccctctgaagtgctttatatgctcaagaacgtccgggtgctgggccacttcgagaagccactcttcctggagctctgccgccacatggtcttccagcggctgggccagggtgactacgtcttccggccgggccagccagatgccagcatctacgtggtgcaggacgggctgctggagctctgtctgccagggcctgacgggaaggagtgtgtggtgaaggaagtggttcctggggacagcgtcaacagccttctcagcatcctggatgtcatcaccggtcaccagcatccccagcggaccgtgtctgcccgggcggcccgggactccacggtgctgcgcctgccggtggaagcattctccgcggtcttcaccaagtacccggagagcttggtgcgggtcgtgcagatcatcatggtgcggctgcagcgagtcaccttcctggcactgcacaactacctgggtctgaccaatgagctcttcagccacgagatccagcccctgcgtctgttccccagccccggcctcccaactcgcaccagccctgtgcggggctccaagagaatggtcagcacctcagctacagacgagcccagggagaccccagggcggccacccgatcccaccggggccccgctgcctggacctacaggggaccctgtgaagcccacatccctggaaaccccctcggcccctctgctgagccgctgcgtctccatgccaggggacatctcaggcttgcagggtggcccccgctccgacttcgacatggcctatgagcgtggccggatctccgtgtccctgcaggaagaggcctccggggggtccctggcagcccccgctcggacccccactcaggagcctcgtgagcagccggcaggcgcctgtgaatacagctactgtgaggatgagtcggccactggtggctgccctttcgggccctaccagggccgccagaccagcagcatcttcgaggcagcaaagcaggagctggccaagctgatgcggattgaggacccctccctcctgaacagcagagtcttgctgcaccacgccaaagctggcaccatcattgcccgccagggagaccaggacgtgagcctgcacttcgtgctctggggctgcctgcacgtgtaccagcgcatgatcgacaaggcggaggacgtgtgcctgttcgtagcgcagcccggggaactggtggggcagctggcggtgctcactggcgaacctctcatcttcacactgcgagcccaacgcgactgcaccttcctgcggatctccaagtccgacttctatgagatcatgcgcgcacagcccagtgtggtgctgagtgcggcgcacacggtggcagccaggatgtcgcccttcgtgcgccagatggacttcgccatcgactggactgcagtggaggcgggacgcgcgctgtacaggcagggcgaccgctccgactgcacttacatcgtgctcaatgggcggctgcgtagcgtgatccagcgaggcagtggcaagaaggagctggtgggcgagtacggccgcggcgacctcatcggcgtggtggaggcactgacccggcagccgcgagccacgacggtgcacgcggtgcgcgacacggagctggccaagcttcccgagggcaccttgggtcacatcaaacgccggtacccgcaggtcgtgacccgccttatccacctactgagccagaaaattctagggaatttgcagcagctgcaaggacccttcccagcaggctctgggttgggtgtgcccccacactcggaactcaccaacccagccagcaacctggcaactgtggcaatcctgcctgtgtgtgctgaggtccccatggtggccttcacgctggagctgcagcacgccctgcaggccatcggtccgacgctactccttaacagtgacatcatccgggcacgcctgggggcctccgcactggatagcatccaagagttccggctgtcagggtggctggcccagcaggaggatgcacaccgtatcgtactctaccagacggacgcctcgctgacgccctggaccgtgcgctgcctgcgacaggccgactgcatcctcattgtgggcctgggggaccaggagcctaccctcggccagctggagcagatgctggagaacacggctgtgcgcgcccttaagcagctagtcctgctccaccgagaggagggcgcgggccccacgcgcaccgtggagtggctaaatatgcgcagctggtgctcggggcacctgcacctgcgctgtccgcgccgcctcttttcgcgccgcagccctgccaagctgcatgagctctacgagaaggttttctccaggcgcgcggaccggcacagcgacttctcccgcttggcgagggtgctcacggggaacaccattgcccttgtgctaggcgggggcggggccaggggctgctcgcacatcggagtactaaaggcattagaggaggcgggggtccccgtggacctggtgggcggcacgtccattggctctttcatcggagcgttgtacgcggaggagcgcagcgccagccgcacgaagcagcgggcccgggagtgggccaagagcatgacttcggtgctggaacctgtgttggacctcacgtacccagtcacctccatgttcactgggtctgcctttaaccgcagcatccatcgggtcttccaggataagcagattgaggacctgtggctgccttacttcaacgtgaccacagatatcaccgcctcagccatgcgagtccacaaagatggctccctgtggcggtacgtgcgcgccagcatgacgctgtcgggctacctgcccccgctgtgcgaccccaaggacgggcacctactcatggatggcggctacatcaacaatctgccagcggacatcgcccgcagcatgggtgccaaaacggtcatcgccattgacgtggggagccaggatgagacggacctcagcacctacggggacagcctgtccggctggtggctgctgtggaagcggctgaatccctgggctgacaaggtaaaggttccagacatggctgaaatccagtcccgcctggcctacgtgtcctgtgtgcggcagctagaggttgtcaagtccagctcctactgcgagtacctgcgcccgcccatcgactgcttcaagaccatggactttgggaagttcgaccagatctatgatgtgggctaccagtacgggaaggcggtgtttggaggctggagccgtggcaacgtcattgagaaaatgctcacagaccggcggtctacagaccttaatgagagccgccgtgcagacgtgcttgccttcccaagctctggcttcactgacttggcagagattgtgtcccggattgagccccccacgagctatgtctctgatggctgtgctgacggagaggagtcagattgtctgacagagtatgaggaggacgccggacccgactgctcgagggatgaaggggggtcccccgagggcgcaagccccagcactgcctccgagatggaggaggagaagtcgattctccggcaacgacgctgtctgccccaggagccgcccggctcagccacagatgcctgaggacctcgacaggggtcaccccctccctcccacccctggactgggctgggggtggccccgtgggggtagctcactccccctcctgctgctatgcctgtgacccccgcggcccacacactggactgacctgccctgagcggggatgcagtgttgcactgatgacttgaccagcccctcccccaataaactcgcctcttggaaatgg

SEQ ID NO: 21703 - DNA, 1482 bp, Homo sapiens
agcaatggcgccaccatcggtcccggagtcccagtgatgctctgtgccatagagcccccggtatcggttccggaagagggacaaagtgctcttctatggccggaagattatgcggaaggtgtcacaatccacctcctccctcgtggatacctctgtctccgccacctcccggccacgcatgaggaagaaactgaagatgctcaacattgccaagaagatcctgcgcatccagaaagagacgcccacgctgcagcggaaggagcccccgcccgcagtgctagaagctgacctgaccgagggcgacctggctaactcccatctgccctctgaagtgctttatatgctcaagaacgtccgggtgctgggccacttcgagaagccactcttcctggagctctgccgccacatggtcttccagcggctgggccagggtgactacgtcttccggccgggccagccagatgccagcatctacgtggtgcaggacgggctgctggagctctgtctgccagggcctgacgggaaggagtgtgtggtgaaggaagtggttcctggggacagcgtcaacagccttctcagcatcctggatgtcatcaccggtcaccagcatccccagcggaccgtgtctgcccgggcggcccgggactccacggtgctgcgcctgccggtggaagcattctccgcggtcttcaccaagtacccggagagcttggtgcgggtcgtgcagatcatcatggtgcggctgcagcgagtcaccttcctggcactgcacaactacctgggtctgaccaatgagctcttcagccacgagatccagcccctgcgtctgttccccagccccggcctcccaactcgcaccagccctgtgcggggctccaagagaatggtcagcacctcagctacagacgagcccagggagaccccagggcggccacccgatcccaccggggccccgctgcctggacctacaggggaccctgtgaagcccacatccctggaaaccccctcggcccctctgctgagccgctgcgtctccatgccaggggacatctcaggcttgcagggtggcccccgctccgacttcgacatggcctatgagcgtggccggatctccgtgtccctgcaggaagaggcctccggggggtccctggcagcccccgctcggacccccactcaggagcctcgtgagcagccggcaggcgcctgtgaatacagctactgtgaggatgagtcggccactggtggctgccctttcgggccctaccagggccgccagaccagcagcatcttcgaggcagcaaagcaggagctggccaagctgatgcggattgaggacccctccctcctgaacagcagagtcttgctgcaccacgccaaagctggcaccatcattgcccgccagggagaccaggacgtgagcggcccacacactggactgacctgccctgagcggggatgcagtgttgcactgatgacttgacc

SEQ ID NO: 21704 - DNA, 4508 bp, Homo sapiens
gagtctgggtttccgttagcctcgcaggggtgtcccttcgagggtcgttagcgagcctccgctttcccacgatctgtcctccgattcctgttaactctagactttctgatgttcccataccccccacgtctcggcaggtgtttccacaccggtagccagctgtgccctgaggtggaagaggaccggccacccaggaattttccaacaatggcgccaccatcggtcccggagtcccagtgatgctctgtgccatagagcccccataacttcactactacgtgatagtaaatccccggcaaaaaccagcagcgccttgcaagcccacgccaccccaagcatcccaggactcttctgaaacgactccgggctaccagatcggccgtccagctggaatcaaccgatggaggctccgctgcaaactggaatggtgcttggcgtgatgatcggggccggagtggcggtggtggtcacggccgtgctcatcctcctggtggtgcggaggctgcgagtgccaaaaaccccagccccggatggcccccggtatcggttccggaagagggacaaagtgctcttctatggccggaagattatgcggaaggtgtcacaatccacctcctccctcgtggatacctctgtctccgccacctcccggccacgcatgaggaagaaactgaagatgctcaacattgccaagaagatcctgcgcatccagaaagagacgcccacgctgcagcggaaggagcccccgcccgcagtgctagaagctgacctgaccgagggcgacctggctaactcccatctgccctctgaagtgctttatatgctcaagaacgtccgggtgctgggccacttcgagaagccactcttcctggagctctgccgccacatggtcttccagcggctgggccagggtgactacgtcttccggccgggccagccagatgccagcatctacgtggtgcaggacgggctgctggagctctgtctgccagggcctgacgggaaggagtgtgtggtgaaggaagtggttcctggggacagcgtcaacagccttctcagcatcctggatgtcatcaccggtcaccagcatccccagcggaccgtgtctgcccgggcggcccgggactccacggtgctgcgcctgccggtggaagcattctccgcggtcttcaccaagtacccggagagcttggtgcgggtcgtgcagatcatcatggtgcggctgcagcgagtcaccttcctggcactgcacaactacctgggtctgaccaatgagctcttcagccacgagatccagcccctgcgtctgttccccagccccggcctcccaactcgcaccagccctgtgcggggctccaagagaatggtcagcacctcagctacagacgagcccagggagaccccagggcggccacccgatcccaccggggccccgctgcctggacctacaggggaccctgtgaagcccacatccctggaaaccccctcggcccctctgctgagccgctgcgtctccatgccaggggacatctcaggcttgcagggtggcccccgctccgacttcgacatggcctatgagcgtggccggatctccgtgtccctgcaggaagaggcctccggggggtccctggcagcccccgctcggacccccactcaggagcctcgtgagcagccggcaggcgcctgtgaatacagctactgtgaggatgagtcggccactggtggctgccctttcgggccctaccagggccgccagaccagcagcatcttcgaggcagcaaagcaggagctggccaagctgatgcggattgaggacgtgagcctgcacttcgtgctctggggctgcctgcacgtgtaccagcgcatgatcgacaaggcggaggacgtgtgcctgttcgtagcgcagcccggggaactggtggggcagctggcggtgctcactggcgaacctctcatcttcacactgcgagcccaacgcgactgcaccttcctgcggatctccaagtccgacttctatgagatcatgcgcgcacagcccagtgtggtgctgagtgcggcgcacacggtggcagccaggatgtcgcccttcgtgcgccagatggacttcgccatcgactggactgcagtggaggcgggacgcgcgctgtacaggcagggcgaccgctccgactgcacttacatcgtgctcaatgggcggctgcgtagcgtgatccagcgaggcagtggcaagaaggagctggtgggcgagtacggccgcggcgacctcatcggcgtggtggaggcactgacccggcagccgcgagccacgacggtgcacgcggtgcgcgacacggagctggccaagcttcccgagggcaccttgggtcacatcaaacgccggtacccgcaggtcgtgacccgccttatccacctactgagccagaaaattctagggaatttgcagcagctgcaaggacccttcccaggctctgggttgggtgtgcccccacactcggaactcaccaacccagccagcaacctggcaactgtggcaatcctgcctgtgtgtgctgaggtccccatggtggccttcacgctggagctgcagcacgccctgcaggccatcggtccgacgctactccttaacagtgacatcatccgggcacgcctgggggcctccgcactggatagcatccaagagttccggctgtcagggtggctggcccagcaggaggatgcacaccgtatcgtactctaccagacggacgcctcgctgacgccctggaccgtgcgctgcctgcgacaggccgactgcatcctcattgtgggcctgggggaccaggagcctaccctcggccagctggagcagatgctggagaacacggctgtgcgcgcccttaagcagctagtcctgctccaccgagaggagggcgcgggccccacgcgcaccgtggagtggctaaatatgcgcagctggtgctcggggcacctgcacctgcgctgtccgcgccgcctcttttcgcgccgcagccctgccaagctgcatgagctctacgagaaggttttctccaggcgcgcggaccggcacagcgacttctcccgcttggcgagggtgctcacggggaacaccattgcccttgtgctaggcgggggcggggccaggggctgctcgcacatcggagtactaaaggcattagaggaggcgggggtccccgtggacctggtgggcggcacgtccattggctctttcatcggagcgttgtacgcggaggagcgcagcgccagccgcacgaagcagcgggcccgggagtgggccaagagcatgacttcggtgctggaacctgtgttggacctcacgtacccagtcacctccatgttcactgggtctgcctttaaccgcagcatccatcgggtcttccaggataagcagattgaggacctgtggctgccttacttcaacgtgaccacagatatcaccgcctcagccatgcgagtccacaaagatggctccctgtggcggtacgtgcgcgccagcatgacgctgtcgggctacctgcccccgctgtgcgaccccaaggacgggcacctactcatggatggcggctacatcaacaatctgccagcggacatcgcccgcagcatgggtgccaaaacggtcatcgccattgacgtggggagccaggatgagacggacctcagcacctacggggacagcctgtccggctggtggctgctgtggaagcggctgaatccctgggctgacaaggtaaaggttccagacatggctgaaatccagtcccgcctggcctacgtgtcctgtgtgcggcagctagaggttgtcaagtccagctcctactgcgagtacctgcgcccgcccatcgactgcttcaagaccatggactttgggaagttcgaccagatctatgatgtgggctaccagtacgggaaggcggtgtttggaggctggagccgtggcaacgtcattgagaaaatgctcacagaccggcggtctacagaccttaatgagagccgccgtgcagacgtgcttgccttcccaagctctggcttcactgacttggcagagattgtgtcccggattgagccccccacgagctatgtctctgatggctgtgctgacggagaggagtcagattgtctgacagagtatgaggaggacgccggacccgactgctcgagggatgaaggggggtcccccgagggcgcaagccccagcactgcctccgagatggaggaggagaagtcgattctccggcaacgacgctgtctgccccaggagccgcccggctcagccacagatgcctgaggacctcgacaggggtcaccccctccctcccacccctggactgggctgggggtggccccgtgggggtagctcactccccctcctgctgctatgcctgtgacccccgcggcccacacactggactgacctgccctgagcggggatgcagtgttgcactgatgacttgaccagcccctcccccaataaactcgcctcttggaaatgg

SEQ ID NO: 21705 - DNA, 4581 bp, Homo sapiens
aaaagacagcttttcttcctggagaacagactttttcagcaggattttcctttcagtgaaacataatttgacttgaaaggaacccagggaaaagtgtccaggtgtgagcatgagcgggtagaggtgtgcccttgtttgcttcaggctgtctgcttttcgcccctgactgttttttctgtttctggccatggaggaagagaaagatgacagcccacagctgacggggattgcagttggagccctcctggccctggccttggttggtgtcctcatccttttcatgttcagaaggcttagacaatttcgacaagcacagcccactcctcagtaccggttccggaagagagacaaagtgatgttttacggccggaagatcatgaggaaggtgaccacactccccaacacccttgtggagaacactgccctgccccggcagcgggccaggaagaggaccaaggtgctgtctttggccaagaggattctgcgtttcaagaaggaatacccggccctgcagcccaaggagcccccgccctccctgctggaggccgacctcacggagtttgacgtgaagaattctcacctgccatcggaagttctgtacatgctgaaaaacgttcgggtcctgggccactttgagaagccgctgttcctggagctttgcaaacacatcgtctttgtgcagctgcaggaaggggagcacgtcttccagcccagggagccggaccccagcatctgtgtggtgcaggacgggcggctggaggtctgcatccaggacactgacggcaccgaggtggtggtgaaagaggttctggcgggagacagcgtccacagcctgctcagcatcctggacatcatcaccggccatgctgcaccttacaaaacggtctccgtccgcgcggccatcccgtccaccatcctccggcttccagctgcggcttttcatggagtttttgagaaatatccggaaactctggtgagggtggtgcagatcatcatggtgcggctgcagagggtgacctttctggctctgcacaactacctcggcctgaccacagagctcttcaacgctgagagccaggccatccctctcgtgtctgtagccagtgtggctgccgggaaggccaagaagcaggtgttctatggcgaagaagagcggcttaaaaagccaccgcggctccaggagtcctgtgactcagatcacgggggcggccgcccggcagctgctgggcccctgctgaagaggagccactccgtccccgcgccttccattcgcaaacagatcttggaggagctggagaagcccggggcaggtgaccctgacccttcggccccacaagggggcccaggcagtgccacttctgatctggggatggcatgtgaccgtgccagggtcttcctgcactcggacgagcaccccgggagctccgtggccagcaagtccaggaaaagcgtgatggttgcagagataccctccacggtctcccagcactcagagagtcacacggatgagaccctggccagcaggaagtcggatgccatcttcagagctgccaagaaggacctgctcaccctgatgaagctggaagactcatctctgttggatggccgggtggcgcttctgcacgttcctgcaggcacggtggtgtcaaggcagggagaccaggacgccagcatcctgttcgtggtctcggggctgctgcacgtgtaccagcggaagatcggcagccaggaggacacctgcttgttcctcacgcgccccggggagatggtgggccagctggccgtgctcaccggggagcctctcatcttcaccgtcaaggccaacagggactgcagcttcctgtccatctccaaggcccacttctatgaaatcatgcggaagcagccgaccgtcgtcctgggtgtggcgcacactgtggtgaagaggatgtcgtccttcgtgcggcaaatcgactttgccctggactgggtggaggtggaggccgggcgagcaatatacaggcagggggacaagtccgactgcacgtacatcatgctcagcggccggctgcgctctgtgatccggaaggatgatgggaagaagcgcctggccggggagtacggccgaggagacctcgtcggcgtggtggagacactgacccaccaggcccgggcgaccacggtgcatgccgttcgggactcagaattggccaagctgccggcaggagccctcacgtccatcaagcgcaggtacccacaggtggtgactcggctgattcatctcttgggtgagaagatcctgggcagcctccagcagggacctgtgacaggccaccagcttgggctccccacggagggcagcaagtgggacttggggaacccggctgtcaacctgtccacggtggcagtgatgcccgtgtcagaggaagtgcccctcaccgccttcgccctggagctggagcatgccctcagcgccatcggcccgaccctgctgctgactagtgacaacataaaacggcgccttggctccgctgccctggacagtgttcacgagtaccggctgtccagctggctggggcagcaggaggacacccacaggatcgtgctctaccaggtagatggcacgctcacaccctggacccagcgctgcgtgcgccaggccgactgcatcctcatcgtgggcctgggtgaccaggagcccacagtgggcgagctggagcggatgctggagagcacagctgtgcgtgcccagaagcagctgatcctgctgcacagggaggagggcccggcgccagcgcgcaccgtggagtggctcaacatgcggagctggtgctccggccacctgcacctctgctgcccgcgccgcgtcttctccaggaggagcctgcccaagctggtggagatgtacaagcatgtcttccagcggcccccggaccgacactcagacttctcccgcctggcgagggtgctgacgggcaacgccattgccctggtgcttgggggagggggagcaagaggctgtgcccaggtgggcgttctcaaggccttggcggagtgcggcatccctgtggacatggtgggaggcacgtccatcggggccttcgtgggtgccctgtactctgaggagcggaactacagccagatgcggatccgggccaagcagtgggccgagggcatgacgtccttgatgaaggccgcgctggacctcacctaccccatcacgtccatgttctccggagccggcttcaacagcagcatcttcagcgtcttcaaggaccagcagatcgaggacctgtggattccttatttcgccatcaccaccgacatcacagcctcggccatgcgggtccacaccgacggctccctgtggtggtacgtgcgtgccagcatgtccctgtccggttacatgccccctctctgtgacccgaaggacggacacctgctgatggacgggggctacatcaacaacctcccagcggatgtggcccggtccatgggggcaaaagtggtgatcgccattgacgtgggcagccgagatgagacggacctcaccaactatggggatgcgctgtctgggtggtggctgctgtggaaacgctggaaccccttggccacgaaagtcaaggtgttgaacatggcagagattcagacgcgcctggcctacgtgtgttgcgtgcggcagctggaggtggtgaagagcagtgactactgcgagtacctgcgcccccccatcgacagctacagcaccctggacttcggcaagttcaacgagatctgcgaagtgggctaccagcacgggcgcacggtgtttgacatctggggccgcagcggcgtgctggagaagatgctccgcgaccagcaggggccgagcaagaagcccgcgagtgcggtcctcacctgtcccaacgcctccttcacggaccttgccgaaattgtgtctcgcattgagcccgccaagcccgccatggtggatgacgaatctgactaccagacggagtacgaggaggagctgctggacgtccccagggatgcatacgcagacttccagagcacctcagcccagcagggctcagacttggaggacgagtcctcactgcggcatcgacaccccagtctggctttcccaaaactgtctgagggctcctctgaccaggacgggtagaggcctctgctaaagagcccggatgcagcgtcttccgtgggactgtccccaaggctgaggctcctgccaagtcctaggggcctctgtacctgccctgctggaagccctgacttccccggggccccaggctgtgttagggttctctgggcctcttctttgtaccagcagccctgcatacagggccctgtgagcccccctgcagtcctgtgaggcccctgaagctctgtgaggcccctgaagctctgtgaaccccctgcagccctgtgaggccccccgaagccctgtgaggccccccgaagccctgtgaaccacctgctgccctgtgaggcccccaaagccctgtgaactgcctgctgtcctgtgaactgcctgctgccctgtgaggtgtgggagccctgatgctgccgtgtgatgtttcaataaaggtggatctcactgtt

SEQ ID NO: 21706 - DNA, 2741 bp, Homo sapiens
cttacaaaacggtctccgtccgcgcggccatcccgtccaccatcctccggcttccagctgcggcttttcatggagtttttgagaaatatccggaaactctggtgagggtggtgcagatcatcatggtgcggctgcagagggtgacctttctggctctgcacaactacctcggcctgaccacagagctcttcaacgctgagagccaggccatccctctcgtgtctgtagccagtgtggctgccgggaaggccaagaagcaggtgttctatggcgaagaagagcggcttaaaaagccaccgcggctccaggagtcctgtgactcagcagatcacgggggcggccgcccggcagctgctgggcccctgctgaagaggagccactccgtccccgcgccttccattcgcaaacagatcttggaggagctggagaagcccggggcaggtgaccctgacccttcggccccacaaggccaccagcttgggctccccacggagggcagcaagtgggacttggggaacccggctgtcaacctgtccacggtggcagtgatgcccgtgtcagaggaagtgcccctcaccgccttcgccctggagctggagcatgccctcagcgccatcggcccgaccctgctgctgactagtgacaacataaaacggcgccttggctccgctgccctggacagtgttcacgagtaccggctgtccagctggctggggcagcaggaggacacccacaggatcgtgctctaccaggtagatggcacgctcacaccctggacccagcgctgcgtgcgccaggccgactgcatcctcatcgtgggcctgggtgaccaggagcccacagtgggcgagctggagcggatgctggagagcacagctgtgcgtgcccagaagcagctgatcctgctgcacagggaggagggcccggcgccagcgcgcaccgtggagtggctcaacatgcggagctggtgctccggccacctgcacctctgctgcccgcgccgcgtcttctccaggaggagcctgcccaagctggtggagatgtacaagcatgtcttccagcggcccccggaccgacactcagacttctcccgcctggcgagggtgctgacgggcaacgccattgccctggtgcttgggggagggggagcaagaggctgtgcccaggtgggcgttctcaaggccttggcggagtgcggcatccctgtggacatggtgggaggcacgtccatcggggccttcgtgggtgccctgtactctgaggagcggaactacagccagatgcggatccgggccaagcagtgggccgagggcatgacgtccttgatgaaggccgcgctggacctcacctaccccatcacgtccatgttctccggagccggcttcaacagcagcatcttcagcgtcttcaaggaccagcagatcgaggacctgtggattccttatttcgccatcaccaccgacatcacagcctcggccatgcgggtccacaccgacggctccctgtggtggtacgtgcgtgccagcatgtccctgtccggttacatgccccctctctgtgacccgaaggacggacacctgctgatggacgggggctacatcaacaacctcccagcggatgtggcccggtccatgggggcaaaagtggtgatcgccattgacgtgggcagccgagatgagacggacctcaccaactatggggatgcgctgtctgggtggtggctgctgtggaaacgctggaaccccttggccacgaaagtcaaggtgttgaacatggcagagattcagacgcgcctggcctacgtgtgttgcgtgcggcagctggaggtggtgaagagcagtgactactgcgagtacctgcgcccccccatcgacagctacagcaccctggacttcggcaagttcaacgagatctgcgaagtgggctaccagcacgggcgcacggtgtttgacatctggggccgcagcggcgtgctggagaagatgctccgcgaccagcaggggccgagcaagaagcccgcgagtgcggtcctcacctgtcccaacgcctccttcacggaccttgccgaaattgtgtctcgcattgagcccgccaagcccgccatggtggatgacgaatctgactaccagacggagtacgaggaggagctgctggacgtccccagggatgcatacgcagacttccagagcacctcagcccagcagggctcagacttggaggacgagtcctcactgcggcatcgacaccccagtctggctttcccaaaactgtctgagggctcctctgaccaggacgggtagaggcctctgctaaagagcccggatgcagcgtcttccgtgggactgtccccaaggctgaggctcctgccaagtcctaggggcctctgtacctgccctgctggaagccctgacttccccggggccccaggctgtgttagggttctctgggcctcttctttgtaccagcagccctgcatacagggccctgtgagcccccctgcagtcctgtgaggcccctgaagctctgtgaggcccctgaagctctgtgaaccccctgcagccctgtgaggccccccgaagccctgtgaggccccccgaagccctgtgaaccacctgctgccctgtgaggcccccaaagccctgtgaactgcctgctgtcctgtgaactgcctgctgccctgtgaggtgtgggagccctgatgctgccgtgtgatgtttcaataaaggtggatctcactgttg

SEQ ID NO: 21707 - DNA, 2344 bp, Homo sapiens
aaaagacagcttttcttcctggagaacagactttttcagcaggattttcctttcagtgaaacataatttgacttgaaaggaacccagggaaaagtgtccaggtgtgagcatgagcgggtagaggtgtgcccttgtttgcttcaggctgtctgcttttcgcccctgactgttttttctgtttctggccatggaggaagagaaagatgacagcccacaggctgacttctgcctgggcaccgccctgcactcttggggactgtggttcacggaggaaggttcaccgtccaccatgctgacggggattgcagttggagccctcctggccctggccttggttggtgtcctcatccttttcatgttcagaaggcttagacaatttcgacaagcacagcccactcctcagtaccggttccggaagagagacaaagtgatgttttacggccggaagatcatgaggaaggtgaccacactccccaacacccttgtggagaacactgccctgccccggcagcgggccaggaagaggaccaaggtgctgtctttggccaagaggattctgcgtttcaagaaggaatacccggccctgcagcccaaggagcccccgccctccctgctggaggccgacctcacggagtttgacgtgaagaattctcacctgccatcggaagttctgtacatgctgaaaaacgttcgggtcctgggccactttgagaagccgctgttcctggagctttgcaaacacatcgtctttgtgcagctgcaggaaggggagcacgtcttccagcccagggagccggaccccagcatctgtgtggtgcaggacgggcggctggaggtctgcatccaggacactgacggcaccgaggtggtggtgaaagaggttctggcgggagacagcgtccacagcctgctcagcatcctggacatcatcaccggccatgctgcaccttacaaaacggtctccgtccgcgcggccatcccgtccaccatcctccggcttccagctgcggcttttcatggagtttttgagaaatatccggaaactctggtgagggtggtgcagatcatcatggtgcggctgcagagggtgacctttctggctctgcacaactacctcggcctgaccacagagctcttcaacgctgagagccaggccatccctctcgtgtctgtagccagtgtggctgccgggaaggccaagaagcaggtgttctatggcgaagaagagcggcttaaaaagccaccgcggctccaggagtcctgtgactcagatcacgggggcggccgcccggcagctgctgggcccctgctgaagaggagccactccgtccccgcgccttccattcgcaaacagatcttggaggagctggagaagcccggggcaggtgaccctgacccttcggccccacaagctcgtgtcctctgtctcttgcctcagtgcctgggtggcttgccgcccacagacaccagcgtctactcctcagcctcatccgactgctgtggctgctccatgcctgtgctgtgcatcatgggccacaagcctcatgtgactgttgacacctaaactcactcatgccagctaaactcattcacgccagttaaactcattcatactagctaaactcatttgtaccagctaaactcactcacaccagttaaactcactcacaccagttaaactcattcgtaccagctaaactcactcatgccagctaaactcactcacgccggctaaactcactcgtaccagctaaactcattcgtaccagctaaactcattcataccagctaaactcactcatgccagctaaactcactcacgccggctaaactcactcataccggctaaactcattcgtactagctaaactcattcgtaccagctaaactcactcgtaccagctaaactcactcacaccagctaaactcacttgtaccagctaaactcactcatgccagctaaactcactcatgccagctaaattcacgccagctaaactcactcgtacccgctaaactcactcatgccaattaaactcattcgtaccagctaaactcactcatgccagccacacttcaggtgctcactggccgcccatggttagcggccacttccggcccagcatgtgctgctctctgtcttctggtgggcgtgcagtggaggctgcctgtgctctgattctgtcttcttgatgaactgtgaggccgagcaccttggatagccttctttgtcttttgcccattttcctcttagctttcattttcttattattaataggaattctttatatattctctgtatgattcctttgtcaagtatgtatattaaaaatattttctattc

SEQ ID NO: 21708 - DNA, 4542 bp, Homo sapiens
gctgcccccatccccgccgcgctgggcctggctcctcttgacctgcttggatacgccccatctggctgctgttctgggttccgggacagccacgtgagggctgtttacagagggaaggaggtggctcctagcagatgacagacacttctcaaaagacagcttttcttcctggagaacagactttttcagcaggattttcctttcagtgaaacataatttgacttgaaaggaacccagggaaaagtgtccaggtgtgagcatgagcgggtagaggtgtgcccttgtttgcttcaggctgtctgcttttcgcccctgactgttttttctgtttctggccatggaggaagagaaagatgacagcccacagctgacggggattgcagttggagccctcctggccctggccttggttggtgtcctcatccttttcatgttcagaaggcttagacaatttcgacaagcacagcccactcctcagtaccggttccggaagagagacaaagtgatgttttacggccggaagatcatgaggaaggtgaccacactccccaacacccttgtggagaacactgccctgccccggcagcgggccaggaagaggaccaaggtgctgtctttggccaagaggattctgcgtttcaagaaggaatacccggccctgcagcccaaggagcccccgccctccctgctggaggccgacctcacggagtttgacgtgaagaattctcacctgccatcggaagttctgtacatgctgaaaaacgttcgggtcctgggccactttgagaagccgctgttcctggagctttgcaaacacatcgtctttgtgcagctgcaggaaggggagcacgtcttccagcccagggagccggaccccagcatctgtgtggtgcaggacgggcggctggaggtctgcatccaggacactgacggcaccgaggtggtggtgaaagaggttctggcgggagacagcgtccacagcctgctcagcatcctggacatcatcaccggccatgctgcaccttacaaaacggtctccgtccgcgcggccatcccgtccaccatcctccggcttccagctgcggcttttcatggagtttttgagaaatatccggaaactctggtgagggtggtgcagatcatcatggtgcggctgcagagggtgacctttctggctctgcacaactacctcggcctgaccacagagctcttcaacgctgagagccaggccatccctctcgtgtctgtagccagtgtggctgccgggaaggccaagaagcaggtgttctatggcgaagaagagcggcttaaaaagccaccgcggctccaggagtcctgtgactcagatcacgggggcggccgcccggcagctgctgggcccctgctgaagaggagccactccgtccccgcgccttccattcgcaaacagatcttggaggagctggagaagcccggggcaggtgaccctgacccttcggccccacaagggggcccaggcagtgccacttctgatctggggatggcatgtgaccgtgccagggtcttcctgcactcggacgagcaccccgggagctccgtggccagcaagtccaggaaaagcgtgatggttgcagagataccctccacggtctcccagcactcagagagtcacacggatgagaccctggccagcaggaagtcggatgccatcttcagagctgccaagaaggacctgctcaccctgatgaagctggaagactcatctctgttggatggccgggtggcgcttctgcacgttcctgcaggcacggtggtgtcaaggcagggagaccaggacgccagcatcctgttcgtggtctcggggctgctgcacgtgtaccagcggaagatcggcagccaggaggacacctgcttgttcctcacgcgccccggggagatggtgggccagctggccgtgctcaccggggagcctctcatcttcaccgtcaaggccaacagggactgcagcttcctgtccatctccaaggcccacttctatgaaatcatgcggaagcagccgaccgtcgtcctgggtgtggcgcacactgtggtgaagaggatgtcgtccttcgtgcggcaaatcgactttgccctggactgggtggaggtggaggccgggcgagcaatatacaggcagggggacaagtccgactgcacgtacatcatgctcagcggccggctgcgctctgtgatccggaaggatgatgggaagaagcgcctggccggggagtacggccgaggagacctcgtcggcgtggtggagacactgacccaccaggcccgggcgaccacggtgcatgccgttcgggactcagaattggccaagctgccggcaggagccctcacgtccatcaagcgcaggtacccacaggtggtgactcggctgattcatctcttgggtgagaagatcctgggcagcctccagcagggacctgtgacaggccaccagcttgggctccccacggagggcagcaagtgggacttggggaacccggctgtcaacctgtccacggtggcagtgatgcccgtgtcagaggaagtgcccctcaccgccttcgccctggagctggagcatgccctcagcgccatcggcccgaccctgctgctgactagtgacaacataaaacggcgccttggctccgctgccctggacagtgttcacgagtaccggctgtccagctggctggggcagcaggaggacacccacaggatcgtgctctaccaggtagatggcacgctcacaccctggacccagcgctgcgtgcgccaggccgactgcatcctcatcgtgggcctgggtgaccaggagcccacagtgggcgagctggagcggatgctggagagcacagctgtgcgtgcccagaagcagctgatcctgctgcacagggaggagggcccggcgccagcgcgcaccgtggagtggctcaacatgcggagctggtgctccggccacctgcacctctgctgcccgcgccgcgtcttctccaggaggagcctgcccaagctggtggagatgtacaagcatgtcttccagcggcccccggaccgacactcagacttctcccgcctggcgagggtgctgacgggcaacgccattgccctggtgcttgggggagggggagcaagaggctgtgcccaggtgggcgttctcaaggccttggcggagtgcggcatccctgtggacatggtgggaggcacgtccatcggggccttcgtgggtgccctgtactctgaggagcggaactacagccagatgcggatccgggccaagcagtgggccgagggcatgacgtccttgatgaaggccgcgctggacctcacctaccccatcacgtccatgttctccggagccggcttcaacagcagcatcttcagcgtcttcaaggaccagcagatcgaggacctgtggattccttatttcgccatcaccaccgacatcacagcctcggccatgcgggtccacaccgacggctccctgtggtggtacgtgcgtgccagcatgtccctgtccggttacatgccccctctctgtgacccgaaggacggacacctgctgatggacgggggctacatcaacaacctcccagcggatgtggcccggtccatgggggcaaaagtggtgatcgccattgacgtgggcagccgagatgagacggacctcaccaactatggggatgcgctgtctgggtggtggctgctgtggaaacgctggaaccccttggccacgaaagtcaaggtgttgaacatggcagagattcagacgcgcctggcctacgtgtgttgcgtgcggcagctggaggtggtgaagagcagtgactactgcgagtacctgcgcccccccatcgacagctacagcaccctggacttcggcaagttcaacgagatctgcgtgccagacgaatctgactaccagacggagtacgaggaggagctgctggacgtccccagggatgcatacgcagacttccagagcacctcagcccagcagggctcagacttggaggacgagtcctcactgcggcatcgacaccccagtctggctttcccaaaactgtctgagggctcctctgaccaggacgggtagaggcctctgctaaagagcccggatgcagcgtcttccgtgggactgtccccaaggctgaggctcctgccaagtcctaggggcctctgtacctgccctgctggaagccctgacttccccggggccccaggctgtgttagggttctctgggcctcttctttgtaccagcagccctgcatacagggccctgtgagcccccctgcagtcctgtgaggcccctgaagctctgtgaggcccctgaagctctgtgaaccccctgcagccctgtgaggccccccgaagccctgtgaggccccccgaagccctgtgaaccacctgctgccctgtgaggcccccaaagccctgtgaactgcctgctgtcctgtgaactgcctgctgccctgtgaggtgtgggagccctgatgctgccgtgtgatgtttcaataaaggtggatctcactgtt

SEQ ID NO: 21709 - DNA, 3376 bp, Homo sapiens
cggccgcccggcagctgctgggcccctgctgaagaggagccactccgtccccgcgccttccattcgcaaacagatcttggaggagctggagaagcccggggcaggtgaccctgacccttcggccccacaagggggcccaggcagtgccacttctgatctggggatggcatgtgaccgtgccagggtcttcctgcactcggacgagcaccccgggagctccgtggccagcaagtccaggaaaagcgtgatggttgcagagataccctccacggtctcccagcactcagagagtcacacggatgagaccctggccagcaggaagtcggatgccatcttcagagctgccaagaaggacctgctcaccctgatgaagctggaagactcatctctgttggatggccgggtggcgcttctgcacgttcctgcaggcacggtggtgtcaaggcagggagaccaggacgccagcatcctgttcgtggtctcggggctgctgcacgtgtaccagcggaagatcggcagccaggaggacacctgcttgttcctcacgcgccccggggagatggtgggccagctggccgtgctcaccggggagcctctcatcttcaccgtcaaggccaacagggactgcagcttcctgtccatctccaaggcccacttctatgaaatcatgcggaagcagccgaccgtcgtcctgggtgtggcgcacactgtggtgaagaggatgtcgtccttcgtgcggcaaatcgactttgccctggactgggtggaggtggaggccgggcgagcaatatacaggcagggggacaagtccgactgcacgtacatcatgctcagcggccggctgcgctctgtgatccggaaggatgatgggaagaagcgcctggccggggagtacggccgaggagacctcgtcggcgtggtggagacactgacccaccaggcccgggcgaccacggtgcatgccgttcgggactcagaattggccaagctgccggcaggagccctcacgtccatcaagcgcaggtacccacaggtggtgactcggctgattcatctcttgggtgagaagatcctgggcagcctccagcagggacctgtgacaggccaccagcttgggctccccacggagggcagcaagtgggacttggggaacccggctgtcaacctgtccacggtggcagtgatgcccgtgtcagaggaagtgcccctcaccgccttcgccctggagctggagcatgccctcagcgccatcggcccgaccctgctgctgactagtgacaacataaaacggcgccttggctccgctgccctggacagtgttcacgagtaccggctgtccagctggctggggcagcaggaggacacccacaggatcgtgctctaccaggtagatggcacgctcacaccctggacccagcgctgcgtgcgccaggccgactgcatcctcatcgtgggcctgggtgaccaggagcccacagtgggcgagctggagcggatgctggagagcacagctgtgcgtgcccagaagcagctgatcctgctgcacagggaggagggcccggcgccagcgcgcaccgtggagtggctcaacatgcggagctggtgctccggccacctgcacctctgctgcccgcgccgcgtcttctccaggaggagcctgcccaagctggtggagatgtacaagcatgtcttccagcggcccccggaccgacactcagacttctcccgcctggcgagggtgctgacgggcaacgccattgccctggtgcttgggggagggggagcaagaggctgtgcccaggtgggcgttctcaaggccttggcggagtgcggcatccctgtggacatggtgggaggcacgtccatcggggccttcgtgggtgccctgtactctgaggagcggaactacagccagatgcggatccgggccaagcagtgggccgagggcatgacgtccttgatgaaggccgcgctggacctcacctaccccatcacgtccatgttctccggagccggcttcaacagcagcatcttcagcgtcttcaaggaccagcagatcgaggacctgtggattccttatttcgccatcaccaccgacatcacagcctcggccatgcgggtccacaccgacggctccctgtggtggtacgtgcgtgccagcatgtccctgtccggttacatgccccctctctgtgacccgaaggacggacacctgctgatggacgggggctacatcaacaacctcccagcggatgtggcccggtccatgggggcaaaagtggtgatcgccattgacgtgggcagccgagatgagacggacctcaccaactatggggatgcgctgtctgggtggtggctgctgtggaaacgctggaaccccttggccacgaaagtcaaggtgttgaacatggcagagattcagacgcgcctggcctacgtgtgttgcgtgcggcagctggaggtggtgaagagcagtgactactgcgagtacctgcgcccccccatcgacagctacagcaccctggacttcggcaagttcaacgagatctgcgaagtgggctaccagcacgggcgcacggtgtttgacatctggggccgcagcggcgtgctggagaagatgctccgcgaccagcaggggccgagcaagaagcccgcgagtgcggtcctcacctgtcccaacgcctccttcacggaccttgccgaaattgtgtctcgcattgagcccgccaagcccgccatggtggatgacgaatctgactaccagacggagtacgaggaggagctgctggacgtccccagggatgcatacgcagacttccagagcacctcagcccagcagggctcagacttggaggacgagtcctcactgcggcatcgacaccccagtctggctttcccaaaactgtctgagggctcctctgaccaggacgggtagaggcctctgctaaagagcccggatgcagcgtcttccgtgggactgtccccaaggctgaggctcctgccaagtcctaggggcctctgtacctgccctgctggaagccctgacttccccggggccccaggctgtgttagggttctctgggcctcttctttgtaccagcagccctgcatacagggccctgtgagcccccctgcagtcctgtgaggcccctgaagctctgtgaggcccctgaagctctgtgaaccccctgcagccctgtgaggccccccgaagccctgtgaggccccccgaagccctgtgaaccacctgctgccctgtgaggcccccaaagccctgtgaactgcctgctgtcctgtgaactgcctgctgccctgtgaggtgtgggagccctgatgctgccgtgtgatgtttcaataaaggtggatctcactgttg

SEQ ID NO: 21710 - DNA, 4806 bp, Homo sapiens
gctgcccccatccccgccgcgctgggcctggctcctcttgacctgcttggatacgccccatctggctgctgttctgggttccgggacagccacgtgagggctgtttacagagggaaggaggtggctcctagcagatgacagacacttctcaaaagacagcttttcttcctggagaacagactttttcagcaggattttcctttcagtgaaacataatttgacttgaaaggaacccagggaaaagtgtccaggtgtgagcatgagcgggtagaggtgtgcccttgtttgcttcaggctgtctgcttttcgcccctgactgttttttctgtttctggccatggaggaagagaaagatgacagcccacaggctgacttctgcctgggcaccgccctgcactcttggggactgtggttcacggaggaaggttcaccgtccaccatgctgacggggattgcagttggagccctcctggccctggccttggttggtgtcctcatccttttcatgttcagaaggcttagacaatttcgacaagcacagcccactcctcagtaccggttccggaagagagacaaagtgatgttttacggccggaagatcatgaggaaggtgaccacactccccaacacccttgtggagaacactgccctgccccggcagcgggccaggaagaggaccaaggtgctgtctttggccaagaggattctgcgtttcaagaaggaatacccggccctgcagcccaaggagcccccgccctccctgctggaggccgacctcacggagtttgacgtgaagaattctcacctgccatcggaagttctgtacatgctgaaaaacgttcgggtcctgggccactttgagaagccgctgttcctggagctttgcaaacacatcgtctttgtgcagctgcaggaaggggagcacgtcttccagcccagggagccggaccccagcatctgtgtggtgcaggacgggcggctggaggtctgcatccaggacactgacggcaccgaggtggtggtgaaagaggttctggcgggagacagcgtccacagcctgctcagcatcctggacatcatcaccggccatgctgcaccttacaaaacggtctccgtccgcgcggccatcccgtccaccatcctccggcttccagctgcggcttttcatggagtttttgagaaatatccggaaactctggtgagggtggtgcagatcatcatggtgcggctgcagagggtgacctttctggctctgcacaactacctcggcctgaccacagagctcttcaacgctgagagccaggccatccctctcgtgtctgtagccagtgtggctgccgggaaggccaagaagcaggtgttctatggcgaagaagagcggcttaaaaagccaccgcggctccaggagtcctgtgactcagatcacgggggcggccgcccggcagctgctgggcccctgctgaagaggagccactccgtccccgcgccttccattcgcaaacagatcttggaggagctggagaagcccggggcaggtgaccctgacccttcggccccacaagggggcccaggcagtgccacttctgatctggggatggcatgtgaccgtgccagggtcttcctgcactcggacgagcaccccgggagctccgtggccagcaagtccaggaaaagcgtgatggttgcagagataccctccacggtctcccagcactcagagagtcacacggatgagaccctggccagcaggaagtcggatgccatcttcagagctgccaagaaggacctgctcaccctgatgaagctggaagactcatctctgttggatggccgggtggcgcttctgcacgttcctgcaggcacggtggtgtcaaggcagggagaccaggacgccagcatcctgttcgtggtctcggggctgctgcacgtgtaccagcggaagatcggcagccaggaggacacctgcttgttcctcacgcgccccggggagatggtgggccagctggccgtgctcaccggggagcctctcatcttcaccgtcaaggccaacagggactgcagcttcctgtccatctccaaggcccacttctatgaaatcatgcggaagcagccgaccgtcgtcctgggtgtggcgcacactgtggtgaagaggatgtcgtccttcgtgcggcaaatcgactttgccctggactgggtggaggtggaggccgggcgagcaatatacaggcagggggacaagtccgactgcacgtacatcatgctcagcggccggctgcgctctgtgatccggaaggatgatgggaagaagcgcctggccggggagtacggccgaggagacctcgtcggcgtggtggagacactgacccaccaggcccgggcgaccacggtgcatgccgttcgggactcagaattggccaagctgccggcaggagccctcacgtccatcaagcgcaggtacccacaggtggtgactcggctgattcatctcttgggtgagaagatcctgggcagcctccagcagggacctgtgacaggccaccagcttgggctccccacggagggcagcaagtgggacttggggaacccggctgtcaacctgtccacggtggcagtgatgcccgtgtcagaggaagtgcccctcaccgccttcgccctggagctggagcatgccctcagcgccatcggcccgaccctgctgctgactagtgacaacataaaacggcgccttggctccgctgccctggacagtgttcacgagtaccggctgtccagctggctggggcagcaggaggacacccacaggatcgtgctctaccaggtagatggcacgctcacaccctggacccagcgctgcgtgcgccaggccgactgcatcctcatcgtgggcctgggtgaccaggagcccacagtgggcgagctggagcggatgctggagagcacagctgtgcgtgcccagaagcagctgatcctgctgcacagggaggagggcccggcgccagcgcgcaccgtggagtggctcaacatgcggagctggtgctccggccacctgcacctctgctgcccgcgccgcgtcttctccaggaggagcctgcccaagctggtggagatgtacaagcatgtcttccagcggcccccggaccgacactcagacttctcccgcctggcgagggtgctgacgggcaacgccattgccctggtgcttgggggagggggagcaagaggctgtgcccaggtgggcgttctcaaggccttggcggagtgcggcatccctgtggacatggtgggaggcacgtccatcggggccttcgtgggtgccctgtactctgaggagcggaactacagccagatgcggatccgggccaagcagtgggccgagggcatgacgtccttgatgaaggccgcgctggacctcacctaccccatcacgtccatgttctccggagccggcttcaacagcagcatcttcagcgtcttcaaggaccagcagatcgaggacctgtggattccttatttcgccatcaccaccgacatcacagcctcggccatgcgggtccacaccgacggctccctgtggtggtacgtgcgtgccagcatgtccctgtccggttacatgccccctctctgtgacccgaaggacggacacctgctgatggacgggggctacatcaacaacctcccagcggatgtggcccggtccatgggggcaaaagtggtgatcgccattgacgtgggcagccgagatgagacggacctcaccaactatggggatgcgctgtctgggtggtggctgctgtggaaacgctggaaccccttggccacgaaagtcaaggtgttgaacatggcagagattcagacgcgcctggcctacgtgtgttgcgtgcggcagctggaggtggtgaagagcagtgactactgcgagtacctgcgcccccccatcgacagctacagcaccctggacttcggcaagttcaacgagatctgcgaagtgggctaccagcacgggcgcacggtgtttgacatctggggccgcagcggcgtgctggagaagatgctccgcgaccagcaggggccgagcaagaagcccgcgagtgcggtcctcacctgtcccaacgcctccttcacggaccttgccgaaattgtgtctcgcattgagcccgccaagcccgccatggtggatgacgaatctgactaccagacggagtacgaggaggagctgctggacgtccccagggatgcatacgcagacttccagagcacctcagcccagcagggctcagacttggaggacgagtcctcactgcggcatcgacaccccagtctggctttcccaaaactgtctgagggctcctctgaccaggacgggtagaggcctctgctaaagagcccggatgcagcgtcttccgtgggactgtccccaaggctgaggctcctgccaagtcctaggggcctctgtacctgccctgctggaagccctgacttccccggggccccaggctgtgttagggttctctgggcctcttctttgtaccagcagccctgcatacagggccctgtgagcccccctgcagtcctgtgaggcccctgaagctctgtgaggcccctgaagctctgtgaaccccctgcagccctgtgaggccccccgaagccctgtgaggccccccgaagccctgtgaaccacctgctgccctgtgaggcccccaaagccctgtgaactgcctgctgtcctgtgaactgcctgctgccctgtgaggtgtgggagccctgatgctgccgtgtgatgtttcaataaaggtggatctcactgtt

SEQ ID NO: 21711 - DNA, 3916 bp, Homo sapiens
ggctgacttctgcctgggcaccgccctgcactcttggggactgtggttcacggaggaaggttcaccgtccaccatgctgacggggattgcagttggagccctcctggccctggccttggttggtgtcctcatccttttcatgttcagaaggcttagacaatttcgacaagcacagcccactcctcagtaccggttccggaagagagacaaagtgatgttttacggccggaagatcatgaggaaggtgaccacactccccaacacccttgtggagaacactgccctgccccggcagcgggccaggaagaggaccaaggtgctgtctttggccaagaggattctgcgtttcaagaaggaatacccggccctgcagcccaaggagcccccgccctccctgctggaggccgacctcacggagtttgacgtgaagaattctcacctgccatcggaagttctgtacatgctgaaaaacgttcgggtcctgggccactttgagaagccgctgttcctggagctttgcaaacacatcgtctttgtgcagctgcaggaaggggagcacgtcttccagcccagggagccggaccccagcatctgtgtggtgcaggacgggcggctggaggtctgcatccaggacactgacggcaccgaggtggtggtgaaagaggttctggcgggagacagcgtccacagcctgctcagcatcctggacatcatcaccggccatgctgcaccttacaaaacggtctccgtccgcgcggccatcccgtccaccatcctccggcttccagctgcggcttttcatggagtttttgagaaatatccggaaactctggtgagggtggtgcagatcatcatggtgcggctgcagagggtgacctttctggctctgcacaactacctcggcctgaccacagagctcttcaacgctgagagccaggccatccctctcgtgtctgtagccagtgtggctgccgggaaggccaagaagcaggtgttctatggcgaagaagagcggcttaaaaagccaccgcggctccaggagtcctgtgactcagatcacgggggcggccgcccggcagctgctgggcccctgctgaagaggagccactccgtccccgcgccttccattcgcaaacagatcttggaggagctggagaagcccggggcaggtgaccctgacccttcggccccacaagggggcccaggcagtgccacttctgatctggggatggcatgtgaccgtgccagggtcttcctgcactcggacgagcaccccgggagctccgtggccagcaagtccaggaaaagcgtgatggttgcagagataccctccacggtctcccagcactcagagagtcacacggatgagaccctggccagcaggaagtcggatgccatcttcagagctgccaagaaggacctgctcaccctgatgaagctggaagactcatctctgttggatggccgggtggcgcttctgcacgttcctgcaggcacggtggtgtcaaggcagggagaccaggacgccagcatcctgttcgtggtctcggggctgctgcacgtgtaccagcggaagatcggcagccaggaggacacctgcttgttcctcacgcgccccggggagatggtgggccagctggccgtgctcaccggggagcctctcatcttcaccgtcaaggccaacagggactgcagcttcctgtccatctccaaggcccacttctatgaaatcatgcggaagcagccgaccgtcgtcctgggtgtggcgcacactgtggtgaagaggatgtcgtccttcgtgcggcaaatcgactttgccctggactgggtggaggtggaggccgggcgagcaatatacaggcagggggacaagtccgactgcacgtacatcatgctcagcggccggctgcgctctgtgatccggaaggatgatgggaagaagcgcctggccggggagtacggccgaggagacctcgtcggcgtggtggagacactgacccaccaggcccgggcgaccacggtgcatgccgttcgggactcagaattggccaagctgccggcaggagccctcacgtccatcaagcgcaggtacccacaggtggtgactcggctgattcatctcttgggtgagaagatcctgggcagcctccagcagggacctgtgacaggccaccagcttgggctccccacggagggcagcaagtgggacttggggaacccggctgtcaacctgtccacggtggcagtgatgcccgtgtcagaggaagtgcccctcaccgccttcgccctggagctggagcatgccctcagcgccatcggcccgaccctgctgctgactagtgacaacataaaacggcgccttggctccgctgccctggacagtgttcacgagtaccggctgtccagctggctggggcagcaggaggacacccacaggatcgtgctctaccaggtagatggcacgctcacaccctggacccagcgctgcgtgcgccaggccgactgcatcctcatcgtgggcctgggtgaccaggagcccacagtgggcgagctggagcggatgctggagagcacagctgtgcgtgcccagaagcagctgatcctgctgcacagggaggagggcccggcgccagcgcgcaccgtggagtggctcaacatgcggagctggtgctccggccacctgcacctctgctgcccgcgccgcgtcttctccaggaggagcctgcccaagctggtggagatgtacaagcatgtcttccagcggcccccggaccgacactcagacttctcccgcctggcgagggtgctgacgggcaacgccattgccctggtgcttgggggagggggagcaagaggctgtgcccaggtgggcgttctcaaggccttggcggagtgcggcatccctgtggacatggtgggaggcacgtccatcggggccttcgtgggtgccctgtactctgaggagcggaactacagccagatgcggatccgggccaagcagtgggccgagggcatgacgtccttgatgaaggccgcgctggacctcacctaccccatcacgtccatgttctccggagccggcttcaacagcagcatcttcagcgtcttcaaggaccagcagatcgaggacctgtggattccttatttcgccatcaccaccgacatcacagcctcggccatgcgggtccacaccgacggctccctgtggtggtacgtgcgtgccagcatgtccctgtccggttacatgccccctctctgtgacccgaaggacggacacctgctgatggacgggggctacatcaacaacctcccagcggatgtggcccggtccatgggggcaaaagtggtgatcgccattgacgtgggcagccgagatgagacggacctcaccaactatggggatgcgctgtctgggtggtggctgctgtggaaacgctggaaccccttggccacgaaagtcaaggtgttgaacatggcagagattcagacgcgcctggcctacgtgtgttgcgtgcggcagctggaggtggtgaagagcagtgactactgcgagtacctgcgcccccccatcgacagctacagcaccctggacttcggcaagttcaacgagatctgcgaagtgggctaccagcacgggcgcacggtgtttgacatctggggccgcagcggcgtgctggagaagatgctccgcgaccagcaggggccgagcaagaagcccgcgagtgcggtcctcacctgtcccaacgcctccttcacggaccttgccgaaattgtgtctcgcattgagcccgccaagcccgccatggtggatgacgaatctgactaccagacggagtacgaggaggagctgctggacgtccccagggatgcatacgcagacttccagagcacctcagcccagcagggctcagacttg

SEQ ID NO: 21712 - DNA, 3490 bp, Homo sapiens
acttccgctgggggcggagcggggcggggctgagtgggtggcgacctagctgctgcgccagtgtttgtgttggaagctcagctgatgcaggccggttggagtggacgtcattgccgggaacgagcgagtcgccgctgcagccctagtgactgcggcctgcatcccgattgtcttctcctccaaggtctacatgattacctgaagtttaataagtaagaccatgaattatggcatttcttaaatgaagcgttcaagaagtgagagaatgtcatagaaaataaatgatttttaagttatgtctattaatctgactgtagatatatatatttacctccttagtaatgcaagaagtgtttgtgggaagcagagaagcaagcaactgtatttcttgttctcacctaagcattactggaggataagccacatcagtctacaaagaggttttcatacaaacataataagatgtaaatggaccaaaagtgaagcacattcttgcagtaagcactgttactctccaagcaaccatggtttacatattgggattttgaaacttagcacttctgctcccaagggacttacaaaagtgaacatttgtatgtcccgtattaaaagtactttgaactctgtttcaaaggctgtttttggcaatcaaaatgaaatgatttcacgtttagctcaatttaagccaagttcccaaattttaagaaaagtatcggatagtggctggttaaaacagaaaaacatcaaacaagccatcaaatctctgaaaaaatatagtgacaaatcagcagaaaagagtccttttccagaagagaaaagtcacattatagacaaagaagaagatataggtaaacgcagtctttttcattacacaagttctataaccacaaaatttggagactcattctactttttatcaaatcatattaattcatatttcaaacgtaaggaaaaaatgtctcaacaaaaggaaaatgaacatttccgggacaaatcagaacttgaagataaaaaggtagaagaggggaaattaagatctccagatcctggcatcctggcttataagccaggctcagaatctgtacatacggtggacaagcctacaagtccttctgcgatacctgatgttcttcaagtttcaactaaacaaagtattgctaactttctttctcgtcccacggaaggtgtacaagctttagtaggtggttatattggtggacttgtccccaaattaaagtatgattcaaagagtcagtcagaagaacaggaagagcctgctaaaactgatcaggctgtcagcaaagacagaaatgcagaggagaaaaagcgtttatctcttcagcgagaaaagattatcgcaagggtgagtattgataacaggacccgggcattagttcaggcattaagaagaacaactgacccaaagctctgcattactagggttgaagaactgacttttcatcttctagaatttcctgaaggaaaaggagtggctgtcaaggaaagaattattccatatttattacgactgagacaaattaaggatgaaactcttcaggctgcagttagagaaattttggccctaattggctatgtggatccagtgaaagggagaggaatccgaattctctcaattgatggtggaggaacaaggggcgtggttgctctccagaccctacgaaaattagttgaacttactcagaagccagttcatcagctctttgattacatttgtggtgtaagcacaggtgccatattagctttcatgttggggttgtttcatatgcccttggatgaatgtgaggaactttatcgaaaattaggatcagatgtattttcacaaaatgtcattgttggaacagtaaaaatgagttggagccatgcattttatgacagtcaaacatgggaaaacattcttaaggataggatgggatctgcactgatgattgaaacagcaagaaaccccacatgtcctaaggtagctgctgtaagtaccatagtaaatagagggataacacccaaagcttttgtgttcagaaactatggtcattttcctggaatcaactctcattatttgggaggctgtcagtataaaatgtggcaggccattagagcctcatctgctgctccaggctactttgcagaatatgcattgggaaatgatcttcatcaagatggaggtttgcttctgaataacccttcggcattagctatgcatgagtgtaaatgtctttggccagatgtgccgttagagtgcatagtatccctgggcactggacgttatgagagtgatgtgagaaacacggtaacatacacaagcttgaaaactaaactttctaatgttatcaacagtgctacagatacagaagaagtccatataatgcttgatggcctgttacctcctgacacctattttagattcaatcctgtaatgtgtgaaaacatacctctagatgaaagtcgaaatgaaaagctggatcagctgcagttggaagggttgaaatacatagaaagaaatgaacaaaaaatgaaaaaagttgcaaaaatattaagtcaagaaaaaacaactctgcagaaaattaatgattggataaaattaaaaactgatatgtatgaaggacttccattcttttcaaaattgtgatgagtatatgcttatgttctcataaatgaaggtctgtttagaagatcaaccacattcaataaggaattgtggggttcgacatgagttaactttgaaatacgtatgaattctggagaatcctgaaaaagacggtgcttcaaccagcttgcatagcacagagaatattcttggttacagaattcatatgggaactaggcttttaagatgttaataattagctaagctttagtaacccttactgtgctagtagattttagtagatattggtgttatattgtttgatgtttgaaaatatattaatatatgtgccgaacaagaaaccgaaagctatattgtactgtgtatttttactttagtcctcataatcatgttgaatttatgtgatcattgattttatttcatatggaaaagctaatttcttcttaaatttacattacctaatattctcactagctatgttctccaatccacactgccttttattgtaatatcatctaaatagatgcagaaaaatggaattttctctattaaagtattttacatttgacataaaaaagaaccagatacagttttctattcagatatgtttattttaacattgtttggttaaaaaaggtgaagttccagtcaaccactttttacccctgaaatttcaagataatgctatattaacttttccagatctaacactagcttattcttccctgttataaaatggtttgaacttactgaggagatattcctatcattaacaaaaataaactatttaaataatctgttgttaaaaggctaatgtcattttaaaattaatttttgttcataatgtagctcccctttagcctttga

SEQ ID NO: 21713 - DNA, 3234 bp, Homo sapiens
tggaagctcagctgatgcaggccggttggagtggacgtcattgccgggaacgagcgagtcgccgctgcagccctagtgactgcggcctgcatcccgattgtcttctcctccaaggtctacatgattacctgaagtttaataagtaagaccatgaattatggcatttcttaaatgaagcgttcaagaagtgagagaatgtcatagaaaataaatgatttttaagttatgtctattaatctgactgtagatatatatatttacctccttagtaatgcaagaagtgtttgtgggaagcagagaagcaagcaactgtatttcttgttctcacctaagcattactggaggataagccacatcagtctacaaagaggttttcatacaaacataataagatgtaaatggaccaaaagtgaagcacattcttgcagtaagcactgttactctccaagcaaccatggtttacatattgggattttgaaacttagcacttctgctcccaagggacttacaaaagtgaacatttgtatgtcccgtattaaaagtactttgaactctgtttcaaaggctgtttttggcaatcaaaatgaaatgatttcacgtttagctcaatttaagccaagttcccaaattttaagaaaagtatcggatagtggctggttaaaacagaaaaacatcaaacaagccatcaaatctctgaaaaaatatagtgacaaatcagcagaaaagagtccttttccagaagagaaaagtcacattatagacaaagaagaagatataggtaaacgcagtctttttcattacacaagttctataaccacaaaatttggagactcattctactttttatcaaatcatattaattcatatttcaaacgtaaggaaaaaatgtctcaacaaaaggaaaatgaacatttccgggacaaatcagaacttgaagataaaaaggtagaagaggggaaattaagatctccagatcctggcatcctggcttataagccaggctcagaatctgtacatacggtggacaagcctacaagtccttctgcgatacctgatgttcttcaagtttcaactaaacaaagtattgctaactttctttctcgtcccacggaaggtgtacaagctttagtaggtggttatattggtggacttgtccccaaattaaagtatgattcaaagagtcagtcagaagaacaggaagagcctgctaaaactgatcaggctgtcagcaaagacagaaatgcagaggagaaaaagcgtttatctcttcagcgagaaaagattatcgcaagggtgagtattgataacaggacccgggcattagttcaggcattaagaagaacaactgacccaaagctctgcattactagggttgaagaactgacttttcatcttctagaatttcctgaaggaaaaggagtggctgtcaaggaaagaattattccatatttattacgactgagacaaattaaggatgaaactcttcaggctgcagttagagaaattttggccctaattggctatgtggatccagtgaaagggagaggaatccgaattctctcaattgatggtggaggaacaaggggcgtggttgctctccagaccctacgaaaattagttgaacttactcagaagccagttcatcagctctttgattacatttgtggtgtaagcacaggtgccatattagctttcatgttggggttgtttcatatgcccttggatgaatgtgaggaactttatcgaaaattaggatcagatgtattttcacaaaatgtcattgttggaacagtaaaaatgagttggagccatgcattttatgacagtcaaacatgggaaaacattcttaaggataggatgggatctgcactgatgattgaaacagcaagaaaccccacatgtcctaaggtaaggaaagatggaggtttgcttctgaataacccttcggcattagctatgcatgagtgtaaatgtctttggccagatgtgccgttagagtgcatagtatccctgggcactggacgttatgagagtgatgtgagaaacacggtaacatacacaagcttgaaaactaaactttctaatgttatcaacagtgctacagatacagaagaagtccatataatgcttgatggcctgttacctcctgacacctattttagattcaatcctgtaatgtgtgaaaacatacctctagatgaaagtcgaaatgaaaagctggatcagctgcagttggaagggttgaaatacatagaaagaaatgaacaaaaaatgaaaaaagttgcaaaaatattaagtcaagaaaaaacaactctgcagaaaattaatgattggataaaattaaaaactgatatgtatgaaggacttccattcttttcaaaattgtgatgagtatatgcttatgttctcataaatgaaggtctgtttagaagatcaaccacattcaataaggaattgtggggttcgacatgagttaactttgaaatacgtatgaattctggagaatcctgaaaaagacggtgcttcaaccagcttgcatagcacagagaatattcttggttacagaattcatatgggaactaggcttttaagatgttaataattagctaagctttagtaacccttactgtgctagtagattttagtagatattggtgttatattgtttgatgtttgaaaatatattaatatatgtgccgaacaagaaaccgaaagctatattgtactgtgtatttttactttagtcctcataatcatgttgaatttatgtgatcattgattttatttcatatggaaaagctaatttcttcttaaatttacattacctaatattctcactagctatgttctccaatccacactgccttttattgtaatatcatctaaatagatgcagaaaaatggaattttctctattaaagtattttacatttgacataaaaaagaaccagatacagttttctattcagatatgtttattttaacattgtttggttaaaaaaggtgaagttccagtcaaccactttttacccctgaaatttcaagataatgctatattaacttttccagatctaacactagcttattcttccctgttataaaatggtttgaacttactgaggagatattcctatcattaacaaaaataaactatttaaataatctgttgttaaaaggctaatgtcattttaaaattaatttttgttcataatgtagctcccctttagcctttga

SEQ ID NO: 21714 - DNA, 568 bp, Homo sapiens
aggggatgaaagagcataagcggagagggaatggtggtgctctctccttgaccatactttagttaggctcctctgagccctcttcccaactaggcctcatccttgggcccctgtcttaggcctgctgagtccagttttagcaagaatcttgcaaagtcagtttagagagtatctcctagccttgataattgatcatctccgcctgtcttcagcaagaatcttagtgttatacagctggaatcatactgctatggtccgaatgtttgtgcctctcaaaattcatgtggaaatcataaccgctaaagtgatggtattaagaggtaagaccatgaattatggcatttcttaaatgaagcgttcaagaagtgagagaatgtcatagaaaataaatgatttttaagttatgtctattaatctgactgtagatatatatatttacctccttagtaatgcaagaagtgtttgtgggaagcagagaagcaagcaactgtatttcttgttctcacctaagcattactggaggataagccacatcagtctacaaagaggttttcatacaaacataata

SEQ ID NO: 21715 - DNA, 3530 bp, Homo sapiens
acttccgctgggggcggagcggggcggggctgagtgggtggcgacctagctgctgcgccagtgtttgtgttggaagctcagctgatgcaggccggttggagtggacgtcattgccgggaacgagcgagtcgccgctgcagccctagtgactgcggcctgcatcccgattgtcttctcctccaaggtctacatgattacctgaagtttaataattttgcctttctagagtgttatacagctggaatcatactgctatggtccgaatgtttgtgcctctcaaaattcatgtggaaatcataaccgctaaagtgatggtattaagaggtaagaccatgaattatggcatttcttaaatgaagcgttcaagaagtgagagaatgtcatagaaaataaatgatttttaagttatgtctattaatctgactgtagatatatatatttacctccttagtaatgcaagaagtgtttgtgggaagcagagaagcaagcaactgtatttcttgttctcacctaagcattactggaggataagccacatcagtctacaaagaggttttcatacaaacataataagatgtaaatggaccaaaagtgaagcacattcttgcagtaagcactgttactctccaagcaaccatggtttacatattgggattttgaaacttagcacttctgctcccaagggacttacaaaagtgaacatttgtatgtcccgtattaaaagtactttgaactctgtttcaaaggctgtttttggcaatcaaaatgaaatgatttcacgtttagctcaatttaagccaagttcccaaattttaagaaaagtatcggatagtggctggttaaaacagaaaaacatcaaacaagccatcaaatctctgaaaaaatatagtgacaaatcagcagaaaagagtccttttccagaagagaaaagtcacattatagacaaagaagaagatataggtaaacgcagtctttttcattacacaagttctataaccacaaaatttggagactcattctactttttatcaaatcatattaattcatatttcaaacgtaaggaaaaaatgtctcaacaaaaggaaaatgaacatttccgggacaaatcagaacttgaagataaaaaggtagaagaggggaaattaagatctccagatcctggcatcctggcttataagccaggctcagaatctgtacatacggtggacaagcctacaagtccttctgcgatacctgatgttcttcaagtttcaactaaacaaagtattgctaactttctttctcgtcccacggaaggtgtacaagctttagtaggtggttatattggtggacttgtccccaaattaaagtatgattcaaagagtcagtcagaagaacaggaagagcctgctaaaactgatcaggctgtcagcaaagacagaaatgcagaggagaaaaagcgtttatctcttcagcgagaaaagattatcgcaagggtgagtattgataacaggacccgggcattagttcaggcattaagaagaacaactgacccaaagctctgcattactagggttgaagaactgacttttcatcttctagaatttcctgaaggaaaaggagtggctgtcaaggaaagaattattccatatttattacgactgagacaaattaaggatgaaactcttcaggctgcagttagagaaattttggccctaattggctatgtggatccagtgaaagggagaggaatccgaattctctcaattgatggtggaggaacaaggggcgtggttgctctccagaccctacgaaaattagttgaacttactcagaagccagttcatcagctctttgattacatttgtggtgtaagcacaggtgccatattagctttcatgttggggttgtttcatatgcccttggatgaatgtgaggaactttatcgaaaattaggatcagatgtattttcacaaaatgtcattgttggaacagtaaaaatgagttggagccatgcattttatgacagtcaaacatgggaaaacattcttaaggataggatgggatctgcactgatgattgaaacagcaagaaaccccacatgtcctaaggtagctgctgtaagtaccatagtaaatagagggataacacccaaagcttttgtgttcagaaactatggtcattttcctggaatcaactctcattatttgggaggctgtcagtataaaatgtggcaggccattagagcctcatctgctgctccaggctactttgcagaatatgcattgggaaatgatcttcatcaagatggaggtttgcttctgaataacccttcggcattagctatgcatgagtgtaaatgtctttggccagatgtgccgttagagtgcatagtatccctgggcactggacgttatgagagtgatgtgagaaacacggtaacatacacaagcttgaaaactaaactttctaatgttatcaacagtgctacagatacagaagaagtccatataatgcttgatggcctgttacctcctgacacctattttagattcaatcctgtaatgtgtgaaaacatacctctagatgaaagtcgaaatgaaaagctggatcagctgcagttggaagggttgaaatacatagaaagaaatgaacaaaaaatgaaaaaagttgcaaaaatattaagtcaagaaaaaacaactctgcagaaaattaatgattggataaaattaaaaactgatatgtatgaaggacttccattcttttcaaaattgtgatgagtatatgcttatgttctcataaatgaaggtctgtttagaagatcaaccacattcaataaggaattgtggggttcgacatgagttaactttgaaatacgtatgaattctggagaatcctgaaaaagacggtgcttcaaccagcttgcatagcacagagaatattcttggttacagaattcatatgggaactaggcttttaagatgttaataattagctaagctttagtaacccttactgtgctagtagattttagtagatattggtgttatattgtttgatgtttgaaaatatattaatatatgtgccgaacaagaaaccgaaagctatattgtactgtgtatttttactttagtcctcataatcatgttgaatttatgtgatcattgattttatttcatatggaaaagctaatttcttcttaaatttacattacctaatattctcactagctatgttctccaatccacactgccttttattgtaatatcatctaaatagatgcagaaaaatggaattttctctattaaagtattttacatttgacataaaaaagaaccagatacagttttctattcagatatgtttattttaacattgtttggttaaaaaaggtgaagttccagtcaaccactttttacccctgaaatttcaagataatgctatattaacttttccagatctaacactagcttattcttccctgttataaaatggtttgaacttactgaggagatattcctatcattaacaaaaataaactatttaaataa

SEQ ID NO: 21716 - DNA, 735 bp, Homo sapiens
ggaagctcagctgatgcaggccggttggagtggacgtcattgccgggaacgagcgagtcgccgctgcagccctagtaagaccatgaattatggcatttcttaaatgaagcgttcaagaagtgagagaatgtcatagaaaataaatgatttttaagttatgtctattaatctgactgtagatatatatatttacctccttagtaatgcaagaagtgtttgtgggaagcagagaagcaagcaactgtatttcttgttctcacctaagcattactggaggataagccacatcagtctacaaagaggttttcatacaaacataataagatgtaaatggaccaaaagtgaagcacattcttgcagtaagcactgttactctccaagcaaccatggtttacatattgggattttgaaacttagcacttctgctcccaagggacttacaaaagtgaacatttgtatgtcccgtattaaaagtactttgaactctgtttcaaaggctgtttttggcaatcaaaatgaaatgatttcacgtttagctcaatttaagccaagttcccaaattttaagaaaagtatcggatagtggctggttaaaacagaaaaacatcaaacaagccatcaaatctctgaaaaaatatagtgacaaatcagcagaaaagagtccttttccagaagagaaaagtcacattatagacaaagaagaagatataggtaaacgcagtctttttcattacac

SEQ ID NO: 21717 - DNA, 3462 bp, Homo sapiens
gtcatgctctattgcgcatatctcggggcgggggaggaacggagattgacaaggaggcagaggcctgagcgaggcggaaaatcctcaccccggcccgcgggtagacccaaacttctagcgcgtcacttccgctgggggcggagcggggcggggctgagtgggtggcgacctagctgctgcgccagtgtttgtgttggaagctcagctgatgcaggccggttggagtggacgtcattgccgggaacgagcgagtcgccgctgcagccctagtgactgcggcctgcatcccggtaagaccatgaattatggcatttcttaaatgaagcgttcaagaagtgagagaatgtcatagaaaataaatgatttttaagttatgtctattaatctgactgtagatatatatatttacctccttagtaatgcaagaagtgtttgtgggaagcagagaagcaagcaactgtatttcttgttctcacctaagcattactggaggataagccacatcagtctacaaagaggttttcatacaaacataataagatgtaaatggaccaaaagtgaagcacattcttgcagtaagcactgttactctccaagcaaccatggtttacatattgggattttgaaacttagcacttctgctcccaagggacttacaaaagtgaacatttgtatgtcccgtattaaaagtactttgaactctgtttcaaaggctgtttttggcaatcaaaatgaaatgatttcacgtttagctcaatttaagccaagttcccaaattttaagaaaagtatcggatagtggctggttaaaacagaaaaacatcaaacaagccatcaaatctctgaaaaaatatagtgacaaatcagcagaaaagagtccttttccagaagagaaaagtcacattatagacaaagaagaagatataggtaaacgcagtctttttcattacacaagttctataaccacaaaatttggagactcattctactttttatcaaatcatattaattcatatttcaaacgtaaggaaaaaatgtctcaacaaaaggaaaatgaacatttccgggacaaatcagaacttgaagataaaaaggtagaagaggggaaattaagatctccagatcctggcatcctggcttataagccaggctcagaatctgtacatacggtggacaagcctacaagtccttctgcgatacctgatgttcttcaagtttcaactaaacaaagtattgctaactttctttctcgtcccacggaaggtgtacaagctttagtaggtggttatattggtggacttgtccccaaattaaagtatgattcaaagagtcagtcagaagaacaggaagagcctgctaaaactgatcaggctgtcagcaaagacagaaatgcagaggagaaaaagcgtttatctcttcagcgagaaaagattatcgcaagggtgagtattgataacaggacccgggcattagttcaggcattaagaagaacaactgacccaaagctctgcattactagggttgaagaactgacttttcatcttctagaatttcctgaaggaaaaggagtggctgtcaaggaaagaattattccatatttattacgactgagacaaattaaggatgaaactcttcaggctgcagttagagaaattttggccctaattggctatgtggatccagtgaaagggagaggaatccgaattctctcaattgatggtggaggaacaaggggcgtggttgctctccagaccctacgaaaattagttgaacttactcagaagccagttcatcagctctttgattacatttgtggtgtaagcacaggtgccatattagctttcatgttggggttgtttcatatgcccttggatgaatgtgaggaactttatcgaaaattaggatcagatgtattttcacaaaatgtcattgttggaacagtaaaaatgagttggagccatgcattttatgacagtcaaacatgggaaaacattcttaaggataggatgggatctgcactgatgattgaaacagcaagaaaccccacatgtcctaaggtagctgctgtaagtaccatagtaaatagagggataacacccaaagcttttgtgttcagaaactatggtcattttcctggaatcaactctcattatttgggaggctgtcagtataaaatgtggcaggccattagagcctcatctgctgctccaggctactttgcagaatatgcattgggaaatgatcttcatcaagatggaggtttgcttctgaataacccttcggcattagctatgcatgagtgtaaatgtctttggccagatgtgccgttagagtgcatagtatccctgggcactggacgttatgagagtgatgtgagaaacacggtaacatacacaagcttgaaaactaaactttctaatgttatcaacagtgctacagatacagaagaagtccatataatgcttgatggcctgttacctcctgacacctattttagattcaatcctgtaatgtgtgaaaacatacctctagatgaaagtcgaaatgaaaagctggatcagctgcagttggaagggttgaaatacatagaaagaaatgaacaaaaaatgaaaaaagttgcaaaaatattaagtcaagaaaaaacaactctgcagaaaattaatgattggataaaattaaaaactgatatgtatgaaggacttccattcttttcaaaattgtgatgagtatatgcttatgttctcataaatgaaggtctgtttagaagatcaaccacattcaataaggaattgtggggttcgacatgagttaactttgaaatacgtatgaattctggagaatcctgaaaaagacggtgcttcaaccagcttgcatagcacagagaatattcttggttacagaattcatatgggaactaggcttttaagatgttaataattagctaagctttagtaacccttactgtgctagtagattttagtagatattggtgttatattgtttgatgtttgaaaatatattaatatatgtgccgaacaagaaaccgaaagctatattgtactgtgtatttttactttagtcctcataatcatgttgaatttatgtgatcattgattttatttcatatggaaaagctaatttcttcttaaatttacattacctaatattctcactagctatgttctccaatccacactgccttttattgtaatatcatctaaatagatgcagaaaaatggaattttctctattaaagtattttacatttgacataaaaaagaaccagatacagttttctattcagatatgtttattttaacattgtttggttaaaaaaggtgaagttccagtcaaccactttttacccctgaaatttcaagataatgctatattaacttttccagatctaacactagcttattcttccctgttataaaatggtttgaacttactgaggagatat

SEQ ID NO: 21718 - DNA, 4259 bp, Homo sapiens
gcgagtcgccgctgcagccctagtgactgcggcctgcatcccggtaagaccatgaattatggcatttcttaaatgaagcgttcaagaagtgagagaatgtcatagaaaataaatgatttttaagttatgtctattaatctgactgtagatatatatatttacctccttagtaatgcaagaagtgtttgtgggaagcagagaagcaagcaactgtatttcttgttctcacctaagcattactggaggataagccacatcagtctacaaagaggttttcatacaaacataataagatgtaaatggaccaaaagtgaagcacattcttgcagtaagcactgttactctccaagcaaccatggtttacatattgggattttgaaacttagcacttctgctcccaagggacttacaaaagtgaacatttgtatgtcccgtattaaaagtactttgaactctgtttcaaaggctgtttttggcaatcaaaatgaaatgatttcacgtttagctcaatttaagccaagttcccaaattttaagaaaagtatcggatagtggctggttaaaacagaaaaacatcaaacaagccatcaaatctctgaaaaaatatagtgacaaatcagcagaaaagagtccttttccagaagagaaaagtcacattatagacaaagaagaagatataggtaaacgcagtctttttcattacacaagttctataaccacaaaatttggagactcattctactttttatcaaatcatattaattcatatttcaaacgtaaggaaaaaatgtctcaacaaaaggaaaatgaacatttccgggacaaatcagaacttgaagataaaaaggtagaagaggggaaattaagatctccagatcctggcatcctggcttataagccaggctcagaatctgtacatacggtggacaagcctacaagtccttctgcgatacctgatgttcttcaagtttcaactaaacaaagtattgctaactttctttctcgtcccacggaaggtgtacaagctttagtaggtggttatattggtggacttgtccccaaattaaagtatgattcaaagagtcagtcagaagaacaggaagagcctgctaaaactgatcaggctgtcagcaaagacagaaatgcagaggagaaaaagcgtttatctcttcagcgagaaaagattatcgcaagggtgagtattgataacaggacccgggcattagttcaggcattaagaagaacaactgacccaaagctctgcattactagggttgaagaactgacttttcatcttctagaatttcctgaaggaaaaggagtggctgtcaaggaaagaattattccatatttattacgactgagacaaattaaggatgaaactcttcaggctgcagttagagaaattttggccctaattggctatgtggatccagtgaaagggagaggaatccgaattctctcaattgatggtggaggaacaaggggcgtggttgctctccagaccctacgaaaattagttgaacttactcagaagccagttcatcagctctttgattacatttgtggtgtaagcacaggtgccatattagctttcatgttggggttgtttcatatgcccttggatgaatgtgaggaactttatcgaaaattaggatcagatgtattttcacaaaatgtcattgttggaacagtaaaaatgagttggagccatgcattttatgacagtcaaacatgggaaaacattcttaaggataggatgggatctgcactgatgattgaaacagcaagaaaccccacatgtcctaaggatggaggtttgcttctgaataacccttcggcattagctatgcatgagtgtaaatgtctttggccagatgtgccgttagagtgcatagtatccctgggcactggacgttatgagagtgatgtgagaaacacggtaacatacacaagcttgaaaactaaactttctaatgttatcaacagtgctacagatacagaagaagtccatataatgcttgatggcctgttacctcctgacacctattttagattcaatcctgtaatgtgtgaaaacatacctctagatgaaagtcgaaatgaaaagctggatcagctgcagttggaagggttgaaatacatagaaagaaatgaacaaaaaatgaaaaaagttgcaaaaatattaagtcaagaaaaaacaactctgcagaaaattaatgattggataaaattaaaaactgatatgtatgaaggacttccattcttttcaaaattgtgatgagtatatgcttatgttctcataaatgaaggtctgtttagaagatcaaccacattcaataaggaattgtggggttcgacatgagttaactttgaaatacgtatgaattctggagaatcctgaaaaagacggtgcttcaaccagcttgcatagcacagagaatattcttggttacagaattcatatgggaactaggcttttaagatgttaataattagctaagctttagtaacccttactgtgctagtagattttagtagatattggtgttatattgtttgatgtttgaaaatatattaatatatgtgccgaacaagaaaccgaaagctatattgtactgtgtatttttactttagtcctcataatcatgttgaatttatgtgatcattgattttatttcatatggaaaagctaatttcttcttaaatttacattacctaatattctcactagctatgttctccaatccacactgccttttattgtaatatcatctaaatagatgcagaaaaatggaattttctctattaaagtattttacatttgacataaaaaagaaccagatacagttttctattcagatatgtttattttaacattgtttggttaaaaaaggtgaagttccagtcaaccactttttacccctgaaatttcaagataatgctatattaacttttccagatctaacactagcttattcttccctgttataaaatggtttgaacttactgaggagatattcctatcattaacaaaaataaactatttaaataatctgttgttaaaaggctaatgtcattttaaaattaatttttgttcataatgtagctcccctttagcctttgaatacacctggcagcagtatgcttaaaaataagaagttagttgcctggcgcagtagctcacacctgtaatcccagcactttgggaggccgaggcaggcagatcacctgacgtcaggagtccaagaccagcctggccaacacggtgaaacctcgtctctaataaaaatacaaacattagcccggcatggtggtgcacacctatagtcccagctactcgggaggctaaggcaggagaatggcttgaacctgagagacggaggttgcagtgagccaaatagcgccagtgcactccagcctaggcgacacagcgagactccatctcaaaaaaaaaaaaaaaaaaaagaagaagttaggcttgttttaccttattaactcctttgaactgtctggatttcatggaagttggtaagatgcacttacatggaacattgttcatgccaaacaaactcatctttattgtatctatttgtcacataaatccttacatggaatgttttgatttcttaagaaaaatgaaacaaaggttagcgccccttgttttagacatacaaactaaagctagaccctgttgcccagatagtcatattgcttctttgcaatatcaattcacagaggctgtgagatgtggttcaaagagtggagtcgagagtctggatgctaatcctgcctttgctgcaagaacccttctgtttgttaccttgaggaaggcaaatgtctgtaggctttgcatatctcatttgtaaaatgaggaaaggtagctgtaaaattttctaacatccgaattatataaactttagacatagtataaaataggaaactaccaatgatttctaaagataatatagttctttcagaccacaaataatacataataacatgcaactaagaacaacttgtaaatgcaagaaaaaaacaaataattggaaatcagaatatttctgggaattcttcgtaataaagcaaatttcaagcacaataaagtaatatttatgcatatttacatatttgcacctcatcataaggtcactctagtcctaaactgatgtagttcatctgttttacagctgaagttaagtatgtcccttatttgtgcttggcttatttctttcttaaataatacattacacaagtgaa

SEQ ID NO: 21719 - DNA, 3366 bp, Homo sapiens
atgctctattgcgcatatctcggggcgggggaggaacggagattgacaaggaggcagaggcctgagcgaggcggaaaatcctcaccccggcccgcgggtagacccaaacttctagcgcgtcacttccgctgggggcggagcggggcggggctgagtgggtggcgacctagctgctgcgccagtgtttgtgttggaagctcagctgatgcaggccggttggagtggacgtcattgccgggaacgagcgagtcgccgctgcagccctagtgactgcggcctgcatcccgtaatgcaagaagtgtttgtgggaagcagagaagcaagcaactgtatttcttgttctcacctaagcattactggaggataagccacatcagtctacaaagaggttttcatacaaacataataagatgtaaatggaccaaaagtgaagcacattcttgcagtaagcactgttactctccaagcaaccatggtttacatattgggattttgaaacttagcacttctgctcccaagggacttacaaaagtgaacatttgtatgtcccgtattaaaagtactttgaactctgtttcaaaggctgtttttggcaatcaaaatgaaatgatttcacgtttagctcaatttaagccaagttcccaaattttaagaaaagtatcggatagtggctggttaaaacagaaaaacatcaaacaagccatcaaatctctgaaaaaatatagtgacaaatcagcagaaaagagtccttttccagaagagaaaagtcacattatagacaaagaagaagatataggtaaacgcagtctttttcattacacaagttctataaccacaaaatttggagactcattctactttttatcaaatcatattaattcatatttcaaacgtaaggaaaaaatgtctcaacaaaaggaaaatgaacatttccgggacaaatcagaacttgaagataaaaaggtagaagaggggaaattaagatctccagatcctggcatcctggcttataagccaggctcagaatctgtacatacggtggacaagcctacaagtccttctgcgatacctgatgttcttcaagtttcaactaaacaaagtattgctaactttctttctcgtcccacggaaggtgtacaagctttagtaggtggttatattggtggacttgtccccaaattaaagtatgattcaaagagtcagtcagaagaacaggaagagcctgctaaaactgatcaggctgtcagcaaagacagaaatgcagaggagaaaaagcgtttatctcttcagcgagaaaagattatcgcaagggtgagtattgataacaggacccgggcattagttcaggcattaagaagaacaactgacccaaagctctgcattactagggttgaagaactgacttttcatcttctagaatttcctgaaggaaaaggagtggctgtcaaggaaagaattattccatatttattacgactgagacaaattaaggatgaaactcttcaggctgcagttagagaaattttggccctaattggctatgtggatccagtgaaagggagaggaatccgaattctctcaattgatggtggaggaacaaggggcgtggttgctctccagaccctacgaaaattagttgaacttactcagaagccagttcatcagctctttgattacatttgtggtgtaagcacaggtgccatattagctttcatgttggggttgtttcatatgcccttggatgaatgtgaggaactttatcgaaaattaggatcagatgtattttcacaaaatgtcattgttggaacagtaaaaatgagttggagccatgcattttatgacagtcaaacatgggaaaacattcttaaggataggatgggatctgcactgatgattgaaacagcaagaaaccccacatgtcctaaggtagctgctgtaagtaccatagtaaatagagggataacacccaaagcttttgtgttcagaaactatggtcattttcctggaatcaactctcattatttgggaggctgtcagtataaaatgtggcaggccattagagcctcatctgctgctccaggctactttgcagaatatgcattgggaaatgatcttcatcaagatggaggtttgcttctgaataacccttcggcattagctatgcatgagtgtaaatgtctttggccagatgtgccgttagagtgcatagtatccctgggcactggacgttatgagagtgatgtgagaaacacggtaacatacacaagcttgaaaactaaactttctaatgttatcaacagtgctacagatacagaagaagtccatataatgcttgatggcctgttacctcctgacacctattttagattcaatcctgtaatgtgtgaaaacatacctctagatgaaagtcgaaatgaaaagctggatcagctgcagttggaagggttgaaatacatagaaagaaatgaacaaaaaatgaaaaaagttgcaaaaatattaagtcaagaaaaaacaactctgcagaaaattaatgattggataaaattaaaaactgatatgtatgaaggacttccattcttttcaaaattgtgatgagtatatgcttatgttctcataaatgaaggtctgtttagaagatcaaccacattcaataaggaattgtggggttcgacatgagttaactttgaaatacgtatgaattctggagaatcctgaaaaagacggtgcttcaaccagcttgcatagcacagagaatattcttggttacagaattcatatgggaactaggcttttaagatgttaataattagctaagctttagtaacccttactgtgctagtagattttagtagatattggtgttatattgtttgatgtttgaaaatatattaatatatgtgccgaacaagaaaccgaaagctatattgtactgtgtatttttactttagtcctcataatcatgttgaatttatgtgatcattgattttatttcatatggaaaagctaatttcttcttaaatttacattacctaatattctcactagctatgttctccaatccacactgccttttattgtaatatcatctaaatagatgcagaaaaatggaattttctctattaaagtattttacatttgacataaaaaagaaccagatacagttttctattcagatatgtttattttaacattgtttggttaaaaaaggtgaagttccagtcaaccactttttacccctgaaatttcaagataatgctatattaacttttccagatctaacactagcttattcttccctgttataaaatggtttgaacttactgaggagatattcctatcattaacaaaaataaactatttaaataa

SEQ ID NO: 21720 - DNA, 4225 bp, Homo sapiens
cccacgcccgcgccttggcggccccactgaatccctacgcggggcccagcggtaccgggagaccgggctagcctatgggagcgcccagataacgcgggttgggggcgcccgcgccccccatccccgccagcatgactcgatcgccgcccctcagagagctgcccccgagttacacacccccagctcgaaccgcagcaccccagatcctagctgggagcctgaaggctccactctggcttcgtgcttacttccagggcctgctcttctctctgggatgcgggatccagagacattgtggcaaagtgctctttctgggactgttggcctttggggccctggcattaggtctccgcatggccattattgagacaaacttggaacagctctgggtagaagtgggcagccgggtgagccaggagctgcattacaccaaggagaagctgggggaggaggctgcatacacctctcagatgctgatacagaccgcacgccaggagggagagaacatcctcacacccgaagcacttggcctccacctccaggcagccctcactgccagtaaagtccaagtatcactctatgggaagtcctgggatttgaacaaaatctgctacaagtcaggagttccccttattgaaaatggaatgattgagcggatgattgagaagctgtttccgtgcgtgatcctcacccccctcgactgcttctgggagggagccaaactccaagggggctccgcctacctgcccggccgcccggatatccagtggaccaacctggatccagagcagctgctggaggagctgggtccctttgcctcccttgagggcttccgggagctgctagacaaggcacaggtgggccaggcctacgtggggcggccctgtctgcaccctgatgacctccactgcccacctagtgcccccaaccatcacagcaggcaggctcccaatgtggctcacgagctgagtgggggctgccatggcttctcccacaaattcatgcactggcaggaggaattgctgctgggaggcatggccagagacccccaaggagagctgctgagggcagaggccctgcagagcaccttcttgctgatgagtccccgccagctgtacgagcatttccggggtgactatcagacacatgacattggctggagtgaggagcaggccagcacagtgctacaagcctggcagcggcgctttgtgcagctggcccaggaggccctgcctgagaacgcttcccagcagatccatgccttctcctccaccaccctggatgacatcctgcatgcgttctctgaagtcagtgctgcccgtgtggtgggaggctatctgctcatgctggcctatgcctgtgtgaccatgctgcggtgggactgcgcccagtcccagggttccgtgggccttgccggggtactgctggtggccctggcggtggcctcaggccttgggctctgtgccctgctcggcatcaccttcaatgctgccactacccaggtgctgcccttcttggctctgggaatcggcgtggatgacgtattcctgctggcgcatgccttcacagaggctctgcctggcacccctctccaggagcgcatgggcgagtgtctgcagcgcacgggcaccagtgtcgtactcacatccatcaacaacatggccgccttcctcatggctgccctcgttcccatccctgcgctgcgagccttctccctacaggcggccatagtggttggctgcacctttgtagccgtgatgcttgtcttcccagccatcctcagcctggacctacggcggcgccactgccagcgccttgatgtgctctgctgcttctccagtccctgctctgctcaggtgattcagatcctgccccaggagctgggggacgggacagtaccagtgggcattgcccacctcactgccacagttcaagcctttacccactgtgaagccagcagccagcatgtggtcaccatcctgcctccccaagcccacctggtgcccccaccttctgacccactgggctctgagctcttcagccctggagggtccacacgggaccttctaggccaggaggaggagacaaggcagaaggcagcctgcaagtccctgccctgtgcccgctggaatcttgcccatttcgcccgctatcagtttgccccgttgctgctccagtcacatgctaaggccatcgtgctggtgctctttggtgctcttctgggcctgagcctctacggagccaccttggtgcaagacggcctggccctgacggatgtggtgcctcggggcaccaaggagcatgccttcctgagcgcccagctcaggtacttctccctgtacgaggtggccctggtgacccagggtggctttgactacgcccactcccaacgcgccctctttgatctgcaccagcgcttcagttccctcaaggcggtgctgcccccaccggccacccaggcaccccgcacctggctgcactattaccgcaactggctacagggaatccaggctgcctttgaccaggactgggcttctgggcgcatcacccgccactcgtaccgcaatggctctgaggatggggccctggcctacaagctgctcatccagactggagacgcccaggagcctctggatttcagccagctgaccacaaggaagctggtggacagagagggactgattccacccgagctcttctacatggggctgaccgtgtgggtgagcagtgaccccctgggtctggcagcctcacaggccaacttctaccccccacctcctgaatggctgcacgacaaatacgacaccacgggggagaaccttcgcatcccgccagctcagcccttggagtttgcccagttccccttcctgctgcgtggcctccagaagactgcagactttgtggaggccatcgagggggcccgggcagcatgcgcagaggccggccaggctggggtgcacgcctaccccagcggctcccccttcctcttctgggaacagtatctgggcctgcggcgctgcttcctgctggccgtctgcatcctgctggtgtgcactttcctcgtctgtgctctgctgctcctcaacccctggacggctggcctcatagtgctggtcctggcgatgatgacagtggaactctttggtatcatgggtttcctgggcatcaagctgagtgccatccccgtggtgatccttgtggcctctgtaggcattggcgttgagttcacagtccacgtggctctgggcttcctgaccacccagggcagccggaacctgcgggccgcccatgcccttgagcacacatttgcccccgtgaccgatggggccatctccacattgctgggtctgctcatgcttgctggttcccactttgacttcattgtaaggtacttctttgcggcgctgacagtgctcacgctcctgggcctcctccatggactcgtgctgctgcctgtgctgctgtccatcctgggcccgccgccagaggtgatacagatgtacaaggaaagcccagagatcctgagtccaccagctccacagggaggcgggcttaggtggggggcatcctcctccctgccccagagctttgccagagtgactacctccatgaccgtggccatccacccaccccccctgcctggtgcctacatccatccagcccctgatgagcccccttggtcccctgctgccactagctctggcaacctcagttccaggggaccaggtccagccactgggtgaaagagcagctgaagcacagagaccatgtgtggggcgtgtggggtcactgggaagcactgggtctggtgttagacgcaggatggacccctggagggccctgctgctgctgcatcccctctcccgacccagctgtcatgggcctccctgatatccatacagaacagccaccgatttgcacatccaggcctgtgtgagcctgtatctgtgtcacttgagagtgaaagctggcacttggggctgcagtgcagccctgtcccccttcccaccccacaccactgcctgcccagctgaccaagcctgagggaccctccagcacccttccgtctggtgactcctgggcaggctctccatatccctgcccacctcctaccacatccattatttatatgaaaatgtctatttttgtagtatacatacatgttagctatgatgaaagttttattttttaaagaatgaaatatattctatgtgaactaatctca

SEQ ID NO: 21721 - DNA, 1110 bp, Homo sapiens
ctttgacttcattgtaaggtacttctttgcggcgctgacagtgctcacgctcctgggcctcctccatggactcgtgctgctgcctgtgctgctgtccatcctgggcccgccgccagaggtgatacagatgtacaaggaaagcccagagatcctgagtccaccagctccacagggaggcgggcttagagtggggagtttgcaagtgaacattagctattggaaggagcttctctggtgccaggacctgaggcccgaggagatctagcctctgcctcccaccccagcaccccctcatcagacacacggagcgccactgtctggacaggctgaattggtcttcgggtccctaatttctcatacgccattccctctgcctagaacactttctcacctccccttgatgtgaccccatatcacccttcgaggtgaattggatcggatgccatctcctccaggaggggtggggtcgtgcctcctgtgaggtcccagtgcccctgagtgtctgtgcccgtctgtttccccgtccctctctctaagcccggaggcttactgcgggtaaggacggcgggacaggaccttaacccctgggacgaacaccagctccgcaaaggactccgcacccggcgccgcccacggggtgcgggtcccaggaggaccagcagagaggagcataggagagcaaaggagatcagtgacccatggcttccccggtggcgcggaacagcccggagccgcctgtgatttgcatacccatggtgcaccacgaaaagataccctcaagatgcttgcactccctctgtgcgcgcatttctgcactgttttagagcatgatgcctcttacacgcatctgtgtgcataaactacatatagggagtgcgtaccacgcaggcatccaacaaccataagtgtgttaagtgttagttctccctgcgaggttcgaagcggaagtcacgaatatactcgggtttctcttcaaagcgcataaatctttcgccttttactaaagatttccgtggagagaaagttgtgagtttttattcaattttttgaggcctcttatttcctgaggctacatttttaagtattaaaagttaggcaactacaaccaag

SEQ ID NO: 21722 - DNA, 4298 bp, Homo sapiens
atccccgccagcatgactcgatcgccgcccctcagagagctgcccccgagttacacacccccagctcgaaccgcagcaccccagatcctagctgggagcctgaaggctccactctggcttcgtgcttacttccagggcctgctcttctctctgggatgcgggatccagagacattgtggcaaagtgctctttctgggactgttggcctttggggccctggcattaggtctccgcatggccattattgagacaaacttggaacagctctgggtagaagtgggcagccgggtgagccaggagctgcattacaccaaggagaagctgggggaggaggctgcatacacctctcagatgctgatacagaccgcacgccaggagggagagaacatcctcacacccgaagcacttggcctccacctccaggcagccctcactgccagtaaagtccaagtatcactctatgggaagtcctgggatttgaacaaaatctgctacaagtcaggagttccccttattgaaaatggaatgattgagcggatgattgagaagctgtttccgtgcgtgatcctcacccccctcgactgcttctgggagggagccaaactccaagggggctccgcctacctgcccggccgcccggatatccagtggaccaacctggatccagagcagctgctggaggagctgggtccctttgcctcccttgagggcttccgggagctgctagacaaggcacaggtgggccaggcctacgtggggcggccctgtctgcaccctgatgacctccactgcccacctagtgcccccaaccatcacagcaggcaggctcccaatgtggctcacgagctgagtgggggctgccatggcttctcccacaaattcatgcactggcaggaggaattgctgctgggaggcatggccagagacccccaaggagagctgctgagggcagaggccctgcagagcaccttcttgctgatgagtccccgccagctgtacgagcatttccggggtgactatcagacacatgacattggctggagtgaggagcaggccagcacagtgctacaagcctggcagcggcgctttgtgcagctggcccaggaggccctgcctgagaacgcttcccagcagatccatgccttctcctccaccaccctggatgacatcctgcatgcgttctctgaagtcagtgctgcccgtgtggtgggaggctatctgctcatgctggcctatgcctgtgtgaccatgctgcggtgggactgcgcccagtcccagggttccgtgggccttgccggggtactgctggtggccctggcggtggcctcaggccttgggctctgtgccctgctcggcatcaccttcaatgctgccactacccaggtgctgcccttcttggctctgggaatcggcgtggatgacgtattcctgctggcgcatgccttcacagaggctctgcctggcacccctctccaggagcgcatgggcgagtgtctgcagcgcacgggcaccagtgtcgtactcacatccatcaacaacatggccgccttcctcatggctgccctcgttcccatccctgcgctgcgagccttctccctacaggcggccatagtggttggctgcacctttgtagccgtgatgcttgtcttcccagccatcctcagcctggacctacggcggcgccactgccagcgccttgatgtgctctgctgcttctccagtccctgctctgctcaggtgattcagatcctgccccaggagctgggggacgggacagtaccagtgggcattgcccacctcactgccacagttcaagcctttacccactgtgaagccagcagccagcatgtggtcaccatcctgcctccccaagcccacctggtgcccccaccttctgacccactgggctctgagctcttcagccctggagggtccacacgggaccttctaggccaggaggaggagacaaggcagaaggcagcctgcaagtccctgccctgtgcccgctggaatcttgcccatttcgcccgctatcagtttgccccgttgctgctccagtcacatgctaaggccatcgtgctggtgctctttggtgctcttctgggcctgagcctctacggagccaccttggtgcaagacggcctggccctgacggatgtggtgcctcggggcaccaaggagcatgccttcctgagcgcccagctcaggtacttctccctgtacgaggtggccctggtgacccagggtggctttgactacgcccactcccaacgcgccctctttgatctgcaccagcgcttcagttccctcaaggcggtgctgcccccaccggccacccaggcaccccgcacctggctgcactattaccgcaactggctacagggaatccaggctgcctttgaccaggactgggcttctgggcgcatcacccgccactcgtaccgcaatggctctgaggatggggccctggcctacaagctgctcatccagactggagacgcccaggagcctctggatttcagccagctgaccacaaggaagctggtggacagagagggactgattccacccgagctcttctacatggggctgaccgtgtgggtgagcagtgaccccctgggtctggcagcctcacaggccaacttctaccccccacctcctgaatggctgcacgacaaatacgacaccacgggggagaaccttcgcatcccgccagctcagcccttggagtttgcccagttccccttcctgctgcgtggcctccagaagactgcagactttgtggaggccatcgagggggcccgggcagcatgcgcagaggccggccaggctggggtgcacgcctaccccagcggctcccccttcctcttctgggaacagtatctgggcctgcggcgctgcttcctgctggccgtctgcatcctgctggtgtgcactttcctcgtctgtgctctgctgctcctcaacccctggacggctggcctcatagtgctggtcctggcgatgatgacagtggaactctttggtatcatgggtttcctgggcatcaagctgagtgccatccccgtggtgatccttgtggcctctgtaggcattggcgttgagttcacagtccacgtggctctgggcttcctgaccacccagggcagccggaacctgcgggccgcccatgcccttgagcacacatttgcccccgtgaccgatggggccatctccacattgctgggtctgctcatgcttgctggttcccactttgacttcattgtaaggtacttctttgcggcgctgacagtgctcacgctcctgggcctcctccatggactcgtgctgctgcctgtgctgctgtccatcctgggcccgccgccagaggtgatacagatgtacaaggaaagcccagagatcctgagtccaccagctccacagggaggcgggcttaggcccgaggagatctagcctctgcctcccaccccagcaccccctcatcagacacacggagcgccactgtctggacaggctgaattggtcttcgggtccctaatttctcatacgccattccctctgcctagaacactttctcacctccccttgatgtgaccccatatcacccttcgaggtgaattggatcggatgccatctcctccaggaggggtggggtcgtgcctcctgtgaggtcccagtgcccctgagtgtctgtgcccgtctgtttccccgtccctctctctaagcccggaggcttactgcgggtaaggacggcgggacaggaccttaacccctgggacgaacaccagctccgcaaaggactccgcacccggcgccgcccacggggtgcgggtcccaggaggaccagcagagaggagcataggagagcaaaggagatcagtgacccatggcttccccggtggcgcggaacagcccggagccgcctgtgatttgcatacccatggtgcaccacgaaaagataccctcaagatgcttgcactccctctgtgcgcgcatttctgcactgttttagagcatgatgcctcttacacgcatctgtgtgcataaactacatatagggagtgcgtaccacgcaggcatccaacaaccataagtgtgttaagtgttagttctccctgcgaggttcgaagcggaagtcacgaatatactcgggtttctcttcaaagcgcataaatctttcgccttttactaaagatttccgtggagagaaagttgtgagtttttattcaattttttgaggcctcttatttcctgaggctacatttttaagtattaaaagttaggcaactacaaccaag

SEQ ID NO: 21723 - DNA, 13714 bp, Homo sapiens
tttggaaggaggcgtgatttccacgttcgagcgtcttcgctccccaccccctctcggcaccagccagtgcgcgccaccacctgagcctggcgagagccgggacgcacgcagtcttcagcctgctcctttaagcctctggagagactcggctctgagcgggtccgcccgacacccgccccctccccccactcctgagaactctttactttttgtttggaaaatcggggccatttctttatttatctctgggtcttcccggaggagggcagagaaggggagagcgagcttggcgggccggaccgggggaggggagcgaagggaggggaggggactgggtgtagcctggaattctccgtcctcgtgttcctgggcgggcgcgcagagtctcctggcgatagcgccgtcgccgctccccgcgccaccccgtcgttggccttgggggtcgggtgagtggggtcatgacgagccgcgggggctgccccgggccccgcccgcgctgagaggggacgcggccgcgcggcgcggagcccccctggcggggaggccgcggggggtggggagggcgcacgcggtagggcggagtgggggcggcgcagaggccgccaagctggggggctctccgggagggcgcggccgcgggcaggagggcgtgtctccggctcgaggggaccctcccgaggcgcggcgcgggactccccgatggtggtgccgcggctccgggagagctcagggtctcgccgccgccgccgtcgccgccgccgcgggcgccgctgccgccgccgccgccgccgccgccgccgccgcccgaacccgcgccgagcgtgcgcctcgccctcctcccgcgcccgctctgctctaggatgctgcggcaggttctgcacaggggcttgaggacgtgtttctcccggctcggccacttcattgccagtcaccctgtcttcttcgcctcggcgccggtgctcatctccatcctgctcggcgccagcttcagccgctaccaggtcgaggagagcgtggagcacctgctggcgccccagcacagcctggccaagatcgagcgcaacctcgttaacagcctcttcccggtcaaccgctccaagcaccgtctctactcggacctgcagacccccgggcgctacggccgggtcatcgtcacctccttccagaaagccaacatgctggaccagcatcacaccgacctgatcttaaagttgcatgctgctgtcaccaagatccaggttccaaggcctggttttaattacacgtttgcccatatatgtatcctgaataatgataagacttgcatcgtggatgacatagtgcacgtcctggaagagctaaagaatgctcgggccaccaatcggaccaattttgctatcacatacccaatcactcacttaaaggacgggagggctgtgtacaatgggcaccagcttgggggcgtcactgtgcacagcaaagaccgggtgaaatctgcagaggccatccagctcacctactacctgcagtcaatcaacagtctcaatgacatggtggctgagaggtgggagtccagcttctgcgacactgtcagactgtttcagaaatccaacagcaaagtcaaaatgtacccttacacgtcctcctcactgagggaagatttccagaagaccagccgcgtatcagaacgttacctggtcaccagcctgattctggtggttaccatggccatcctgtgttgctctatgcaggactgcgtccgcagcaaaccctggctaggcctgctcggattggtgaccataagcctggccactctcactgcagccgggatcatcaatcttactggtgggaaatataattccaccttcctgggagtccctttcgtcatgctaggtcatggattatatgggacttttgaaatgttatcctcctggaggaaaactagagaagaccaacatgttaaagagagaactgcagcagtctatgcagactccatgctctccttttctctcaccactgccatgtacctggtcacctttggcataggggccagccctttcacgaacattgaggcagccaggattttctgctgcaattcctgtattgcaatcttcttcaactacctctatgtactctcgttttatggttccagcctagtgttcactggctacatagaaaacaattaccagcatagtatcttctgtagaaaagtcccaaagcctgaggcattgcaggagaagccggcatggtacaggtttctcctgacggccagattcagtgaggacacagctgaaggcgaggaagcgaacacttacgagagtcacctattggtatgtttcctcaaacgctattactgtgactggataaccaacacctatgtcaagccttttgtagttctcttttaccttatttatatttcctttgccttaatgggctatctgcaggtcagtgaagggtcagaccttagtaacattgtagcaaccgcgacacaaaccattgagtacactactgcccagcaaaagtacttcagcaactacagtcctgtgattgggttttacatatatgagtctatagaatactggaacactagtgtccaagaagatgttctagaatacaccaaggggtttgtgcggatatcctggtttgagagctatttaaattaccttcggaaactcaatgtatccactggcttgcctaagaaaaatttcacagacatgttgaggaattcctttctgaaagcccctcaattttcacattttcaagaggacatcatcttctctaaaaaatacaatgatgaggtcgatgtagtggcctccagaatgtttttggtggccaagaccatggaaacaaacagagaagaactctatgatctcttggaaaccctgaggagactttctgtcacctccaaggtgaagttcatcgtcttcaatccgtcctttgtatacatggatcgatatgcctcctctctgggagcccccctgcacaactcctgcatcagtgctttgttcctgctcttcttctcggcattcctggtggcagattcactgattaacgtctggatcactctcacagttgtgtccgtggagtttggagtgataggtttcatgacattatggaaagtagaactggactgcatttctgtgctatgcttaatttatggaattaattacacaattgacaattgtgctccaatgttatccacatttgttctgggcaaggatttcacaagaactaaatgggtaaaaaatgccctggaagtgcatggggtagctattttacagagttacctctgctatattgttggtctgattcctcttgcagctgtgccttcaaatctgacctgtacactgttcaggtgcttgtttttaatagcatttgtcaccttctttcactgctttgccattttacctgtgatactgactttcctgccaccctctaagaaaaaaaggaaagagaagaaaaatcctgagaaccgggaggaaattgagtgtgtagaaatggtagatatcgatagtacccgtgtggttgaccaaattacaacagtgtgataatgtctgcttggcatattttcaccttaggtcttatcaagaccaaagagattatgttaatgaaacaattaaattcaaagttcttcccttttttaaagataggaaacaggcattgccaaaaaaaaaaaaaaaaaaaaaaggaaaggacagtggggagaaatgggcctggcatattttcagtctttaaaacaaaggagttgttatgagaattcacacacacatagacacacacacacacacacacacacacacacacacacacacaccctgggagacctatagtctcttaaactaagatcaagtagaagaaagcttattaacaagcaggatcctgccttatccaaactgcagatgttgctggcattgtgacaaaacccactgattgaaaggtcaactgccaaggcagaaacacctttaagcattgttcaaacaataaggcttccagaacttctgtagagcagtagctccagtcatggtctgtggtttgaggttttagctgtctcacctagctccctaacactgaaggagatacttgtgaaagttctgaccagcaaaagcaagccagagccttggaaactgatatgtggtagagtggccatcactcatggactaaaattgattcaccgctaaatttacccaggtgaagcagtttcgttgtctagaatgaaattatcatattccgccattggtatgcctttaacatttgtatagtttggtttgcttaaaacaccttaaaaccaatgacagctccagcactgcagaattggtgtgattctactttggaatagcttgtcacttgtcaccaaatgggtctgctttattagttacagctcttggcaggaggatccagggacccaaaaccacagggccaaacccaaatacctggcatgatggagcaaaagcaggtgtctacttggacccagatatagtgtctccattttaacaacaacaacaaaatagccagctggtacagctgtttgcattggccctacatgcattttttgcatggatatccagaaacatctgcccacacaaaactgcggggaaaaaaaatgaacactgaaatagttatttgctgttgcttccaacttgtagtgccagtctgcctttgctgtgaaacacacctgctcagagacagagaggggaagaagatctttggtaagtctaagtcctgacgctgagaagctttgtaaaagtgcagggagataaagggccaaaagggagatagatggaaaacactggaaaaagtattcactgatacaaatctatcaatgatggcagtccaattctcttgctaaagtggctgcacctcaccttgctggtcccccccacaccttttttgatgtccttctgcgtcatcatagcaaggcccttctgtaaattaacaagcctagatatttatactcttgacttccagtatctacagaagaatggttcatagatctaaacagaaatggtttagatctaaaaaggctgtatacgttgcccaggcccctgcatttctttaaatttataaaaatgaagctaaaacctggttacatttgaagcaaatatctacagtatttttcccttttagagatgtagcttccttagacatctgtagtggtaagcatttcccaaaagcatcttacctttctgaaccttagcagacatactgtgcagcttacctatcttctgcagaggaggaaactgagacctaggagaataaagtgactcactcaggtcacaccactaaagggttttcatcatttcagcatacctaagacagggcagtccaattttcagtattctcataagatggctattactcctctcaaaatgcatttccaaagtaggaacataggacttcgttggccacagggcagacatttttttagtgtctggaattaaaatgtttgaggtttaggtttgccattgtctttccaaaaggccaaataattcagatgtaaccacaccaagtgcaaacctgtgctttctatttcacgtactgttgtccatacagttctaaatacatgtgcaggggattgtagctaatgcattacacagtcgttcagtcttctctgcagacacactaagtgatcataccaacgtgttatacactcaactagaagataataagctttaatctgagggcaagtacagtcctgacaaaagggcaagtttgcataatagatcttcgatcaattctctctccaaggggcccgcaactaggctattattcataaaacacaactgaagaggggattggttttactgttaaatcatgtgttgctaaatcattttctgaacagtgtgttctaaatcagtcattgatttagtgtcagccacgtggagcacctcggcttaaagcagctccacaaaacctgacacaacacacacaccaattaaatggattttgttgagaatttaatcattcaatttggtcaaccagaatgacttcctgtggaactctgttttatgacagataatagttttccaacttgattgagtctctgtataccctgggatattgtattttttaatgaagggcattttcaaacttgtcaacttctcttttcagcacttgaaatgaaggcttatggaattctgactgtgaaatgaatttttctattgggagattatgcatgccaagatttattatttattgttagataattattatttatttgttaatactgattattgattattgctctgctgcattggtttagccccgctatggagaagacactttagaagtaactcagaatcacatccccataaaatctaagtctttacttcatcaagttttactttttgaattgctataaagacggaaaaattgatccctgcaaacacttgaagaagctgtgttttttttctttcaattaattccaaccaagacattaacgtccactttaccaaagaaacttacttggttggtttttagttggtgtttgttgtttgtttaccaaagaaaatattcgattcatcaaaaatattgctcctggtcaactaaaaaactgtgatactgggacttttttggccattcataaggaaaatttttaaaagtcaaggtaagggtgatattctctcatttagtggaagaagaagatgtcaattcacagggaatgtggtgttcgcaagaaagaaaatgatacttgaaatagggcattattgtttagcctacagcaacatttcaacaagcagcatcagggctcctcaggttaaaagaagtacagtttgtttcagagaaaaaggaagacaaaccctcgtgaaatgtttctccattgttccagctcataagttttactttgttttgggttttggagtttttagtttctttgatgtttgttttgctttaatttggtttgtggtttgtgtttgcttgtgtttgcttctgcctttcctaccttctgccttttactccctcagttttcagtcagaagtgtgataatcagatgccatcctccatggccacgcttatgtatgcaatataccgctccaaatgaggaccttggtaacccttgaccctttaattctaactaaccatcacccaatcgtaagtggcattatgggaccatgataccacttttctccagtgtcaatgacagagctcagctgtgtccatcacaagaaaaggtggaatgggcagctgtcttgggggtgtggcaagaggcagaacctcttggacacaaatgttatcttcctcataatggctttattcttttggatcctattaaagtacccctgtagcttatagtagtgtttgacctctgtgactctgttttctcatctgtaaaatggggataatatcagtaaatgtctttaaattcagcaaatacttatcgagtgccaaatatcgcccagatactgttcgagaggctggggacacaacagtcaacaaatcagattttttaaaatctgctcttgtagagtctacctttgagtgacattgcaggtatattgtggggattgaatgagatgagagatgacatttggaaagcactcttggaaaggcctggcaaagaaaagagactcaagacattatttgtaattcagcaatctcgcacagtagcattagggctcgggatgtaaagctactgagaagtagatttgagcctgagaattagggctacaaatacaatgagttgccacagaaggtagttaattaccagtcattttaggacatcaaaatgaagctgatcaccacatagtggggccactgtaaaggggctgcaagtcctggatgttggcatcatactatgatctttgaaaaaaacagatacaggcacttgcttttggggatggggaagggacaccactgattactgaataactgtggctggcttgtctgagggaatgtaaacattcccttgaggtaatttgcttttaattttgtgtaaaaagcaccaggtatttagagacataaagttcccgttttttaaaagaatagtaaatctgcaatacaaagaaaaatattaagttagtggattcgctggcaaagaactaagaatggctgcagccaacacactgcagagttcctccctgtggtggttacaactgttatttctgtttcatgccagtccaggagaaagcaaagaggaaagtggatgagctataatccgttcacctgaataggcagtgccaggatgtcccccccagcttgcctctcacccgccccgctgctgcccagctgatttgtttgaagtcctctttgatatctatgagagcaccgtggaaggaagaagaagggaggcgaccggagagctatggcctctgtgcagatttttgagttagattaaaattagtaccacctgattaggagcctacctggtgaggaaaaaagccttcttttcaaagtacaaaaaaaagcgatgtgtaccaaggagaaaaccagcagagaaagcttggtggaagaagtgatgttcttgtggaatgtgccagcagcttctccttccagaatgctgacaccagatgaatctttggttagaattaagcctacccctttgtttttcacatgagaaaactgaaccctcgagtaatgaaattatattcacagagctaattagaaacaggagactataattgaaatctagtttttagcctcaattctttctccattttgccactttactgccaaattctattcatctaaattattggggtcttaacctgggggccaaatgagttcatgggaggggtctctgagtttcctacaattaagttacatgcaaaaatgtgtgtatatgttcaacatgtgcattttcctaaactgagggctcagattccaaaagaggtctatgaccgaaaaagggtgaagaaccactgtcctaaattaatacagacctcattgggagtgtgatcctggtgtcctcattttggctaatgagcaatcaagaacttttgaactatcttttctctaaggatccaaaaatgcttcaaaatattggtttcttcatcccaagccaagtgcctacttctattcatttattcttcattcattctttcattcattcatttctttattctgcaaatgtattttcagtgccaattcatgttctagcagcagctaaatatgccctccacagcaggaccaggaaaggagccctctgtactgtgctcttgttggcaagaggaacaccaggttgctaccacattctcactgttgcaacaaattatatatagcctcaaattttcagtaaccatcccacacacacatacacacataaaggcagcagccaacaaagccaacatatagaagtgtgccctgtcaaagaaccaggaagagcagcctatttccaggttatatacagtgatatgctgtttacaactgcataccacatccttagaaggcctgctcccaaatgagccctactctgagatgtctacaccaggcatgctttcacacacgtgcagtaccctactctcaaaacaagtatggagagaataagtctcattcatctcgttaatatttttagtgggcaaagaagcaaccgtggccatggacagatgggtgcatttaaggacaggtgtggccgggcacagtggctcaagcctgtaatcccagcactttgggaggcggaggcgggcagatcacgaggttaagagattgagaccatcctggccagcatggtgaaaccccgcctctactaaaaaatacaaaaaaattagctgggcgtggtggcacgtgcctgtagtcccagctactcaggaggcaggagaatcccttgaacccgggaggtagaagttgcagtgagccgagatttcaccactgccctccagactggcaacagagtgagacttcgtctcaaaaaaataaaggacaagtgtgttttatacacaaatatgcagaagcccagttctcttgactccaagtcagaagctagataaaatagaggttgctgggggaagttggaaaataaatgactatactgtacttgttggctctgctgctgctgatataacttcaggcacaacggaagccgcctcggttggcctatgggaagggctgggtgaatcactgcttggccttgcatgaagcacaaaggacacaccaatggctgatcagtggcccttccatcatcttctgcccagccatgataaggaaagccttctattgagatggaggaatattagctcaactttgtagcatctgatgtaaagtttgaggggtttgtcttttttgtttgtttgtttgtttttttttgagatggagtctcactctgtcacccaggctggagtgcagtggcgccatctcagctcactgcaagctccacctcccaggttcacgacattctcctgcctcagcctcctgagtagctgggactacaggtgcccgccaccgcgcccggctaattgtgtgtgtgtgtgtgtgtgtgtgtgtgtgtgtgtttagtagagatggggtttcaccgtgttacccatgatagtctcgatctcctaacctcgtgatccacccgcctcggcctcccaaagtgctgggattacaggcgtgagccaccgtgcccggcaagggctttgttcattaggatcaacaaagtgctttgtctaattcctgcaaaatggcaaagacccagcccatttccattactcattccaggctcatgctcaggaaaactaataacgttctctttgacaaaacaatttccttaattttctaggatgaatcttgaacatgtttagctcagcctttcagatatttattctttaaattaccatcctgtcaaaattgcctttacgcactgatccagaatcaccaaggcagttgccacgatgcctcccaggactgtgggtgactgggcaaactggtaatgacccgttggctctgcttcacacacacacatacacattgacacacataaatgtacacatgcatatatgtgtgtacaacacaactataaaacatagaaacatatacctgtacatatgcacatgcttacatacacacatatcacagatgtgcatgcacacatacacatgcacaccaccttttacaatatgcctgacacatttgaggcacattaaaatgccttggcaggcccagccctatagttctgtaaggtttggcaggccaaaggcttcggatgtctgcaggataccattgaaaaaatgttatcttccccttctatatgtttcttatgcacgagcacagctaagagcagccaaatagtaagctttaaagaaaagaaacctggaaaagtgaatgtgccttgcaatttaaaaattgctaacagtttcacagtgggaaaattgcatttgttggaattttccaagtcataagcaagaagaatagcatagacccaaaacgacagagatctcttccaaggtatggaattgtggaaatttatttagaatatttgcttggtgatccagagaagggggaaagaagtggtgaggaagaatatatggggtgatccctccaaattgccaactcctcgtcttaggaagaagtgggcagtttccattgatccctagcatcagtttgacgggaaaaccggtgcatttcatcaacctcaaggaaaggaagtgccatgcatggaggcctggtgataggcaacatccatttagaagaacagtcacacaagcaacagaagaactatccaagactagaagcttagaagcttataccaaactctctgtctctctctctctctctcacacacacacacacagagtggatgggaggggacattaagaggaaccctagtgcagttcccccaaaaaaccttggcatagagtataacagggaaaaagtaattactgggaagctgaaaacaatcaaatatgtgaggaatgactgaatatgagctgaggataatgtaaattgttctggattgtctataagataaagatacagagcctgaatctatgtttttctgaataaagagaccccatattctcttttgaattattgacctataattcctcttcagcagctttgaatacactcaagttctcttcctattgtttatgatcccataatacaaccacccactatttgttgtggtttacaatccagcttagaacccttgagcaaaattattgaattattgaatgctaggcccaaacaaaagaaatttcagcttggttttagtaatttcttgatcaaacttctctcattcctctaaatgtacaaaggtttcaaagttgtaaaaaatatgtctacatagccaatgctcttagtatttttaacagcaaagataatctctgccaataattattaatgacaaaatagtgataactgttcaatgttgctttaacagtccaattgtagtaggtgagaaaacaaaaaagaagagaagctatgttgaatatttagtaatgttggaaaagatcctcaccctagacataaaatagtttaaacatttaaacatggcccctctcttattgtcattgctagtgaaagaagttcctgaaattgcatattacattgtaaagttttgggctaaatcacaatacatttttaagttgcttccatggcaatagatcgtaagaccacagcttgtcaaagtaaccactaattcagtattcagaaaccttatcatctgttcctccaaaaagaccccatagttaatgttgtgtttcccagtattttagttgggtttcttcacacttaggcaagtgggtgattctggtcataataaactattttcaaactaggaaaaagtatccaaatgctagagcacataatgagttcagcttggtcagttttgagacagataagcataaaaccctactagaaaaaaataatagtcaaacctaaagctttaaaaaatgtgagtcacatcacttttctccaggaaaggcagaacgtgctcagggtggaatttaatcaaaaatgtacccagaacaatttcccacaaagagctgtaatactttgcagcaaggggcattaataaactctaatttttaccgaaagtcaagagacacacagatcttttttggtaccctctacatcatcatagcaaggcccttctgaacattaacaagcctagatgtttctactgcttatttgcagtatctacaggggaatggttcgtggatataaacagaaatgttttatctgaagaggctgtgtatgccaccccagacccctgcatttcttaatatctataaaaatatgactaaacttgttacatttgaggcaaatatgtacagtatttttcccttttaaagatagtttaaaaaatcaaggtaataaaaaacggccaactctttcaggaaaaaaaaaatccggtattttgtactacttgagtttctctaatgcctaaaatatgcatttaaatcatcccacacctacacagaaacaaaatcagcagggaaaaccatcccactgatgattggcaattccaccgttcctctccatctgaccagctttcaccagagggcgatctttcatgcttgcacatcgagtttatacaatgtagaagcccccaagtcacctgggaaatggctcatgccaaatacatggagtccttagttgactatcttttcatattaaaatcccatcttccaatgaagcatcctgttttcaatactgatatcaaatttcgaatgtaaaggagatttcaaatgtattgctttcaccttttcttttttattcatttatttttaattgacataaaaattgtatatatttatgggatacaatgtgatgttttgatatatgtatgcattgtggaatgattaaatcaagctaattaaca

SEQ ID NO: 21724 - DNA, 5215 bp, Homo sapiens
gcggctccgagaagcttccccctgcgacttccgcgaggagacgagtctgcgcagcgtggtggccgccgccccccgaccctctgcgcactctctcccgcgccggcggctcagcctagccccgttcggccggccgagactatggacacggaggatgaccccttgctgcaggatgtgtggctagaggaggagcaggaggaggaagaagcaacgggtgaaacctttttaggggcccagaagccagggccccaacctggggcagggggacagtgttgctggcggcactggcccctggcttcccgacccccagcttcgggcttctggagtaccctgggctgggccttcaccaatccgtgctgtgctgggctggtgctcttcctgggctgcagcatccccatggccctgtcagccttcatgttcctttactacccaccgctggacattgacatctcctacaacgcctttgagatccgcaaccacgaggcctcacagcgtttcgacgctctcactctggcgcttaagtcccagtttggatcctgggggcggaaccggcgcgatttggccgacttcacctccgagacgcttcagcgccttatctcagagcagctgcagcagctgcatctcggcaaccgctcgcggcaagcctcccgagccccccgcgtcatccccgcggcctcactcggtggcccaggcccttaccgggacacttccgcggctcaaaagcccacagccaatcggagcgggcgacttcggcgtgagaccccgcccctggaggatctggcagccaaccagagtgaagacccgcgaaaccagcggctgagcaagaatgggcggtaccagcccagcatcccgccccacgcggcagtcgcggccaatcagagccgtgcccgccgaggcgcctcgcgctgggactactcgcgcgcctatgtgagtgccaacactcagacgcacgcgcactggcgcatcgagctcatcttcctggcgcgcggcgacgcggagcgcaacattttcaccagtgagcgcctggtcacgatccatgagatcgagcgcaagatcatggaccacccaggcttccgggagttctgctggaagccccacgaggtgctcaaggatctgccgctgggctcctactcctactgctcgccccccagctcgctcatgacctacttttttcccaccgagaggggcggcaagatctactatgacggcatgggccaggacctggcggacatccggggctccctggagctggccatgactcaccctgagttctactggtatgtggatgagggcctctctgcagacaatctgaagagctccctcctgcgcagtgagatcctgtttggagcacccctgcccaactactactcagtagatgaccgctgggaggaacaacgggctaagtttcagagcttcgtggtcacctacgtggccatgctggccaagcagtctaccagcaaagtccaggttctctatggggggacagacctgtttgactatgaagtgcgcaggacgttcaacaatgacatgctcctggccttcatcagcagcagctgcattgctgccctggtctacatcctcacctcctgctcagtgttcctgtccttctttgggattgccagcattggtctcagctgcctggtggccctcttcctgtaccacgtggtctttggtatccagtacttgggcatcctgaatggggtggccgccttcgtgatcgtgggcattggtgtggacgatgtctttgtgttcatcaacacctaccgccaggccacccacctggaagacccacagctgcgcatgatccacaccgtccaaactgcaggcaaggccaccttcttcacctccctgaccacagccgccgcctacgcagctaacgtcttctcccagatcccagccgtccacgactttggcctgttcatgtctctcatcgtgtcctgttgctggctggccgtgcttgtcaccatgcctgcagctctgggcctctggagcctctacctggcaccactggagagctcctgccagaccagctgccaccagaattgcagccggaagacctccctgcacttccccggagacgtgtttgccgctcccgagcaggttggaggcagccctgcccagggccccataccctacctggatgatgacatccccttgctggaggtcgaggaagagccagtgtcactggagctgggagacgtgtccctggtgtctgtgtcccccgagggtctgcagccagcctccaacacgggcagccgcggccatctcatcgtgcagctgcaggagctgctgcaccactgggtcctgtggtcagccgtcaagagccgctgggtgattgtggggctgttcgtctccatcctcatcttgtccctggtgttcgccagccggctccgccccgccagccgggccccgctactcttccggcctgataccaacatccaggtgctgctggacctcaagtacaacctgagcgccgagggcatctcctgcatcacctgttcaggtctgttccaggagaagccccacagcctgcagaacaacatccggacgtccctggagaagaagaggcgaggctcaggggtcccctgggctagccggcctgaggccaccctgcaggatttcccaggcaccgtgtacatctctaaagtgaagagtcaaggccaccccgctgtctacaggctctccctcaatgccagcctgcctgctccttggcaggctgtgtcgcctggggatggagaggtgccctccttccaggtgtatagagcgccttttggtaacttcaccaagaagctgaccgcttgtatgtctacagtagggctgctccaggcggcgagcccctcccgcaagtggatgctgacgaccttggcctgtgatgccaagcggggctggaagtttgacttcagcttctacgtggccaccaaggagcagcagcacacccggaagctgtacttcgcccagtcccacaagccccccttccacgggcgcgtatgcatggcaccccctggctgcctgcttagctccagccccgatgggcctaccaaaggcttcttcttcgtgcctagtgagaaagtgcccaaggcccgtctctcagccaccttcggcttcaacccctgcgtgaacacgggctgcgggaagccggcggtgcggccactagtggataccggggccatggtctttgtggtcttcggcattattggcgtcaaccgcactcggcaggtggacaaccacgtcattggagacccgggtagtgttgtctacgacagcagctttgacctcttcaaggaaattgggcacctgtgtcacctctgcaaggccatcgcagccaactccgagctggtgaagccgggtggggcccagtgcctgccttcaggctacagcatctcctccttcctgcagatgttgcaccctgagtgcaaggagctgcccgagcccaacctgctcccggggcagctgtcccacggggcagtgggcgtcagggagggccgcgtgcagtggatctccatggctttcgagtcgaccacgtacaagggcaaatcctccttccagacctactcggactacctgcgctgggagagcttcctccagcagcagctgcaggccttgcccgagggctcagtcctgcgccggggcttccagacctgcgagcactggaagcagatattcatggaaatcgtaggggtgcagagcgccctgtgcggcctggtgctatccctgctcatctgcgtggccgcggtggccgtgttcaccacccacatcctgctcctgctgcccgtgctcctcagcatcttgggcatcgtgtgcctggtggtgaccatcatgtactggagcggctgggagatgggggctgtggaagccatctccctgtccatcctcgttggctcctccgtggattactgcgtccacctggtcgagggctacctgctggctggagagaacctgcccccccaccaggccgaggacgcccgaacgcagcgccagtggcgtacgctggaggccgtgcggcacgtgggcgtggccatcgtctccagtgccctcaccacggtcatcgccacagtgcccctcttcttctgcatcatcgccccatttgccaagttcggcaagattgtggcactcaacacgggcgtgtccatcctctacacgctgaccgtcagcaccgccctgctgggcatcatggcgcccagctctttcactcggacccggacttccttcctcaaggccctgggtgccgtgctgctggcaggggccctggggctgggtgcctgcctcgtgctcctgcagagcggctataagattcccctgcccgcaggggcctccctatagcccgggacgggctctggacacttgcacctttggtcccatgggtgggggacaggagctgcttcccagctcgacttcagctagctgtgtccccaggcctgggcccagggcgccctgcgggccagcgtggaggctgacacccacacagatggtgtggaccatgctgccttgtggagctgggagttggagacagccgccaccccacaggccgggctactggcagccacactcggctttttgcccagtggcagaagagaccagccctcctcccatgcccggtcaccatgggggtcaggttatttttgtagggggtctccctctcacactgcctcagtgctcacaaccttccagtgtggatgttacagggtggcccccattctaccgatgtgaaaactgaggcgccaggacacagtggctgccctgtcgctggatcagtagcagagccagagctgcctccgagcgccatgccgccctcgggaatcatacaggaagagcacagtggatccagggtgggggcctctcaccccctaaccccgcccccccgcaaccctccccttcagctttacggcggccagtgctgaatggccctgtggccctccctgggccttttggtcttggccagagaagacagaaggacccggcttgggcttctgcatgtcctacccctgaccccagcctcaaggggcccctcaaaggccctctctgggggctctggggctcagcacagctttcctcatggatctaagcccctgtctttcccacctgactctgagtggatgttttgggggatggcccctgtggggaggagctgccatgccggccgcctgctcacggcagaaggttgctattaaaatgacataggattgcagactgctgctgttaatacgagcattttaagcac

SEQ ID NO: 21725 - DNA, 5213 bp, Homo sapiens
gcggctccgagaagcttccccctgcgacttccgcgaggagacgagtctgcgcagcgtggtggccgccgccccccgaccctctgcgcactctctcccgcgccggcggctcagcctagccccgttcggccggccgagactatggacacggaggatgaccccttgctgcaggatgtgtggctagaggaggagcaggaggaggaagaagcaacgggtgaaacctttttaggggcccagaagccagggccccaacctggggcagggggacagtgttgctggcggcactggcccctggcttcccgacccccagcttcgggcttctggagtaccctgggctgggccttcaccaatccgtgctgtgctgggctggtgctcttcctgggctgcagcatccccatggccctgtcagccttcatgttcctttactacccaccgctggacattgacatctcctacaacgcctttgagatccgcaaccacgaggcctcacagcgtttcgacgctctcactctggcgcttaagtcccagtttggatcctgggggcggaaccggcgcgatttggccgacttcacctccgagacgcttcagcgccttatctcagagcagctgcagcagctgcatctcggcaaccgctcgcggcaagcctcccgagccccccgcgtcatccccgcggcctcactcggtggcccaggcccttaccgggacacttccgcggctcaaaagcccacagccaatcggagcgggcgacttcggcgtgagaccccgcccctggaggatctggcagccaaccagagtgaagacccgcgaaaccagcggctgagcaagaatgggcggtaccagcccagcatcccgccccacgcggcagtcgcggccaatcagagccgtgcccgccgaggcgcctcgcgctgggactactcgcgcgcctatgtgagtgccaacactcagacgcacgcgcactggcgcatcgagctcatcttcctggcgcgcggcgacgcggagcgcaacattttcaccagtgagcgcctggtcacgatccatgagatcgagcgcaagatcatggaccacccaggcttccgggagttctgctggaagccccacgaggtgctcaaggatctgccgctgggctcctactcctactgctcgccccccagctcgctcatgacctacttttttcccaccgagaggggcggcaagatctactatgacggcatgggccaggacctggcggacatccggggctccctggagctggccatgactcaccctgagttctactggtatgtggatgagggcctctctgcagacaatctgaagagctccctcctgcgcagtgagatcctgtttggagcacccctgcccaactactactcagtagatgaccgctgggaggaacaacgggctaagtttcagagcttcgtggtcacctacgtggccatgctggccaagcagtctaccagcaaagtccaggttctctatggggggacagacctgtttgactatgaagtgcgcaggacgttcaacaatgacatgctcctggccttcatcagcagcagctgcattgctgccctggtctacatcctcacctcctgctcagtgttcctgtccttctttgggattgccagcattggtctcagctgcctggtggccctcttcctgtaccacgtggtctttggtatccagtacttgggcatcctgaatggggtggccgccttcgtgatcgtgggcattggtgtggacgatgtctttgtgttcatcaacacctaccgccaggccacccacctggaagacccacagctgcgcatgatccacaccgtccaaactgcaggcaaggccaccttcttcacctccctgaccacagccgccgcctacgcagctaacgtcttctcccagatcccagccgtccacgactttggcctgttcatgtctctcatcgtgtcctgttgctggctggccgtgcttgtcaccatgcctgcagctctgggcctctggagcctctacctggcaccactggagagctcctgccagaccagctgccaccagaattgcagccggaagacctccctgcacttccccggagacgtgtttgccgctcccgagcaggttggaggcagccctgcccagggccccataccctacctggatgatgacatccccttgctggaggtcgaggaagagccagtgtcactggagctgggagacgtgtccctggtgtctgtgtcccccgagggtctgcagccagcctccaacacgggcagccgcggccatctcatcgtgcagctgcaggagctgctgcaccactgggtcctgtggtcagccgtcaagagccgctgggtgattgtggggctgttcgtctccatcctcatcttgtccctggtgttcgccagccggctccgccccgccagccgggccccgctactcttccggcctgataccaacatccaggtgctgctggacctcaagtacaacctgagcgccgagggcatctcctgcatcacctgttcaggtctgttccaggagaagccccacagcctgcagaacaacatccggacgtccctggagaagaagaggcgaggctcaggggtcccctgggctagccggcctgaggccaccctgcaggatttcccaggcaccgtgtacatctctaaagtgaagagtcaaggccaccccgctgtctacaggctctccctcaatgccagcctgcctgctccttggcaggctgtgtcgcctggggatggagaggtgccctccttccaggtgtatagagcgccttttggtaacttcaccaagaagctgaccgcttgtatgtctacagtagggctgctccaggcggcgagcccctcccgcaagtggatgctgacgaccttggcctgtgatgccaagcggggctggaagtttgacttcagcttctacgtggccaccaaggagcagcagcacacccggaagctgtacttcgcccagtcccacaagccccccttccacgggcgcgtatgcatggcaccccctggctgcctgcttagctccagccccgatgggcctaccaaaggcttcttcttcgtgcctagtgagaaagtgcccaaggcccgtctctcagccaccttcggcttcaacccctgcgtgaacacgggctgcgggaagccggcggtgcggccactagtggataccggggccatggtctttgtggtcttcggcattattggcgtcaaccgcactcggcaggtggacaaccacgtcattggagacccgggtagtgttgtctacgacagcagctttgacctcttcaaggaaattgggcacctgtgtcacctctgcaaggccatcgcagccaactccgagctggtgaagccgggtggggcccagtgcctgccttcaggctacagcatctcctccttcctgcagatgttgcaccctgagtgcaaggagctgcccgagcccaacctgctcccggggcagctgtcccacggggcagtgggcgtcagggagggccgcgtgcagtggatctccatggctttcgagtcgaccacgtacaagggcaaatcctccttccagacctactcggactacctgcgctgggagagcttcctccagcagcagctgcaggccttgcccgagggctcagtcctgcgccggggcttccagacctgcgagcactggaagcagatattcatggaaatcgccggggtgcagagcgccctgtgcggcctggtgctatccctgctcatctgcgtggccgcggtggccgtgttcaccacccacatcctgctcctgctgcccgtgctcctcagcatcttgggcatcgtgtgcctggtggtgaccatcatgtactggagcggctgggagatgggggctgtggaagccatctccctgtccatcctcgttggctcctccgtggattactgcgtccacctggtcgagggctacctgctggctggagagaacctgcccccccaccaggccgaggacgcccgaacgcagcgccagtggcgtacgctggaggccgtgcggcacgtgggcgtggccatcgtctccagtgccctcaccacggtcatcgccacagtgcccctcttcttctgcatcatcgccccatttgccaagttcggcaagattgtggcactcaacacgggcgtgtccatcctctacacgctgaccgtcagcaccgccctgctgggcatcatggcgcccagctctttcactcggacccggacttccttcctcaaggccctgggtgccgtgctgctggcaggggccctggggctgggtgcctgcctcgtgctcctgcagagcggctataagattcccctgcccgcaggggcctccctatagcccgggacgggctctggacacttgcacctttggtcccatgggtgggggacaggagctgcttcccagctcgacttcagctagctgtgtccccaggcctgggcccagggcgccctgcgggccagcgtggaggctgacacccacacagatggtgtggaccatgctgccttgtggagctgggagttggagacagccgccaccccacaggccgggctactggcagccacactcggctttttgcccagtggcagaagagaccagccctcctcccatgcccggtcaccatgggggtcaggttatttttgtagggggtctccctctcacactgcctcagtgctcacaaccttccagtgtggatgttacagggtggcccccattctaccgatgtgaaaactgaggcgccaggacacagtggctgccctgtcgctggatcagtagcagagccagagctgcctccgagcgccatgccgccctcgggaatcatacaggaagagcacagtggatccagggtgggggcctctcaccccctaaccccgcccccccgcaaccctccccttcagctttacggcggccagtgctgaatggccctgtggccctccctgggccttttggtcttggccagagaagacagaaggacccggcttgggcttctgcatgtcctacccctgaccccagcctcaaggggcccctcaaaggccctctctgggggctctggggctcagcacagctttcctcatggatctaagcccctgtctttcccacctgactctgagtggatgttttgggggatggcccctgtggggaggagctgccatgccggccgcctgctcacggcagaaggttgctattaaaatgacataggattgcagactgctgctgttaatacgagcattttaagc

SEQ ID NO: 21726 - DNA, 2529 bp, Homo sapiens
aggaaaccgttgggtggggccaggagagcgttgggtggggccaggaaaccgtctggtgggatctccgcagctgcttttcacctgctgttcctcctgcgcttcctaagaggaagaatcaatgccgtgggtggagcccaagcccaggccggggccggagcagaagcccaagctcaccaaaccggactctgccaccgggccgcagtggtaccaggaatctcaggaatcggagtcggaaggcaagcagccacccccgggacccctggcacccccgaaatcccccgaaccctcaggacccctggcgtcggagcaggatgcacccctgccagagggggacgatgcacccccccggccgtcgatgctggacgatgcaccccgcctgccgctggagctggacgatgcacccctgccggaggaggaaacccccgaacccacggccatctgcaggcaccggcaccgctgtcacaccgactgcctagaggggctgctgtcccgcaccttccagtggctggggtggcaggtgggcgcgcacccctggatcttcctgctggcgcccttgatgctgacagccgcgctgggcaccggcttcctgtacctacccaaggacgaagaggaagacctagaggagcattacacccctgtggggagcccggccaaggcggagcggcgcttcgtgcagggccatttcaccaccaacgactcctaccgcttctccgcctccaggaggagcaccgaagccaatttcgtctcgcttctggtggtctcctacagcgactcactgctggacccagctacctttgcagaagtcagcaaactggacggcgcggtgcaggatctgcgcgtggcgcgggaaaagggaagccagatccagtaccagcaggtgtgcgcgaggtacagggcgctctgcgtgccccccaacccgatcctgtacgcctggcaggtgaacaaaacgctcaacctgagcagcatctccttccccgcctacaaccacggcaggcatcccctctacctgaccggcttcttcggaggatacatcttggggggcagcctaggaatgggccagttactcctgcgggccaaagccatgcggctgctgtactacctgaagaccgaggaccctgagtacgacgtgcagagcaagcagtggctcacccatttgctcgatcaatttaccaacattaagaacatcttggccttgaaaaaaattgaggtagtccactttacatcgctttccagacaactggaatttgaggcaacttctgtgactgtgatccctgtgtttcacctggcatacattctcatcattctgtttgcagtcacatcatgctttaggtttgactgcatacgaaacaaaatgtgtgttgcggcctttggagtgatttctgctttcttggcagtggtgagcggctttggcctgctgttgcacattggggtgccatttgtcatcatagttgccaattcaccatttcttattctaggtgttggggtcgatgacatgtttatcatgatttctgcctggcataagaccaaccttgcagatgacatacgagagcggatgtccaatgtctattcaaaagcggcagtgtctattacaatcaccaccatcactaacatcctggccttatatacagggattatgagctcttttaggtctgtacaatgtttttgcatctatacaggaatgaccctgttattttgctatttttataacatcacgtgttttggagcatttatggccttggatggtaaaagagaagtagtctgcctatgctggttgaaaaaggctgacccaaaatggccctcatttaaaaagttctgctgtttcccatttggttctgtcccagatgaacatggaactgatatccatccaataagtttgttttttagagactattttggcccctttctcacaaggagtgagtccaagtattttgtagtctttatatatgttttgtacatcataagcagtatatatgggtgtttccatgtgcaggaaggtttagaccttcgaaatctggcaagtgacgattcctacatcacaccatattttaacgtagaggagaattatttttcagattatggtcccagggttatggttattgttactaaaaaagttgactactgggataaagatgttaggcaaaaactggaaaactgtactaaaatttttgaaaaaaatgtctatgtagataaaaatcttacagagttttggttagatgcatatgtgcaatatttaaaaggtaacagccaagatcctaatgagaagaatacttttatgaacaatattcctgattttttaagcaattttccaaattttcagcatgatattaatatttcttcatcaaatgaaatcatttcttcccggggcttcattcagacaacagatgtttcttcctcagccaaaaagaaaatattgttattctaattacgacgcatagctgaagactgtcaaattcccctaatggtgtataaccaggcatttatatattttgatcagtatgctgcaatattagaagacactgttagaaatgt

SEQ ID NO: 21727 - DNA, 6618 bp, Homo sapiens
ctcctcggtgcaacctatataaggctcacagtctgcgctcctggtacacgcgcttcaacttcggttggtgtgtgtcgaagaaacctgactgcgccctgaggagaacagcggagaaggtccaccgagcctggcgaaaggtccgctgagcgggctgtcgtccggagccactccgggctgcggagcacccagtggagaccgcgcctggctcaggtgtgggaccccatccttcctgtcttcgcagaggagtcctcgcgtgaaataagcgggttttgaaaacaaaaaaaagaaggagtggaagagggggccaggatccaggcctccatccccacagaagtgaagctacagctgggaggtctcctcccaccccaaccgtcaccctgggtcccgactgcccacctcctcctcctccccctccccccaacaacaacaacaacaacaactccaagcacaccggccataagagtgcgtgtgtccccaacatgaccgaacgaagaagggacgagctctctgaagagatcaacaacttaagagagaaggtcatgaagcagtcggaggagaacaacaacctgcagagccaggtgcagaagctcacagaggagaacaccacccttcgagagcaagtggaacccacccctgaggatgaggatgatgacatcgagctccgcggtgctgcagcagctgctgccccaccccctccaatagaggaagagtgcccagaagacctcccagagaagttcgatggcaacccagacatgctggctcctttcatggcccagtgccagatcttcatggaaaagagcaccagggatttctcagttgatcgtgtccgtgtctgcttcgtgacaagcatgatgaccggccgtgctgcccgttgggcctcagcaaagctggagcgctcccactacctgatgcacaactacccagctttcatgatggaaatgaagcatgtctttgaagaccctcagaggcgagaggttgccaaacgcaagatcagacgcctgcgccaaggcatggggtctgtcatcgactactccaatgctttccagatgattgcccaggacctggattggaacgagcctgcgctgattgaccagtaccacgagggcctcagcgaccacattcaggaggagctctcccacctcgaggtcgccaagtcgctgtctgctctgattgggcagtgcattcacattgagagaaggctggccagggctgctgcagctcgcaagccacgctcgccaccccgggcgctggtgttgcctcacattgcaagccaccaccaggtagatccaaccgagccggtgggaggtgcccgcatgcgcctgacgcaggaagaaaaagaaagacgcagaaagctgaacctgtgcctctactgtggaacaggaggtcactacgctgacaattgtcctgccaaggcctcaaagtcttcgccggcgggaaactccccggccccgctgtagagggaccttcagcgaccgggccagaaataataaggtccccacaagatgatgcctcatctccacacttgcaagtgatgctccagattcatcttccgggcagacacaccctgttcgtccgagccatgatcgattctggtgcttctggcaacttcattgatcacgaatatgttgctcaaaatggaattcctctaagaatcaaggactggccaatacttgtggaagcaattgatgggcgccccatagcatcgggcccagttgtccacgaaactcacgacctgatagttgacctgggagatcaccgagaggtgctgtcatttgatgtgactcagtctccattcttccctgtcgtcctaggggttcgctggctgagcacacatgatcccaatatcacatggagcactcgatctatcgtctttgattctgaatactgccgctaccactgccggatgtattctccaataccaccatcgctcccaccaccagcaccacaaccgccactctattatccagtagatggatacagagtttaccaaccagtgaggtattactatgtccagaatgtgtacactccagtagatgagcacgtctacccagatcaccgcctggttgaccctcacatagaaatgatacctggagcacacagtattcccagtggacatgtgtattcactgtccgaacctgaaatggcagctcttcgagattttgtggcaagaaatgtaaaagatgggctaattactccaacgattgcacctaatggagcccaagttctccaggtgaagagggggtggaaactgcaagtttcttatgattgccgagctccaaacaattttactatccagaatcagtatcctcgcctatctattccaaatttagaagaccaagcacacctggcaacgtacactgaattcgtacctcaaatacctggataccaaacataccccacatatgccgcgtacccgacctacccagtaggattcgcctggtacccagtgggacgagacggacaaggaagatcactatatgtacctgtgatgatcacttggaatccacactggtaccgccagcctccggtaccacagtacccgccgccacagccgccgcctccaccaccaccaccgccgccgcctccatcttacagtaccctgtaaatacctgtcatgtccttcaggatctctgccctcaaaatttattcctgttcagcttctcaatcagtgactgtgtgctaaattttaggctactgtatcttcaggccacctgaggcacatcctctctgaaacggctatggaaggttagggccactctggactggcacacatcctaaagcaccaaaagaccttcaacattttctgagagcaacagagtatttgccaataaatgatctctcatttttccaccttgactgccaatctaactaaaataattaataagtttactttccagccagtcctggaagtctgggttttacctgccaaaacctccatcaccatctaaattataggctgccaaatttgctgtttaacatttacagagaagctgatacaaacgcaggaaatgctgatttctttatggagggggagacgaggaggaggaggacatgacttttcttgcggtttcggtaccctctttttaaatcactggaggactgaggccttattaaggaagccaaaattatcggtgcagtgtggaaaggcttccgtgatcctctcgctgcacccttagaaacttcaccgtcttcaaactccatttccatggttctgttaattctcaaggagcagcaactcgactggttctcccaggagcaggaaaaacccttgtgacatgaaacatctcaggcctgaaaagaaagtgctctctcagatggactcttgcatgttaagactatgtcttcacatcatggtgcaaatcacatgtacccaatgactccggctttgacacaacaccttaccatcatcatgccatgatggcttccacaaagcattaaacctggtaaccagagattactggtggctccagcgttgttagatgttcatgaaatgtgaccacctctcaatcacctttgagggctaaagagtagcacatcaaaaggactccaaaatcccatacccaactcttaagagatttgtcctggtacttcagaaagaattttcatgagtgttcttaattggctggaaaagcaccagctgacgttttggaagaatctatccatgtgtctgcctccatatgcatctgggcatttcatcttcagtcccctcattagactgtagcattaggatgtgtggagagaggagaaatgatttagcacccagattcacactcctatgcctggaagggggacatctttgaagaagaggaattagggctgtggacactgtcttgaggatgtggacttccttagtgagctccacattacttgatggtaaccacttcaaaaggatcagaatccacgtaatgaaaaaggtccctctagaggatggagctgatgtgaagctgccaatggatgaaaagcctcagaaagcaactcaaaggactcaaagcaacggacaacacaagagttgtcttcagcccagtgacacctctgatgtcccctggaagctttgtgctaacctgggactgcctgacttcctttagcctggtcccttgctactaccttgaactgttttatctaacctctctttttctgtttaattctttgctactgccattgaccctgctgcaggatttgtgtcattttcctgcctggttgctgagactccattttgctgccacacacagagatgtaagaggcaggctttaattgccaaagcacagtttgagcagtagaaaacaacatggtgtatatctcaaattgcctgacatgaagaggagtctaacggtgaagtttcacttttcatcagcatcatctttcacatgttcattatcatctgctcttattcttgcatgtttaaacacttaaaatttttagtataatttttagtgtgttttgaagtggtgactaggctttcaaaaacttccattgaattacaaagcactatccagttcttattgttaaactaagtaaaaatgataagtaacatagtgtaaaatattcctttactgtgaacttcttacaatgctgtgaatgagaggctcctcagaactggagcatttgtataataattcatcctgttcatcttcaattttaacatcatatataatttcaattctatcaattgggcctttaaaaatcatataaaaggatataaaatttgaaaagagaaacctaattggctatttaatccaaaacaactttttttttccttcaatggaatcagaaagcttgtcaatcactcatgtgttttagagtaattacttttaaaatggtgcatttgtgcttctgaactattttgaagagtcacttctgtttacctcaagtatcaattcatcctccatacatttgaattcaagttgtttttttgtcaaatttacagttgtcaattgatcttcaagctgcagggtgcctagaaatgggccgttgtctgtagccctggcatgtgcacacggacatttgccaccactgcaagcaaaagtctggagaagttcaccaacgacaagaacgattagggaaaatatgctgctgtgggttaacaactcagaaagtccctgatccacatttggctgtttactaaagcttgtgattaactttttggcagtgtgtactatgctctattgctatatatgctatctataaatgtagatgttaaggataagtaattctaaatttattattctatagttttgaagtttggttaagtttcctttcactcaattgatttattttgttgttaatcaaatttatgttaattggatcctttaaattttttttggcattttccaacaaaaatggctttattcataagaaaggaaaaaaatcaatggaatttgatatctaaagaagttagaaagggagcaaaataaaaaacataaaggagatagatgaattagtaagcaaatcagtagtcgagtttttcaaactggcaaaattaattaattgacttttagcccaaatttacattgttaattaaatcaagaaggaagaagatctaagagctcccattgataggcaagcctagagagaactagctaaatttatcatgctaggatattgaaacacagaaagtttacatacatttatgaagggtcaatttagtttggacagtgaggtatttgtcttagtggaaaaaaggagaattagtctgatcaaatcgtgaagtaatacagtgaacttgcaggtgcacaaaataagagggccacatctatatggtgcagtctggaattctgtttaagtttgtaggtacctcttggacttctgaattgatccagttgtcatccaccacagacatctcacatcagatacagacagttccaagattgacaacagagaacaacctgctggaaagacctgggcagaaatggagagccctgcgggaaccatgctacattttcatctaaagagagaatgcacatctgatgagactgaaagttctttgttgttttagattgtagaatggtattgaattggtctgtggaaaattgcattgcttttatttctttgtgtaatcaagtttaagtaataggggatatataatcataagcattttagggtgggagggactattaagtaattttaagtgggtggggttatttagaatgttagaataatattatgtattagatatcgctataagtggacatgcgtacttacttgtaaccctttaccctataattgctatccttaaagatttcaaataaactcggagggaactgcagggagaccaacttatttagagcgaattggacatggataaaaaccccagtgggagaaagttcaaaggtgattagattaataatttaatagaggatgagtgacctctgataaattactgctagaatgaacttgtcaatgatggatggtaaattttcatggaagttataaaagtgataaataaaaacccttgcttttacccctgtcagtagccctcctcctaccactgaaccccattgcccctacccctccttctaactttattgctgtattctcttcactctatatttctctctatttgctaatattgcattgctgttacaataaaaattcaataaagatttagtggttaagtgcaaa

SEQ ID NO: 21728 - DNA, 2587 bp, Homo sapiens
acacgcgcttcaacttcggttggtgtgtgtcgaagaaacctgactgcgccctgaggagaacagcggagaaggtccaccgagcctggcgaaaggtccgctgagcgggctgtcgtccggagccactccgggctgcggagcacccagtggagaccgcgcctggctcaggtgtgggaccccatccttcctgtcttcgcagaggagtcctcgcgtggtgagtatgcgaaataagcgggttttgaaaacaaaaaaaagaaggagtggaagagggggccaggatccaggcctccatccccacagaagtgaagctacagctgggaggtctcctcccaccccaaccgtcaccctgggtcccgactgcccacctcctcctcctccccctccccccaacaacaacaacaacaacaactccaagcacaccggccataagagtgcgtgtgtccccaacatgaccgaacgaagaagggacgagctctctgaagagatcaacaacttaagagagaaggtcatgaagcagtcggaggagaacaacaacctgcagagccaggtgcagaagctcacagaggagaacaccacccttcgagagcaagtggaacccacccctgaggatgaggatgatgacatcgagctccgcggtgctgcagcagctgctgccccaccccctccaatagaggaagagtgcccagaagacctcccagagaagttcgatggcaacccagacatgctggctcctttcatggcccagtgccagatcttcatggaaaagagcaccagggatttctcagttgatcgtgtccgtgtctgcttcgtgacaagcatgatgaccggccgtgctgcccgttgggcctcagcaaagctggagcgctcccactacctgatgcacaactacccagctttcatgatggaaatgaagcatgtctttgaagaccctcagaggcgagaggttgccaaacgcaagatcagacgcctgcgccaaggcatggggtctgtcatcgactactccaatgctttccagatgattgcccaggacctggattggaacgagcctgcgctgattgaccagtaccacgagggcctcagcgaccacattcaggaggagctctcccacctcgaggtcgccaagtcgctgtctgctctgattgggcagtgcattcacattgagagaaggctggccagggctgctgcagctcgcaagccacgctcgccaccccgggcgctggtgttgcctcacattgcaagccaccaccaggtagatccaaccgagccggtgggaggtgcccgcatgcgcctgacgcaggaagaaaaagaaagacgcagaaagctgaacctgtgcctctactgtggaacaggaggtcactacgctgacaattgtcctgccaaggcctcaaagtcttcgccggcgggaaactccccggccccgctgtagagggaccttcagcgaccgggccagaaataataaggtccccacaagatgatgcctcatctccacacttgcaagtgatgctccagattcatcttccgggcagacacaccctgttcgtccgagccatgatcgattctggtgcttctggcaacttcattgatcacgaatatgttgctcaaaatggaattcctctaagaatcaaggactggccaatacttgtggaagcaattgatgggcgccccatagcatcgggcccagttgtccacgaaactcacgacctgatagttgacctgggagatcaccgagaggtgctgtcatttgatgtgactcagtctccattcttccctgtcgtcctaggggttcgctggctgagcacacatgatcccaatatcacatggagcactcgatctatcgtctttgattctgaatactgccgctaccactgccggatgtattctccaataccaccatcgctcccaccaccagcaccacaaccgccactctattatccagtagatggatacagagtttaccaaccagtgaggtattactatgtccagaatgtgtacactccagtagatgagcacgtctacccagatcaccgcctggttgaccctcacatagaaatgatacctggagcacacagtattcccagtggacatgtgtattcactgtccgaacctgaaatggcagctcttcgagattttgtggcaagaaatgtaaaagatgggctaattactccaacgattgcacctaatggagcccaagttctccaggtgaagagggggtggaaactgcaagtttcttatgattgccgagctccaaacaattttactatccagaatcagtatcctcgcctatctattccaaatttagaagaccaagcacacctggcaacgtacactgaattcgtacctcaaatacctggataccaaacataccccacatatgccgcgtacccgacctacccagtaggattcgcctggtacccagtgggacgagacggacaaggaagatcactatatgtacctgtgatgatcacttggaatccacactggtaccgccagcctccggtaccacagtacccgccgccacagccgccgcctccaccaccaccaccgccgccgcctccatcttacagtaccctgtaaatacctgtcatgtcct

SEQ ID NO: 21729 - DNA, 5483 bp, Homo sapiens
gaatattgatgcggcgcgcgtcggcgtcgccctcctcccattgagcgaggctgtgtcgcgtggcccagcgtcggcgtgacggttggacgcgggcgcggcactgcgggtcccgattgctgcagccgcttgtcagtgtgatgaagattggcacccagacaccattcgcttttcacccaagatgatttgatgtcttataaaactctgatgaaccatgatggctacacagacattaagtatagacagctatcaagatgggcaacagatgcaagtagtaacagagttaaagacagaacaagatccaaactgctctgaacccgatgcagaaggagtgagccctccccctgtggagtctcagaccccgatggatgtggacaagcaggccatttataggcatccactatttccattattagctttgttgtttgaaaaatgtgaacaatctacacagggctctgaaggcacaacttctgccagttttgatgtagacatcgaaaattttgtaagaaagcaagagaaggaagggaaacctttcttttgtgaagatccagaaactgataatttaatggtaaaagcaatccaggttttgcgcattcatcttcttgagctggaaaaggttaacgaactctgcaaagatttctgcagtcgatacattgcttgtctgaaaacaaaaatgaacagtgaaactctgttgagtggagagcctggaagcccgtactcaccagtgcagtcccagcagattcaaagtgccatcacaggcaccatcagccctcagggaattgtggtgccggcgtccgcgctgcagcagggaaacgtagccatggcgacggtggcaggtggcacagtgtatcagcctgtcacggtcgtcactccccaaggccaagtggtcacacagacattgtcgcctgggacaattaggatccagaactcccagcttcagttacagttaaaccaagatctcagcatcttgcatcaagatgatggttcatctaagaacaagaggggcgtcctgccaaagcatgccacgaacgtgatgcggtcctggctcttccagcacatcgggcatccctacccaacagaggatgagaaaaaacagattgctgctcagacaaatttgacactactccaagtcaacaactggttcatcaatgccagaagacgaattcttcagccaatgttggattcaagttgttcagagacccccaaaacaaagaaaaaaactgctcagaaccggccagttcagaggttttggcctgattctattgcatcaggagtcgcacagccaccgccgagcgagctcaccatgtcggaaggagctgttgtcaccatcaccacgcccgtgaacatgaacgtggacagccttcagtctctgtcctcggacggggccaccctggcggtgcagcaggtcatgatggcagggcagagcgaggacgagtctgtggacagcacagaggaggatgcgggtgccctggcccctgcccacatcagcgggctggtcttggagaacagtgactccctgcagtaggggcaggagcagacgcacctgactttttggagtttgcacagcaaacattttacacagttttatttctaatatgttttatatgtagatatagaagagtgcacttttgtatttcatagtaagcttaaagcgcgtctttgccggtgcagcgacttctttcaagtgtgtgtgtgtgtgtgtgtgtgtgtgtgtgtgcgtgtgtgcgtgtgtgtggatttttaaagaaattctttaaaggtttaacgctagattgtgaggaatgacacaccactccctccccaccttgaatccctaattagattaaggaatagcgctgccattttctaaaccgtgatgcggttgtcacttagttctgtggttccagcagatctcagtgggctggttgatttgtgtggcccatggatttgaaagaagctgctgcacccgaaactgccagtgtgcggtgacaacggcacacgcctagactgagtgtggtttcgtcgtgagtggatggacggcaagcttagcaagcctaagtcccctcatgttcagtgagcctgtttcatttgctatatagaaaaagaaactcctatttttaccttgctggaattattggataaaaaagctatttttataaattcgttatgaattggatgatgactatattgaggataaaatttctagagaagaaacaatacatgcttgctattaatatttcaatttggaatgttctgaattgaccaaatttaatgaacctgcccaaagttagctaccgttccatggttctttgctctccccgggtagtgatgaacatttactactataaaagaaacagctatttaatgaaattttgatatctgcaaatttttgttgatatgtaatgctcagattgcattttacacttgatctaaacatatatcgaaagatatctgctaaacaggacttcaggtaagtgaggtgaaatggtagccagtgacccgttaggagctctcaccgtacatactccagtctaatttaaatctgaccacagttgcatggtcgctttaccatgttagctgtgtattgttttaaaagttttaacttcaaaatatgttatgcacagaatgtttattataaactaatataaaatgtgctctaccccattggctcagagctagggcaaacagcagatattcagactttattacttaactagcggacatccctggagtcccagcagcgagctggtctggcgagggcacctcggcagcccccacgggttggctcctacgtttgcgtttgtggctggtctcctggtgtcagtgttctcttgtacgttgttgctttcgacttttcagagccctcctgctcacttgaccacgtgagatttggaataactgtaggacttctgtttcctggtaacaagatgaaccgagagagtgggctgggttctgttttctttggttttgatttgttttcattgtttacttaggagtggtgctttttctcagaaaacaggccacggtgtttcatacagaatgtcttcatatcatctgaaatggtatggctgaagttcatttgtttacagggtcgggaatgtcttcagttcttgagagtcaacagtaatgattggttgtaagccaagggacattttaagctagtgaagagttttttctggaattgatttttcccaaaagaatatattaattgaggttaagaagtcagtgggaaacacacagaaatttgttttaaaatctttcaggagctttactgaaagacttggttatcaagtcttttggggagagaatgacattttttttttgagacagagttttgctcttgttgcccaggctggagggcaatggtgcaatctcagctcactgcaacctccacctcttatgttcaagcaattctccttccttagcctcctgagtagctgggattacaggcatgcgccaccacacccggctaattttgtatttttagtagagatgggtttctccatgttggtcgggctggtctcgaactcccgacctcaggtgatctgcctgcctcagcctcccaaagtgctgggattacaggtgtgagccaccgcgcccggccgagaatgacatcttaaagccaccattgcgttcctcatttgtgaactgtcttctcatattttaagtcaagtctataagatcatttttaacctaagttccaactttgttggactccttaaaataagcacccatgaaagccagccagcccttcctccttccctcaccaccctccgtctcttcggctgcttgctctttagtgtagattagtggaagccattcacagaatgtagactcatgtataggtcaccgtttctttcccccactagaaatcacattcactaagcagtggattgaatttaagagtgctgcccctgcccggcgcagtagggcgtgcctctagttccagctactcgggagtctgaggcagaggatggcatgtgccaggagtttgaggctgcagtgcactatgcttgcacctgtgaatagccactgcactccatcttgggcaacacagtgagacccccatctataaaaagagagcactgcctgaacctcggtggcactgggaagctctggcctgagagttaaacacccatgctgaatgatacagtgtgcattctctccagctgcaaactttcttcaactttcctaaattcttactaaattcagaggaataggataaagatcacttagagaaagggtgcttatggacatagcctgagtttcctttaacctctctgcaatgggtgcttttaactagcttctacatggcaagctgtttcagtttgcaaaatcactgcccagcatgtttgaggtcagttggcaccttaaaacacctgttctccagcccttggacagtggagagaatctgtaaaagtgtgaccccctctaagatttcgttttaaatgatcagattcggttccagttttattcttgttgagtttttccctatgaaggctccttttgaatgtgtcttgagacccaaattgagcatgttgctgttattcctgccctgcacctgtggagcaggagtggcagggctggctgtgctgggttccagctcgctcccaccgagggactagcttggcctttgcgctttgattccagatagtaagatgagtggaagtgtttatcgagcatgcaaaagaaaccctcacggctaagggctctgggagttgtgtctgtgtgacctgagagtgatccatctcctgcctgtgtgaggtagcagtgggcacttttcattgagacaaactccagggtgtccagagggggttctgccccttgtgaaggcccattcctggcacttagagacagaaagaactcagcaatctttcgttctagttatattcggtctttgaaactgacaatctttgaaatgtgaatactgtaacaatatgttttcttggattgttgtctttaaaaaggatttttgtgaagcaattgatttatcaaagcaaaaaaattaaaaatagaaacttgctttatggatgttttattttataaagctcatgtcaccaaaagctgcttctccattttatgtaaaacattgagaatgttttcatgttttctggtgacatgtagggtctgtagtcacccctgcatattgagaaactaggaccacactgcatcggactagtcaggtccatttacatgtccaagaatcttttcttaaattccttactttgttcattcattggctgttcaggcagaaaatggaaacaggtagcttttatgttttttattatagttttccacaaatctaattattttgatagttacaagaagataatgattcatcagtaagctaacataatccctttcatagttcatattataaattttcatgacaagaaagttcctgaagatttaaaaggtacattaaaacaatttcagagggtttttaatctttgttgtccagagtgttataactcccaacaactgttcatgcttagaggctaaagtca

SEQ ID NO: 21730 - DNA, 1449 bp, Homo sapiens
agtgtgatgaagattggcacccagacaccattcgcttttcacccaagatgatttgatgtcttataaaactctgatgaaccatgatggctacacagacattaagtatagacagctatcaagatgggcaacagatgcaagtagtaacagagttaaagacagaacaagatccaaactgctctgaacccgatgcagaaggagtgagccctccccctgtggagtctcagaccccgatggatgtggacaagcaggccatttatagatggtaaaagcaatccaggttttgcgcattcatcttcttgagctggaaaaggttaacgaactctgcaaagatttctgcagtcgatacattgcttgtctgaaaacaaaaatgaacagtgaaactctgttgagtggagagcctggaagcccgtactcaccagtgcagtcccagcagattcaaagtgccatcacaggcaccatcagccctcagggaattgtggtgccggcgtccgcgctgcagcagggaaacgtagccatggcgacggtggcaggtggcacagtgtatcagcctgtcacggtcgtcactccccaaggccaagtggtcacacagacattgtcgcctgggacaattaggatccagaactcccagcttcagttacagttaaaccaagatctcagcatcttgcatcaagatgatggttcatctaagaacaagaggggcgtcctgccaaagcatgccacgaacgtgatgcggtcctggctcttccagcacatcgggcatccctacccaacagaggatgagaaaaaacagattgctgctcagacaaatttgacactactccaagtcaacaactggttcatcaatgccagaagacgaattcttcagccaatgttggattcaagttgttcagagacccccaaaacaaagaaaaaaactgctcagaaccggccagttcagaggttttggcctgattctattgcatcaggagtcgcacagccaccgccgagcgagctcaccatgtcggaaggagctgttgtcaccatcaccacgcccgtgaacatgaacgtggacagccttcagtctctgtcctcggacggggccaccctggcggtgcagcaggtcatgatggcagggcagagcgaggacgagtctgtggacagcacagaggaggatgcgggtgccctggcccctgcccacatcagcgggctggtcttggagaacagtgactccctgcagtaggggcaggagcagacgcacctgactttttggagtttgcacagcaaacattttacacagttttatttctaatatgttttatatgtagatatagaagagtgcacttttgtatttcatagtaagcttaaagcgcgtctttgccggtgcagcgacttctttcaagtgtgtgtgtgtgtgtgtgtgtgtgtgtgtgtgcgtgtgtgcgtgtgtgtggatttttaaagaaattcttt

SEQ ID NO: 21731 - DNA, 2788 bp, Homo sapiens
gcgtcgccctcctcccattgagcgaggctgtgtcgcgtggcccagcgtcggcgtgacggttggacgcgggcgcggcactgcgggtcccgattgctgcagccgcttgtcagtgtgatgaagattggcacccagacaccattcgcttttcacccaagatgatttgatgtcttataaaactctgatgaaccatgatggctacacagacattaagtatagacagctatcaagatgggcaacagatgcaagtagtaacagagttaaagacagaacaagatccaaactgctctgaacccgatgcagaaggagtgagccctccccctgtggagtctcagaccccgatggatgtggacaagcaggccatttataggcatccactatttccattattagctttgttgtttgaaaaatgtgaacaatctacacagggctctgaaggcacaacttctgccagttttgatgtagacatcgaaaattttgtaagaaagcaagagaaggaagggaaacctttcttttgtgaagatccagaaactgataatttaatggtaaaagcaatccaggttttgcgcattcatcttcttgagctggaaaaggttaacgaactctgcaaagatttctgcagtcgatacattgcttgtctgaaaacaaaaatgaacagtgaaactctgttgagtggagagcctggaagcccgtactcaccagtgcagtcccagcagattcaaagtgccatcacaggcaccatcagccctcagggaattgtggtgccggcgtccgcgctgcagcagggaaacgtagccatggcgacggtggcaggtggcacagtgtatcagcctgtcacggtcgtcactccccaaggccaagtggtcacacagacattgtcgcctgggacaattaggatccagaactcccagcttcagttacagttaaaccaagatctcagcatcttgcatcaagatgatggttcatctaagaacaagaggggcgtcctgccaaagcatgccacgaacgtgatgcggtcctggctcttccagcacatcgggcatccctacccaacagaggatgagaaaaaacagattgctgctcagacaaatttgacactactccaagtcaacaactggttcatcaatgccagaagacgaattcttcagccaatgttggattcaagttgttcagagacccccaaaacaaagaaaaaaactgctcagaaccggccagttcagaggttttggcctgattctattgcatcaggagtcgcacagccaccgccgagcgagctcaccatgtcggaaggtacaggtggccggccaaggccagacatggtggaccatggggtggggattatgaacaagaggcctggatcaggcctgttagctccaccgcgcccggccgagaatgacatcttaaagccaccattgcgttcctcatttgtgaactgtcttctcatattttaagtcaagtctataagatcatttttaacctaagttccaactttgttggactccttaaaataagcacccatgaaagccagccagcccttcctccttccctcaccaccctccgtctcttcggctgcttgctctttagtgtagattagtggaagccattcacagaatgtagactcatgtataggtcaccgtttctttcccccactagaaatcacattcactaagcagtggattgaatttaagagtgctgcccctgcccggcgcagtagggcgtgcctctagttccagctactcgggagtctgaggcagaggatggcatgtgccaggagtttgaggctgcagtgcactatgcttgcacctgtgaatagccactgcactccatcttgggcaacacagtgagacccccatctataaaaagagagcactgcctgaacctcggtggcactgggaagctctggcctgagagttaaacacccatgctgaatgatacagtgtgcattctctccagctgcaaactttcttcaactttcctaaattcttactaaattcagaggaataggataaagatcacttagagaaagggtgcttatggacatagcctgagtttcctttaacctctctgcaatgggtgcttttaactagcttctacatggcaagctgtttcagtttgcaaaatcactgcccagcatgtttgaggtcagttggcaccttaaaacacctgttctccagcccttggacagtggagagaatctgtaaaagtgtgaccccctctaagatttcgttttaaatgatcagattcggttccagttttattcttgttgagtttttccctatgaaggctccttttgaatgtgtcttgagacccaaattgagcatgttgctgttattcctgccctgcacctgtggagcaggagtggcagggctggctgtgctgggttccagctcgctcccaccgagggactagcttggcctttgcgctttgattccagatagtaagatgagtggaagtgtttatcgagcatgcaaaagaaaccctcacggctaagggctctgggagttgtgtctgtgtgacctgagagtgatccatctcctgcctgtgtgaggtagcagtgggcacttttcattgagacaaactccagggtgtccagagggggttctgccccttgtgaaggcccattcctggcacttagagacagaaagaactcagcaatctttcgttctagttatattcggtctttgaaactgacaatctttgaaatgtgaatactgtaacaatatgttttcttggattgttgtctttaaaaaggatttttgtgaagcaattgatttatcaaagcaaaaaaatt

SEQ ID NO: 21732 - DNA, 3653 bp, Homo sapiens
gtcccgagcagtgctgggaagtataggctgtgttgtcacgccggtgtcagtctgatgaagattggcatcaggtgaagtctggagcaggacttctgaggctttctatcctccatgctgctcactagaaaaggggctgtgaactgtgctttggctctagcagacaggaagaaattctggcccagctggaagtagaaagaggggagtgagtctcctgaggaccatctcagaggccccgggatcacccgaacagtcctccatgtgaatcaatcccatgatgcaacatgcctccccagcccccgctctgacgatgatggccacgcagaatgtcccgcccccaccctaccaggacagcccacagatgacggcaaccgcccagccaccctccaaggcccaggctgtccacatctctgccccctcagctgctgccagcacacctgtgcccagtgcccccatcgacccccaggcccagctggaggctgacaagcgagctgtatacaggcaccctcttttcccgctcctgacgctgctgtttgagaaatgtgaacaggccacccagggctctgagtgcatcacctccgccagctttgatgtggacatcgagaactttgtccaccagcaggaacaggagcacaaacccttcttcagcgatgacccagaactggacaatctgatggtgaaggcaatccaggtcctgagaatccacctgctggagctggagaaagtcaatgaactctgcaaggacttttgtaaccgttacatcacctgcctcaaaaccaagatgcacagcgacaacctgctcaggaatgatctaggggggccctactcccccaaccagccctccatcaaccttcactcacaggacctcctgcagaattcccccaattccatgtccggagtctccaataacccccaggggattgtggtcccagcctcagcgctccagcagggcaacatcgccatgacaaccgtcaactcacaagttgtgtcaggtggagccttataccaaccggttaccatggtaacctcccagggtcaggtggtcacccaagcaatcccccagggagccatccagatccagaacacacaggttaaccttgacctcacctccctcctggacaatgaggataagaagtccaagaacaaacgaggagtcttgcccaagcatgccaccaatataatgcgttcttggctcttccagcatctcatgcacccctaccccacggaggatgagaagaggcagatcgcagcccagaccaacctcaccctcctgcaagtaaacaactggttcatcaatgcccggaggcgcatcctgcagcccatgcttgatgccagcaacccagatcctgcccccaaagccaagaagatcaagtctcagcaccggcccacccaaagattctggcccaactccatcgctgcgggggtgctgcagcagcagggcggtgccccagggacaaaccccgatggttccatcaacttggacaacctgcagtccctgtcctcagacagtgccaccatggccatgcagcaggctatgatggctgcacacgatgactcattggatgggacagaagaagaggatgaggatgagatggaagaggaggaggaggaggagctggaggaggaggtcgacgagctgcagacgacaaatgtcagcgacctgggcttggaacacagtgactccctggagtagtcgggcagcccagatggcactgatcactgagcaggagaggagtgtcgccgggaggccttcagggtgggggggaaggggacatgggcaggaagcaccgagggagttgggccctagcttccccaaatcagtagcttgaagaaaggcaaaggagacacctgttccttcccaaccaccgagcttcaatgaggaccccagccccacttccctggaactgccgaggactctgtttggcggggccagtcgagcagcctgtgtggaaagacaggagtgagatctggactcaccaaatccctgaggatagatggcacccatggcccccacccacggaaggacttgagttgtttacaagccctgcactgaggcagattggtgctgttcgcagagtaggcctttgcccgggggcagacttagaaggaaggggagagacaaagggggactgagtttcatccccagaagtttctcagctcctttgacagacattcaagggcaggagggagccccaaagcataaccagtggccagaggagtgggagggcctgaggcatcacatcttgcagatcagaatgggatggaatccaccaggctccagctcatccctccaaggccctgtctctgcgcacagcaaccatggacatgggagaaagggatgggagccacagtgcccttcactctctcctggaaaccaactgtaagctggtgggctcaacctgtgggaggttaagaggagtcccttctgggttgactccaagagccaaggagatggcagaccctgggctaggaaccatatggaggtgactttgaggccacagctgtccctaggtgatcacagaacttagctcctttaacaacaggacaatggttttttaccctagatgttcccaccttcagtgctccacgccctccatagaccttcagagaaggtgaaaccaggttatctgggaatctttccagcccgcaggtcgccacggccatccctttgctcccagcctggctccatcagcctccagcttcctttcttcattctgtccttcagggaaggcagaagaaacattggaaagcatctagtccagtgggaagccaggggttggagaaggtgctacatccctcttcccatcaatatcctaaatgtgggggagggcccagagaatggcacccaagagcctgcggggatgcccatcccacacaccccacccagctgttctaaccctgctatccacagccctggaggaactggggctcctggaaggaggaggaggctctccactgtccaccctaacacataccctcccacccaccttccagacccccttggttggcaccctctcctccggttccctctcaccccatggctgtgaatgacaggacaggtcacacgtgtgttttccattgggtttaatttaatggacgtgcagtttcatttgtaaattgtgcattggccacctccttcagtggcaggatgtgagtggctacctggctcaactggaggggaccccttgggccctctggggcttcccctcccccacctggttggggtagagcaaaaggatggtcactcttccgaggtctccctgaaatgaatgtatttctcccccaaaagagctgatatttaatgttttaataaggatttttgagaaacaaataaccttatttataatctgggtgatccaatcattttttactcccttttgatgccatacatagaggaaagtctagcttttttggcgtgagacttttgcaatgtgcagtgggataaaatgcatttccttttctggttcgtttttcttgttaacacgcgcacacagacacacacacacaccgttccactcaccacctggacaggcgtcccccagcacggacacactggcacacaggtgcccacatctcttcctctcagcccctccacctgcctaatgttatgcaacctccttctgatgtatccaccaaaccagtactgaatgtggccg

SEQ ID NO: 21733 - DNA, 545 bp, Homo sapiens
gtgttgtcacgccggtgtcagtctgatgaagattggcatcaggtgaagtctggagcaggacttctgaggctttctatcctccatgctgctcactagaaaaggggctgtgaactattgcatctacagacagtcagagtgcccgcaagaaatcaggcaatgagcgtaaaaacaacagactcgatccaccccgctcgaccagatcttgatgggaacctatgctcgaagggtgctttggctctagcagacaggaagaaattctggcccagctggaagtagaaagaggggagtgagtctcctgaggaccatctcagaggccccgggatcacccgaacatatgccatgataagggctggatctgttatggtgagattgggccccaactccaaaggaccttgcccaggattttgtcctccatgtgaatcaatcccatgatgcaacatgcctccccagcccccgctctgacgatgatggccacgcagaatgtcccgcccccaccctaccaggacagcccacagatgacggcaaccgcccagccaccctccaag

SEQ ID NO: 21734 - DNA, 1709 bp, Homo sapiens
gggtccctgtgccgctgacgtcccgagcagtgctgggaagtataggctgtgttgtcacgccggtgtcagtctgatgaagattggcatcaggtgaagtctggagcaggacttctgaggctttctatcctccatgctgctcactagaaaaggggctgtgaactgtgctttggctctagcagacaggaagaaattctggcccagctggaagtagaaagaggggagtgagtctcctgaggaccatctcagaggccccgggatcacccgaacaatgacggcaaccgcccagccaccctccaaggcccaggctgtccacatctctgccccctcagctgctgccagcacacctgtgcccagtgcccccatcgacccccaggcccagctggaggctgacaagcgagctgtatacaggcaccctcttttcccgctcctgacgctgctgtttgagaaatgtgaacaggccacccagggctctgagtgcatcacctccgccagctttgatgtggacatcgagaactttgtccaccagcaggaacaggagcacaaacccttcttcagcgatgacccagaactggacaatctgatggtgaaggcaatccaggtcctgagaatccacctgctggagctggagaaagtcaatgaactctgcaaggacttttgtaaccgttacatcacctgcctcaaaaccaagatgcacagcgacaacctgctcaggaatgatctaggggggccctactcccccaaccagccctccatcaaccttcactcacaggacctcctgcagaattcccccaattccatgtccggagtctccaataacccccaggggattgtggtcccagcctcagcgctccagcagggcaacatcgccatgacaaccgtcaactcacaagttgtgtcaggtggagccttataccaaccggttaccatggtaacctcccagggtcaggtggtcacccaagcaatcccccagggagccatccagatccagaacacacaggttaaccttgacctcacctccctcctggacaatgaggataagaagtccaagaacaaacgaggagtcttgcccaagcatgccaccaatataatgcgttcttggctcttccagcatctcatgcacccctaccccacggaggatgagaagaggcagatcgcagcccagaccaacctcaccctcctgcaagtaaacaactggttcatcaatgcccggaggcgcatcctgcagcccatgcttgatgccagcaacccagatcctgcccccaaagccaagaagatcaagtctcagcaccggcccacccaaagattctggcccaactccatcgctgcgggggtgctgcagcagcagggcggtgccccagggacaaaccccgatggttccatcaacttggacaacctgcagtccctgtcctcagacagtgccaccatggccatgcagcaggctatgatggctgcacacgatgactcattggatgggacagaagaagaggatgaggatgagatggaagaggaggaggaggaggagctggaggaggaggtcgacgagctgcagacgacaaatgtcagcgacctgggcttggaacacagtgactccctggagtagtcgggcagcccagatggcactgatcactgagcaggagaggagtgtcgccgggaggccttcagggtgggggggaaggggacatgggcaggaagcaccgagggagttgggc

SEQ ID NO: 21735 - DNA, 1673 bp, Homo sapiens
gtgccgctgacgtcccgagcagtgctgggaagtataggctgtgttgtcacgccggtgtcagtctgatgaagattggcatcaggtgctttggctctagcagacaggaagaaattctggcccagctggaagtagaaagaggggagtgagtctcctgaggaccatctcagaggccccgggatcacccgaacaatgacggcaaccgcccagccaccctccaaggcccaggctgtccacatctctgccccctcagctgctgccagcacacctgtgcccagtgcccccatcgacccccaggcccagctggaggctgacaagcgagctgtatacaggcaccctcttttcccgctcctgacgctgctgtttgagaaatgtgaacaggccacccagggctctgagtgcatcacctccgccagctttgatgtggacatcgagaactttgtccaccagcaggaacaggagcacaaacccttcttcagcgatgacccagaactggacaatctgatggtgaaggcaatccaggtcctgagaatccacctgctggagctggagaaagtcaatgaactctgcaaggacttttgtaaccgttacatcacctgcctcaaaaccaagatgcacagcgacaacctgctcaggaatgatctaggggggccctactcccccaaccagccctccatcaaccttcactcacaggacctcctgcagaattcccccaattccatgtccggagtctccaataacccccaggggattgtggtcccagcctcagcgctccagcagggcaacatcgccatgacaaccgtcaactcacaagttgtgtcaggtggagccttataccaaccggttaccatggtaacctcccagggtcaggtggtcacccaagcaatcccccagggagccatccagatccagaacacacaggttaaccttgacctcacctccctcctggacaatgaggataagaagtccaagaacaaacgaggagtcttgcccaagcatgccaccaatataatgcgttcttggctcttccagcatctcatgcacccctaccccacggaggatgagaagaggcagatcgcagcccagaccaacctcaccctcctgcaagtaaacaactggttcatcaatgcccggaggcgcatcctgcagcccatgcttgatgccagcaacccagatcctgcccccaaagccaagaagatcaagtctcagcaccggcccacccaaagattctggcccaactccatcgctgcgggggtgctgcagcagcagggcggtgccccagggacaaaccccgatggttccatcaacttggacaacctgcagtccctgtcctcagacagtgccaccatggccatgcagcaggctatgatggctgcacacgatgactcattggatgggacagaagaagaggatgaggatgagatggaagaggaggaggaggaggagctggaggaggaggtcgacgagctgcagacgacaaatgtcagcgacctgggcttggaacacagtgactccctggagtagtcgggcagcccagatggcactgatcactgagcaggagaggagtgtcgccgggaggccttcagggtgggggggaaggggacatgggcaggaagcaccgagggagttgggccctagcttccccaaatcagtagcttgaagaaaggcaaaggaga

SEQ ID NO: 21736 - DNA, 521 bp, Homo sapiens
attgccaaatgagcgacactaacaagagtgatgctctcagaggaaggacagactgagtggactgcaaggataggggagacttctggaagaggtggatggtgtggcagacccttgacactcattccccttcagcaggcttggaatgtggggatgactatccccattttcacatatggcaaaggcccaagccacacagctggtgaagtctggagcaggacttctgaggctttctatcctccatgctgctcactagaaaaggggctgtgaactgtgctttggctctagcagacaggaagaaattctggcccagctggaagtagaaagaggggagtgagtctcctgaggaccatctcagaggccccgggatcacccgaacagtcctccatgtgaatcaatcccatgatgcaacatgcctccccagcccccgctctgacgatgatggccacgcagaatgtcccgcccccaccctaccaggacagcccacagatgacggcaaccgcccagccaccctccaaggccca

SEQ ID NO: 21737 - DNA, 3175 bp, Homo sapiens
acatgcctccccagcccccgctctgacgatgatggccacgcagaatgtcccgcccccaccctaccaggacagcccacagatgacggcaaccgcccagccaccctccaaggcccaggctgtccacatctctgccccctcagctgctgccagcacacctgtgcccagtgcccccatcgacccccaggcccagctggaggctgacaagcgagctgtatacaggcaccctcttttcccgctcctgacgctgctgtttgagaaatgtgaacaggccacccagggctctgagtgcatcacctccgccagctttgatgtggacatcgagaactttgtccaccagcaggaacaggagcacaaacccttcttcagcgatgacccagaactggacaatctgatggtgaaggcaatccaggtcctgagaatccacctgctggagctggagaaagtcaatgaactctgcaaggacttttgtaaccgttacatcacctgcctcaaaaccaagatgcacagcgacaacctgctcaggaatgatctaggggggccctactcccccaaccagccctccatcaaccttcactcacaggacctcctgcagaattcccccaattccatgtccggagtctccaataacccccaggggattgtggtcccagcctcagcgctccagcagggcaacatcgccatgacaaccgtcaactcacaagttgtgtcaggtggagccttataccaaccggttaccatggtaacctcccagggtcaggtggtcacccaagcaatcccccagggagccatccagatccagaacacacaggttaaccttgacctcacctccctcctggacaatgaggataagaagtccaagaacaaacgaggagtcttgcccaagcatgccaccaatataatgcgttcttggctcttccagcatcatgcacccctaccccacggaggatgagaagaggcagatcgcagcccagaccaacctcaccctcctgcaagtaaacaactggttcatcaatgcccggaggcgcatcctgcagcccatgcttgatgccagcaacccagatcctgcccccaaagccaagaagatcaagtctcagcaccggcccacccaaagattctggcccaactccatcgctgcgggggtgctgcagcagcagggcggtgccccagggacaaaccccgatggttccatcaacttggacaacctgcagtccctgtcctcagacagtgccaccatggccatgcagcaggctatgatggctgcacacgatgactcattggatgggacagaagaagaggatgaggatgagatggaagaggaggaggaggaggagctggaggaggaggtcgacgagctgcagacgacaaatgtcagcgacctgggcttggaacacagtgactccctggagtagtcgggcagcccagatggcactgatcactgagcaggagaggagtgtcgccgggaggccttcagggtgggggggaaggggacatgggcaggaagcaccgagggagttgggccctagcttccccaaatcagtagcttgaagaaaggcaaaggagacacctgttccttcccaaccaccgagcttcaatgaggaccccagccccacttccctggaactgccgaggactctgtttggcggggccagtcgagcagcctgtgtggaaagacaggagtgagatctggactcaccaaatccctgaggatagatggcacccatggcccccacccacggaaggacttgagttgtttacaagccctgcactgaggcagattggtgctgttcgcagagtaggcctttgcccgggggcagacttagaaggaaggggagagacaaagggggactgagtttcatccccagaagtttctcagctcctttgacagacattcaagggcaggagggagccccaaagcataaccagtggccagaggagtgggagggcctgaggcatcacatcttgcagatcagaatgggatggaatccaccaggctccagctcatccctccaaggccctgtctctgcgcacagcaaccatggacatgggagaaagggatgggagccacagtgcccttcactctctcctggaaaccaactgtaagctggtgggctcaacctgtgggaggttaagaggagtcccttctgggttgactccaagagccaaggagatggcagaccctgggctaggaaccatatggaggtgactttgaggccacagctgtccctaggtgatcacagaacttagctcctttaacaacaggacaatggttttttaccctagatgttcccaccttcagtgctccacgccctccatagaccttcagagaaggtgaaaccaggttatctgggaatctttccagcccgcaggtcgccacggccatccctttgctcccagcctggctccatcagcctccagcttcctttcttcattctgtccttcagggaaggcagaagaaacattggaaagcatctagtccagtgggaagccaggggttggagaaggtgctacatccctcttcccatcaatatcctaaatgtgggggagggcccagagaatggcacccaagagcctgcggggatgcccatcccacacaccccacccagctgttctaaccctgctatccacagccctggaggaactggggctcctggaaggaggaggaggctctccactgtccaccctaacacataccctcccacccaccttccagacccccttggttggcaccctctcctccggttccctctcaccccatggctgtgaatgacaggacaggtcacacgtgtgttttccattgggtttaatttaatggacgtgcagtttcatttgtaaattgtgcattggccacctccttcagtggcaggatgtgagtggctacctggctcaactggaggggaccccttgggccctctggggcttcccctcccccacctggttggggtagagcaaaaggatggtcactcttccgaggtctccctgaaatgaatgtatttctcccccaaaagagctgatatttaatgttttaataaggatttttgagaaacaaataaccttatttataatctgggtgatccaatcattttttactcccttttgatgccatacatagaggaaagtctagcttttttggcgtgagacttttgcaatgtgcagtgggataaaatgcatttccttt

SEQ ID NO: 21738 - DNA, 1870 bp, Homo sapiens
agtctgatgaagattggcatcaggtgaagtctggagcaggacttctgaggctttctatcctccatgctgctcactagaaaaggggctgtgaactgtgctttggctctagcagacaggaagaaattctggcccagctggaagtagaaagaggggagtgagtctcctgaggaccatctcagaggccccgggatcacccgaacagtcctccatgtgaatcaatcccatgatgcaacatgcctccccagcccccgctctgacgatgatggccacgcagaatgtcccgcccccaccctaccaggacagcccacaggcaccctcttttcccgctcctgacgctgctgtttgagaaatgtgaacaggccacccagggctctgagtgcatcacctccgccagctttgatgtggacatcgagaactttgtccaccagcaggaacaggagcacaaacccttcttcagcgatgacccagaactggacaatctgatggtgaaggcaatccaggtcctgagaatccacctgctggagctggagaaagtcaatgaactctgcaaggacttttgtaaccgttacatcacctgcctcaaaaccaagatgcacagcgacaacctgctcaggaatgatctaggggggccctactcccccaaccagccctccatcaaccttcactcacaggacctcctgcagaattcccccaattccatgtccggagtctccaataacccccaggggattgtggtcccagcctcagcgctccagcagggcaacatcgccatgacaaccgtcaactcacaagttgtgtcaggtggagccttataccaaccggttaccatggtaacctcccagggtcaggtggtcacccaagcaatcccccagggagccatccagatccagaacacacaggttaaccttgacctcacctccctcctggacaatgaggataagaagtccaagaacaaacgaggagtcttgcccaagcatgccaccaatataatgcgttcttggctcttccagcatctcatgcacccctaccccacggaggatgagaagaggcagatcgcagcccagaccaacctcaccctcctgcaagtaaacaactggttcatcaatgcccggaggcgcatcctgcagcccatgcttgatgccagcaacccagatcctgcccccaaagccaagaagatcaagtctcagcaccggcccacccaaagattctggcccaactccatcgctgcgggggtgctgcagcagcagggcggtgccccagggacaaaccccgatggttccatcaacttggacaacctgcagtccctgtcctcagacagtgccaccatggccatgcagcaggctatgatggctgcacacgatgactcattggatgggacagaagaagaggatgaggatgagatggaagaggaggaggaggaggagctggaggaggaggtcgacgagctgcagacgacaaatgtcagcgacctgggcttggaacacagtgactccctggagtagtcgggcagcccagatggcactgatcactgagcaggagaggagtgtcgccgggaggccttcagggtgggggggaaggggacatgggcaggaagcaccgagggagttgggccctagcttccccaaatcagtagcttgaagaaaggcaaaggagacacctgttccttcccaaccaccgagcttcaatgaggaccccagccccacttccctggaactgccgaggactctgtttggcggggccagtcgagcagcctgtgtggaaagacaggagtgagatctggactcaccaaatccctgaggatagatggcacccatggcccccacccacggaaggacttgagttgtttacaagccctgcactgaggcagatt

SEQ ID NO: 21739 - DNA, 554 bp, Homo sapiens
tatctcccaggtttgctgctggggtggccgcagaaccgggagtcggtcacagagttcacagacgaggtcacatggaggagaagcctggtgccaggaacaagctaggagtaactggaccacgatgacgcctgtgctttggctctagcagacaggaagaaattctggcccagctggaagtagaaagaggggagtgagtctcctgaggaccatctcagaggccccgggatcacccgaacagtcctccatgtgaatcaatcccatgatgcaacatgcctccccagcccccgctctgacgatgatggccacgcagaatgtcccgcccccaccctaccaggacagcccacagatgacggcaaccgcccagccaccctccaaggcccaggctgtccacatctctgccccctcagctgctgccagcacacctgtgcccagtgcccccatcgacccccaggcccagctggaggctgacaagcgagctgtatacaggcaccctcttttcccgctcctgacgctgctgtttgagaaatgtgaacaggccacccagggctctgagt

SEQ ID NO: 21740 - DNA, 604 bp, Homo sapiens
aaggcactttagcaggaatctggcggcagagaggccgattgatgagatgccgaggtctgcagccccaactggaggcgccccggaagagtgagatggagtggggagggggtggaccgggcaggggaggaggcaaagagtctgtttccctggcccaaggaggccgagtggagccggcccagagatgaacgcatctgggagctgccaaggtgctttggctctagcagacaggaagaaattctggcccagctggaagtagaaagaggggagtgagtctcctgaggaccatctcagaggccccgggatcacccgaacagtcctccatgtgaatcaatcccatgatgcaacatgcctccccagcccccgctctgacgatgatggccacgcagaatgtcccgcccccaccctaccaggacagcccacagatgacggcaaccgcccagccaccctccaaggcccaggctgtccacatctctgccccctcagctgctgccagcacacctgtgcccagtgcccccatcgacccccaggcccagctggaggctgacaagcgagctgtatacagatggtgaaggcaatccaggtcctgagaatccacctgctggag

SEQ ID NO: 21741 - DNA, 1966 bp, Homo sapiens
gccgagcgggagccgcgcgggagcagcgcagctacggcggcggcagcggcggcgcggttgcgattccgagccgttgagacgcctctgcggcagctggtggcgcaggtggcttgcgtggacgcgggtagaggcgaccggccagcaaccgcagcgtcggcgcccgcggccccggcaggcgcgtcgggacgccccgaggcatcctcccccgcccgcgggcccggtagctgggcccgcgtccgccgcccgcatccccgcgccgccgcatctcctcgccgcctcccgggcttcggacccccggtctcgcccccgaaacatgactcgcgatttcaaacctggagacctcatcttcgccaagatgaaaggttatccccattggccagctcgagtagacgaagttcctgatggagctgtaaagccacccacaaacaaactacccattttcttttttggaactcatgagactgcttttttaggaccaaaggatatatttccttactcagaaaataaggaaaagtatggcaaaccaaataaaagaaaaggttttaatgaaggtttatgggagatagataacaatccaaaagtgaaattttcaagtcaacaggcagcaactaaacaatcaaatgcatcatctgatgttgaagttgaagaaaaggaaactagtgtttcaaaggaagataccgaccatgaagaaaaagccagcaatgaggatgtgactaaagcagttgacataactactccaaaagctgccagaagggggagaaagagaaaggcagaaaaacaagtagaaactgaggaggcaggagtagtgacaacagcaacagcatctgttaatctaaaagtgagtcctaaaagaggacgacctgcagctacagaagtcaagattccaaaaccaagaggcagacccaaaatggtaaaacagccctgtccttcagagagtgacatcattactgaagaggacaaaagtaagaaaaaggggcaagaggaaaaacaacctaaaaagcagcctaagaaggatgaagagggccagaaggaagaagataagccaagaaaagagccggataaaaaagaggggaagaaagaagttgaatcaaaaaggaaaaatttagctaaaacaggggttacttcaacctccgattctgaagaagaaggagatgatcaagaaggtgaaaagaagagaaaaggtgggaggaactttcagactgctcacagaaggaatatgctgaaaggccaacatgagaaagaagcagcagatcgaaaacgcaagcaagaggaacaaatggaaactgagcattttgctctgtaaagcatttcagatgcagcttgtgtgaaatgcattatgcaaaataaagtttattgtattgtattcccagccaaacaacatgtaatctacagtaataaaaaatatatctcattttgggctcaaagcattaatccagttactgaaaagagaatacaagtggagcaaacaagagatgaagatcttgatacagactcattggactgaatttcccccttccccccattgatggaagaatgttccagattctaaattgaggacttcattattaatggcattactgtgttatgattaacaaatttcctgtaaggtacacactacatactaaggtcggccatcattcctgttttttttttttttttttttttttaaccaagcttaaaatgaagctttgtgtttgaaagtaataacaagctcagacgaagatggtggttgtacattattcatctagaaaatataaaaattcattttgttttgaagctagttattaaactggaatagcagttatatccctgagaatggggcccttctcttgacattcctttgttgtttaattctttagaatcttaataaatgtttttttaatcctgagagattaaacagtagtagacttgttaagaatgaaactgtaaccaaaattttaaaataaagttttttttaaaaaaaaaa

SEQ ID NO: 21742 - DNA, 1889 bp, Homo sapiens
ggcgccgagcgggagccgcgcgggagcagcgcagctacggcggcggcagcggcggcgcggttgcgattccgagccgttgagacgcctctgcggcagctggtggcgcaggtggcttgcgtggacgcgggtagaggcgaccggccagcaaccgcagcgtcggcgcccgcggccccggcaggcgcgtcgggacgccccgaggcatcctcccccgcccgcgggcccggtagctgggcccgcgtccgccgcccgcatccccgcgccgccgcatctcctcgccgcctcccgggcttcggacccccggtctcgcccccgaaacatgactcgcgatttcaaacctggagacctcatcttcgccaagatgaaaggttatccccattggccagctcgagtagacgaagttcctgatggagctgtaaagccacccacaaacaaactacccattttcttttttggaactcatgagactgcttttttaggaccaaaggatatatttccttactcagaaaataaggaaaagtatggcaaaccaaataaaagaaaaggttttaatgaaggtttatgggagatagataacaatccaaaagtgaaattttcaagtcaacaggcagcaactaaacaatcaaatgcatcatctgatgttgaagttgaagaaaaggaaactagtgtttcaaaggaagataccgaccatgaagaaaaagccagcaatgaggatgtgactaaagcagttgacataactactccaaaagctgccagaagggggagaaagagaaaggcagaaaaacaagtagaaactgaggaggcaggagtagtgacaacagcaacagcatctgttaatctaaaagtgagtcctaaaagaggacgacctgcagctacagaagtcaagattccaaaaccaagaggcagacccaaaatggtaaaacagccctgtccttcagagagtgacatcattactgaagaggacaaaagtaagaaaaaggggcaagaggaaaaacaacctaaaaagcagcctaagaaggatgaagagggccagaaggaagaagataagccaagaaaagagccggataaaaaagaggggaagaaagaagttgaatcaaaaaggaaaaatttagctaaaacaggggttacttcaacctccgattctgaagaagaaggagatgatcaagaaggtgaaaagaagagaaaaggtgggaggaactttcagactgctcacagaaggaatatgctgaaaggccaacatgagaaagaagcagcagatcgaaaacgcaagcaagaggaacaaatggaaactgagcaccaaacaacatgtaatctacagtaataaaaaatatatctcattttgggctcaaagcattaatccagttactgaaaagagaatacaagtggagcaaacaagagatgaagatcttgatacagactcattggactgaatttcccccttccccccattgatggaagaatgttccagattctaaattgaggacttcattattaatggcattactgtgttatgattaacaaatttcctgtaaggtacacactacatactaaggtcggccatcattcctgttttttttttttttttttttttttaaccaagcttaaaatgaagctttgtgtttgaaagtaataacaagctcagacgaagatggtggttgtacattattcatctagaaaatataaaaattcattttgttttgaagctagttattaaactggaatagcagttatatccctgagaatggggcccttctcttgacattcctttgttgtttaattctttagaatcttaataaatgtttttttaatcctgagagattaaacagtagtagacttgttaagaatgaaactgtaaccaaaattttaaaataaagttttttttaaaaaaaaaa

SEQ ID NO: 21743 - DNA, 3391 bp, Homo sapiens
agttggtcgcgccccagtgctagcgggcgccgagcgggagccgcgcgggagcagcgcagctacggcggcggcagcggcggcgcggttgcgattccgagccgttgagacgcctctgcggcagctggtggcgcaggtggcttgcgtggacgcgggtagaggcgaccggccagcaaccgcagcgtcggcgcccgcggccccggcagcaggcgcgtcgggacgccccgaggcatcctcccccgcccgcgggcccggtagctgggcccgcgtccgccgcccgcatccccgcgccgccgcatctcctcgccgcctcccgggcttcggacccccggtctcgcccccgaaacatgactcgcgatttcaaacctggagacctcatcttcgccaagatgaaaggttatccccattggccagctcgagtagacgaagttcctgatggagctgtaaagccacccacaaacaaactacccattttcttttttggaactcatgagactgcttttttaggaccaaaggatatatttccttactcagaaaataaggaaaagtatggcaaaccaaataaaagaaaaggttttaatgaaggtttatgggagatagataacaatccaaaagtgaaattttcaagtcaacaggcagcaactaaacaatcaaatgcatcatctgatgttgaagttgaagaaaaggaaactagtgtttcaaaggaagataccgaccatgaagaaaaagccagcaatgaggatgtgactaaagcagttgacataactactccaaaagctgccagaagggggagaaagagaaaggcagaaaaacaagtagaaactgaggaggcaggagtagtgacaacagcaacagcatctgttaatctaaaagtgagtcctaaaagaggacgacctgcagctacagaagtcaagattccaaaaccaagaggcagacccaaaatggtaaaacagccctgtccttcagagagtgacatcattactgaagaggacaaaagtaagaaaaaggggcaagaggaaaaacaacctaaaaagcagcctaagaaggatgaagagggccagaaggaagaagataagccaagaaaagagccggataaaaaagaggggaagaaagaagttgaatcaaaaaggaaaaatttagctaaaacaggggttacttcaacctccgattctgaagaagaaggagatgatcaagaaggtgaaaagaagagaaaaggtgggaggaactttcagactgctcacagaaggaatatgctgaaaggccaacatgagaaagaagcagcagatcgaaaacgcaagcaagaggaacaaatggaaactgagcagcagaataaagatgaaggaaagaagccagaagttaagaaagtggagaagaagcgagaaacatcaatggattctcgacttcaaaggatacatgctgagattaaaaattcactcaaaattgataatcttgatgtgaacagatgcattgaggccttggatgaacttgcttcacttcaggtcacaatgcaacaagctcagaaacacacagagatgattactacactgaaaaaaatacggcgattcaaagttagtcaggtaatcatggaaaagtctacaatgttgtataacaagtttaagaacatgttcttggttggtgaaggagattccgtgatcacccaagtgctgaataaatctcttgctgaacaaagacagcatgaggaagcgaataaaaccaaagatcaagggaagaaagggccaaacaaaaagctagagaaggaacaaacagggtcaaagactctaaatggaggatctgatgctcaagatggtaatcagccacaacataacggggagagcaatgaagacagcaaagacaaccatgaagccagcacgaagaaaaagccatccagtgaagagagagagactgaaatatctctgaaggattctacactagataactaggttgacatacctggaatatagagaacacttgagaagtttgtaatggttttcatttgaaatagactgctgaaagttttaaatttttataagcataggtttgatgttgaaaacttgttttgagggagaaaatccctttgttttaaagtaaagtaaacattatcgctaagtgtacttgtgcagtattaacagctacattatacagtaaatgtgggataaaatccatttagaaaatgttaaactgcttttccagacatggttgtagcatattttcaattagtgtgtgtatgttaatgtgtaattgatagtagaacaaagttacatttttaaaactgctacttgtataaaccttgcctcttttcccaaatactgtgggttttgtgcatagtttttacaaaccttggatttaccagactgtcttttcactgtttgtgggttttgtagaagttacacatttttatggtagataaaatgttacttctatacaagtactcactccctttttatcaaaagttaattttaatctcacagtctacattgtgctacattatccagcttctttggaacaatgtgtgctctgtatggttttttttggtatgacaactaattaagcaactgacatggaactgagaattctacaaactataaaacattaatttttgaaggtaatttagttttgtggctgggcattcagtgaagtcttaggacttctttgcagacaactgactgggtatatataggaatgaatctggctttagggttaaatcatttaaggtccttttataggcaggcactagtaactaaaactgaaaactaagtaagtttatttttgaggaatgttgttaaaaatgtctttaggaagtcactaaaacttaattggaagaaaaaatcatgatgcttatacaataaatatgaataaatgttatataaggaaactcacctatttgaaatcatggctatattgtttttattttctagattccaaaaatacaaacactagttgttccagcattgtactttgataagtctgtacattgacgtgtatggactaaatccagggtaaaatcaatgttacaaaatttaagggtatgttaactaaaggatagcatttctaagatattttgaatattagggtcatttggcacttctcagcaagtaggatacttctcatgttttgaaattatatgaatatggaaaaaaatggcttaagaccagcgtctctgtatgacattgtgtggttgaccctctgagataactgttttcatctacagaattgcatttttgcttttaaagaggtcttataatggaactaggaatcaccgttttgagagaacctgcatatataccagtcattatctgtttggtccttatacagttttaacttacttagatttattctagttaagccataagttcaacgtgtaaacttgttttcattaaagaatttttctatcaaa

SEQ ID NO: 21744 - DNA, 3364 bp, Homo sapiens
gggcgccgagcgggagccgcgcgggagcagcgcagctacggcggcggcagcggcggcgcggttgcgattccgagccgttgagacgcctctgcggcagctggtggcgcaggtggcttgcgtggacgcgggtagaggcgaccggccagcaaccgcagcgtcggcgcccgcggccccggcaggcgcgtcgggacgccccgaggcatcctcccccgcccgcgggcccggtagctgggcccgcgtccgccgcccgcatccccgcgccgccgcatctcctcgccgcctcccgggcttcggacccccggtctcgcccccgaaacatgactcgcgatttcaaacctggagacctcatcttcgccaagatgaaaggttatccccattggccagctcgagtagacgaagttcctgatggagctgtaaagccacccacaaacaaactacccattttcttttttggaactcatgagactgcttttttaggaccaaaggatatatttccttactcagaaaataaggaaaagtatggcaaaccaaataaaagaaaaggttttaatgaaggtttatgggagatagataacaatccaaaagtgaaattttcaagtcaacaggcagcaactaaacaatcaaatgcatcatctgatgttgaagttgaagaaaaggaaactagtgtttcaaaggaagataccgaccatgaagaaaaagccagcaatgaggatgtgactaaagcagttgacataactactccaaaagctgccagaagggggagaaagagaaaggcagaaaaacaagtagaaactgaggaggcaggagtagtgacaacagcaacagcatctgttaatctaaaagtgagtcctaaaagaggacgacctgcagctacagaagtcaagattccaaaaccaagaggcagacccaaaatggtaaaacagccctgtccttcagagagtgacatcattactgaagaggacaaaagtaagaaaaaggggcaagaggaaaaacaacctaaaaagcagcctaagaaggatgaagagggccagaaggaagaagataagccaagaaaagagccggataaaaaagaggggaagaaagaagttgaatcaaaaaggaaaaatttagctaaaacaggggttacttcaacctccgattctgaagaagaaggagatgatcaagaaggtgaaaagaagagaaaaggtgggaggaactttcagactgctcacagaaggaatatgctgaaaggccaacatgagaaagaagcagcagatcgaaaacgcaagcaagaggaacaaatggaaactgagcagcagaataaagatgaaggaaagaagccagaagttaagaaagtggagaagaagcgagaaacatcaatggattctcgacttcaaaggatacatgctgagattaaaaattcactcaaaattgataatcttgatgtgaacagatgcattgaggccttggatgaacttgcttcacttcaggtcacaatgcaacaagctcagaaacacacagagatgattactacactgaaaaaaatacggcgattcaaagttagtcaggtaatcatggaaaagtctacaatgttgtataacaagtttaagaacatgttcttggttggtgaaggagattccgtgatcacccaagtgctgaataaatctcttgctgaacaaagacagcatgaggaagcgaataaaaccaaagatcaagggaagaaagggccaaacaaaaagctagagaaggaacaaacagggtcaaagactctaaatggaggatctgatgctcaagatggtaatcagccacaacataacggggagagcaatgaagacagcaaagacaaccatgaagccagcacgaagaaaaagccatccagtgaagagagagagactgaaatatctctgaaggattctacactagataactaggttgacatacctggaatatagagaacacttgagaagtttgtaatggttttcatttgaaatagactgctgaaagttttaaatttttataagcataggtttgatgttgaaaacttgttttgagggagaaaatccctttgttttaaagtaaagtaaacattatcgctaagtgtacttgtgcagtattaacagctacattatacagtaaatgtgggataaaatccatttagaaaatgttaaactgcttttccagacatggttgtagcatattttcaattagtgtgtgtatgttaatgtgtaattgatagtagaacaaagttacatttttaaaactgctacttgtataaaccttgcctcttttcccaaatactgtgggttttgtgcatagtttttacaaaccttggatttaccagactgtcttttcactgtttgtgggttttgtagaagttacacatttttatggtagataaaatgttacttctatacaagtactcactccctttttatcaaaagttaattttaatctcacagtctacattgtgctacattatccagcttctttggaacaatgtgtgctctgtatggttttttttggtatgacaactaattaagcaactgacatggaactgagaattctacaaactataaaacattaatttttgaaggtaatttagttttgtggctgggcattcagtgaagtcttaggacttctttgcagacaactgactgggtatatataggaatgaatctggctttagggttaaatcatttaaggtccttttataggcaggcactagtaactaaaactgaaaactaagtaagtttatttttgaggaatgttgttaaaaatgtctttaggaagtcactaaaacttaattggaagaaaaaatcatgatgcttatacaataaatatgaataaatgttatataaggaaactcacctatttgaaatcatggctatattgtttttattttctagattccaaaaatacaaacactagttgttccagcattgtactttgataagtctgtacattgacgtgtatggactaaatccagggtaaaatcaatgttacaaaatttaagggtatgttaactaaaggatagcatttctaagatattttgaatattagggtcatttggcacttctcagcaagtaggatacttctcatgttttgaaattatatgaatatggaaaaaaatggcttaagaccagcgtctctgtatgacattgtgtggttgaccctctgagataactgttttcatctacagaattgcatttttgcttttaaagaggtcttataatggaactaggaatcaccgttttgagagaacctgcatatataccagtcattatctgtttggtccttatacagttttaacttacttagatttattctagttaagccataagttcaacgtgtaaacttgttttcattaaagaatttttctatcaaa

SEQ ID NO: 21745 - DNA, 1664 bp, Homo sapiens
cgggcccggtagctgggcccgcgtccgccgcccgcatccccgcgccgccgcatctcctcgccgcctcccgggcttcggacccccggtctcgcccccgaaacatgactcgcgatttcaaacctggagacctcatcttcgccaagatgaaaggttatccccattggccagctcgagtagacgaagttcctgatggagctgtaaagccacccacaaacaaactacccattttcttttttggaactcatgagactgcttttttaggaccaaaggatatatttccttactcagaaaataaggaaaagtatggcaaaccaaataaaagaaaaggttttaatgaaggtttatgggagatagataacaatccaaaagtgaaattttcaagtcaacaggcagcaactaaacaatcaaatgcatcatctgatgttgaagttgaagaaaaggaaactagtgtttcaaaggaagataccgaccatgaagaaaaagccagcaatgaggatgtgactaaagcagttgacataactactccaaaagctgccagaagggggagaaagagaaaggcagaaaaacaagtagaaactgaggaggcaggagtagtgacaacagcaacagcatctgttaatctaaaagtgagtcctaaaagaggacgacctgcagctacagaagtcaagattccaaaaccaagaggcagacccaaaatggtaaaacagccctgtccttcagagagtgacatcattactgaagaggacaaaagtaagaaaaaggggcaagaggaaaaacaacctaaaaagcagcctaagaaggatgaagagggccagaaggaagaagataagccaagaaaagagccggataaaaaagaggggaagaaagaagttgaatcaaaaaggaaaaatttagctaaaacaggggttacttcaacctccgattctgaagaagaaggagatgatcaagaaggtgaaaagaagagaaaaggtgggaggaactttcagactgctcacagaaggaatatgctgaaaggccaacatgagaaagaagcagcagatcgaaaacgcaagcaagaggaacaaatggaaactgagcaccaaacaacatgtaatctacagtaataaaaaatatatctcattttgggctcaaagcattaatccagttactgaaaagagaatacaagtggagcaaacaagagatgaagatcttgatacagactcattggactgaatttcccccttccccccattgatggaagaatgttccagattctaaattgaggacttcattattaatggcattactgtgttatgattaacaaatttcctgtaaggtacacactacatactaaggtcggccatcattcctgttttttttttttttttttttttttaaccaagcttaaaatgaagctttgtgtttgaaagtaataacaagctcagacgaagatggtggttgtacattattcatctagaaaatataaaaattcattttgttttgaagctagttattaaactggaatagcagttatatccctgagaatggggcccttctcttgacattcctttgttgtttaattctttagaatcttaataaatgtttttttaatcctgagagattaaacagtagtagacttgttaagaatgaaactgtaaccaaaattttaaaataaagtttttttt

SEQ ID NO: 21746 - DNA, 1786 bp, Homo sapiens
gtagggggtggcgctctccgttcggcggcgctcccatggcgcacattaccattaaccagtacctgcagcaggtgtacgaagccatcgacagcagagatggagcatcttgtgcagagttggtgtcttttaaacatcctcatgttgcaaacccacgacttcaaatggcctctccagaggagaagtgtcaacaagtcttggaacccccttatgatgaaatgtttgcagctcatttaaggtgcacttatgcagtggggaatcatgacttcatagaggcatacaagtgccagaccgtgatagtccaatatcctttgtcgttcatggcagctgtcccgcatagaacacatgcagtggattacttgggacttgagacccggaaacactgggccagttgctcatttctgcagttagaaaggaatgacagtgttttggaacagaagctcgtttcagctctttcacttggtacatcattcttgcgagcattccaggcccacaaagaagaaaactgggctctgcctgtcatgtatgcagtagcgcttgaccttcgagtgtttgccaataatgcagatcaacagttggtaaagaaaggaaaaagcaaagttggggacatgttggaaaaagcagcagagttactgatgagctgtttccgggtctgtgccagcgacacccgtgctggtatagaggactctaagaagtggggcatgctgtttctggtgaaccagctgtttaaaatctacttcaagatcaacaaactccatttatgtaaacccctaattagagcaattgacagctcaaacctgaaagacgattacagcactgcacagagagtaacatacaaatactacgttggacgcaaggctatgtttgacagcgattttaagcaagctgaggagtacctgtcatttgcctttgagcattgtcaccgttctagtcagaagaacaaaaggatgattctgatctatttgcttccagtaaaaatgctattgggtcacatgcccactgtggagctcctgaaaaagtatcacctgatgcagtttgcggaagtaaccagagctgtgagcgagggcaacctgctgctgctgcacgaggcgctggcgaagcacgaggccttcttcattcgctgcggaatcttcctcatcctggagaagctgaagatcatcacctacaggaacctctttaagaaagtgtatttgttactgaaaacacaccagctgtctctggatgcttttctggttgccttgaagttcatgcaggtggaggacgtggacattgacgaagttcagtgtattctggctaacttgatatacatgggacacgtcaaaggctacatatcgcatcagcatcagaagctggtggtcagcaagcagaacccatttcctcccctgtccacggtgtgttgaaagtacacggagccccgaggacggactcggctggttctggagtctttgtgagacttctttgaaggaggctttgcgtgaaggctgctcggctcacttttcctaagtgtggttcctgaaggctgtctttgtaactttttgtagttctttgtgtaaaaagcgtattctgaatttatacacatggcatgttcttcattatatcttccaggatacatctatttttatatattaaatttgaatgtgttatcaaaatgcttggttaacttaaggcacctttttaaaagcagaatttaatttgatttaaattttccagattttatagcttgcctgtatggatgctcctcaatttatgatagggttacatcccaataaacttattttatttgcctttg

SEQ ID NO: 21747 - DNA, 1584 bp, Homo sapiens
atgcgtctgacagatgttgttcaacagcttgtgtacgaagccatcgacagcagagatggagcatcttgtgcagagttggtgtcttttaaacatcctcatgttgcaaacccacgacttcaaatggcctctccagaggagaagtgtcaacaagtcttggaacccccttatgatgaaatgtttgcagctcatttaaggtgcacttatgcagtggggaatcatgacttcatagaggcatacaagtgccagaccgtgatagtccaatatacatcattcttgcgagcattccaggcccacaaagaagaaaactgggctctgcctgtcatgtatgcagtagcgcttgaccttcgagtgtttgccaataatgcagatcaacagttggtaaagaaaggaaaaagcaaagttggggacatgttggaaaaagcagcagagttactgatgagctgtttccgggtctgtgccagcgacacccgtgctggtatagaggactctaagaagtggggcatgctgtttctggtgaaccagctgtttaaaatctacttcaagatcaacaaactccatttatgtaaacccctaattagagcaattgacagctcaaacctgaaagacgattacagcactgcacagagagtaacatacaaatactacgttggacgcaaggctatgtttgacagcgattttaagcaagctgaggagtacctgtcatttgcctttgagcattgtcaccgttctagtcagaagaacaaaaggatgattctgatctatttgcttccagtaaaaatgctattgggtcacatgcccactgtggagctcctgaaaaagtatcacctgatgcagtttgcggaagtaaccagagctgtgagcgagggcaacctgctgctgctgcacgaggcgctggcgaagcacgaggccttcttcattcgctgcggaatcttcctcatcctggagaagctgaagatcatcacctacaggaacctctttaagaaagtgtatttgttactgaaaacacaccagctgtctctggatgcttttctggttgccttgaagttcatgcaggtggaggacgtggacattgacgaagttcagtgtattctggctaacttgatatacatgggacacgtcaaaggctacatatcgcatcagcatcagaagctggtggtcagcaagcagaacccatttcctcccctgtccacggtgtgttgaaagtacacggagccccgaggacggactcggctggttctggagtctttgtgagacttctttgaaggaggctttgcgtgaaggctgctcggctcacttttcctaagtgtggttcctgaaggctgtctttgtaactttttgtagttctttgtgtaaaaagcgtattctgaatttatacacatggcatgttcttcattatatcttccaggatacatctatttttatatattaaatttgaatgtgttatcaaaatgcttggttaacttaaggcacctttttaaaagcagaatttaatttgatttaaattttccagattttatagcttgcctgtatggatgctcctcaatttatgatagggttacatcccaataaacttattttatttgc

SEQ ID NO: 21748 - DNA, 1898 bp, Homo sapiens
ggaccgagggccggaagtgacgccagctggcccgcttgaggcgtagggggtggcgctctccgttcggcggcgctcccatggcgcacattaccattaaccagtacctgcagcaggtgtacgaagccatcgacagcagagatggagcatcttgtgcagagttggtgtcttttaaacatcctcatgttgcaaacccacgacttcaaatggcctctccagaggagaagtgtcaacaagtcttggaacccccttatgatgaaatgtttgcagctcatttaaggtgcacttatgcagtggggaatcatgacttcatagaggcatacaagtgccagaccgtgatagtccaatcattcttgcgagcattccaggcccacaaagaagaaaactgggctctgcctgtcatgtatgcagtagcgcttgaccttcgagtgtttgccaataatgcagatcaacagttggtaaagaaaggaaaaagcaaagttggggacatgttggaaaaagcagcagagttactgatgagctgtttccgggtctgtgccagcgacacccgtgctggtatagaggactctaagaagtggggcatgctgtttctggtgaaccagctgtttaaaatctacttcaagatcaacaaactccatttatgtaaacccctaattagagcaattgacagctcaaacctgaaagacgattacagcactgcacagagagtaacatacaaatactacgttggacgcaaggctatgtttgacagcgattttaagcaagctgaggagtacctgtcatttgcctttgagcattgtcaccgttctagtcagaagaacaaaaggatgattctgatctatttgcttccagtaaaaatgctattgggtcacatgcccactgtggagctcctgaaaaagtatcacctgatgcagtttgcggaagtaaccagagctgtgagcgagggcaacctgctgctgctgcacgaggcgctggcgaagcacgaggccttcttcattcgctgcggaatcttcctcatcctggagaagctgaagatcatcacctacaggaacctctttaagaaagtgtatttgttactgaaaacacaccagctgtctctggatgcttttctggttgccttgaagttcatgcaggtggaggacgtggacattgacgaagttcagtgtattctggctaacttgatatacatgggacacgtcaaaggctacatatcgcatcagcatcagaagctggtggtcagcaagcagaacccatttcctcccctgtccacggtgtgttgaaagtacacggagccccgaggacgggtgagcagttgtttctttccactttggttgtgctgatgagaccggtccggtactgcaacaaggctccctgaagccggaactcttggaggcgcttttcccagggatgctgaggctgagattttcagcacacccgagttaatctccttcatttgtaactaatttcagcctgatgaaaacctggaattcctttttcacagactcggctggttctggagtctttgtgagacttctttgaaggaggctttgcgtgaaggctgctcggctcacttttcctaagtgtggttcctgaaggctgtctttgtaactttttgtagttctttgtgtaaaaagcgtattctgaatttatacacatggcatgttcttcattatatcttccaggatacatctatttttatatattaaatttgaatgtgttatcaaaatgcttggttaacttaaggcacctttttaaaagcagaatttaatttgatttaaattttccagattttatagcttgcctgtatggatgctcctcaatttatgatagggttacatcccaataaacttattttatttgcctttgctttgttggttaaaaaaaaatttcttttaaaaaac

SEQ ID NO: 21749 - DNA, 1555 bp, Homo sapiens
gaggcgtagggggtggcgctctccgttcggcggcgctcccatggcgcacattaccattaaccagtacctgcagcaggtgtacgaagccatcgacagcagagatggagcatcttgtgcagagttggtgtcttttaaacatcctcatgttgcaaacccacgacttcaaatggcctctccagaggagaagtgtcaacaagtcttggaacccccttatgatgaaatgtttgcagctcatttaaggtgcacttatgcagtggggaatcatgacttcatagaggcatacaagtgccagaccgtgatagtccaatatcctttgtcgttcatggcagctgtcgcagatcaacagttggtaaagaaaggaaaaagcaaagttggggacatgttggaaaaagcagcagagttactgatgagctgtttccgggtctgtgccagcgacacccgtgctggtatagaggactctaagaagtggggcatgctgtttctggtgaaccagctgtttaaaatctacttcaagatcaacaaactccatttatgtaaacccctaattagagcaattgacagctcaaacctgaaagacgattacagcactgcacagagagtaacatacaaatactacgttggacgcaaggctatgtttgacagcgattttaagcaagctgaggagtacctgtcatttgcctttgagcattgtcaccgttctagtcagaagaacaaaaggatgattctgatctatttgcttccagtaaaaatgctattgggtcacatgcccactgtggagctcctgaaaaagtatcacctgatgcagtttgcggaagtaaccagagctgtgagcgagggcaacctgctgctgctgcacgaggcgctggcgaagcacgaggccttcttcattcgctgcggaatcttcctcatcctggagaagctgaagatcatcacctacaggaacctctttaagaaagtgtatttgttactgaaaacacaccagctgtctctggatgcttttctggttgccttgaagttcatgcaggtggaggacgtggacattgacgaagttcagtgtattctggctaacttgatatacatgggacacgtcaaaggctacatatcgcatcagcatcagaagctggtggtcagcaagcagaacccatttcctcccctgtccacggtgtgttgaaagtacacggagccccgaggacggactcggctggttctggagtctttgtgagacttctttgaaggaggctttgcgtgaaggctgctcggctcacttttcctaagtgtggttcctgaaggctgtctttgtaactttttgtagttctttgtgtaaaaagcgtattctgaatttatacacatggcatgttcttcattatatcttccaggatacatctatttttatatattaaatttgaatgtgttatcaaaatgcttggttaacttaaggcacctttttaaaagcagaatttaatttgatttaaattttccagattttatagcttgcctgtatggatgctcctcaatttatgatagggttacatcccaataaacttattttatttgc

SEQ ID NO: 21750 - DNA, 1654 bp, Homo sapiens
gggggtggcgctctccgttcggcggcgctcccatggcgcacattaccattaaccagtacctgcagcaggtgtacgaagccatcgacagcagagatggagcatcttgtgcagagttggtgtcttttaaacatcctcatgttgcaaacccacgacttcaaatggcctctccagaggagaagtgtcaacaagtcttggaacccccttatgatgaaatgtttgcagctcatttaaggtgcacttatgcagtggggaatcatgacttcatagaggcatacaagtgccagaccgtgatagtccaatcattcttgcgagcattccaggcccacaaagaagaaaactgggctctgcctgtcatgtatgcagtagcgcttgaccttcgagtgtttgccaataatgcagatcaacagttggtaaagaaaggaaaaagcaaagttggggacatgttggaaaaagcagcagagttactgatgagctgtttccgggtctgtgccagcgacacccgtgctggtatagaggactctaagaagtggggcatgctgtttctggtgaaccagctgtttaaaatctacttcaagatcaacaaactccatttatgtaaacccctaattagagcaattgacagctcaaacctgaaagacgattacagcactgcacagagagtaacatacaaatactacgttggacgcaaggctatgtttgacagcgattttaagcaagctgaggagtacctgtcatttgcctttgagcattgtcaccgttctagtcagaagaacaaaaggatgattctgatctatttgcttccagtaaaaatgctattgggtcacatgcccactgtggagctcctgaaaaagtatcacctgatgcagtttgcggaagtaaccagagctgtgagcgagggcaacctgctgctgctgcacgaggcgctggcgaagcacgaggccttcttcattcgctgcggaatcttcctcatcctggagaagctgaagatcatcacctacaggaacctctttaagaaagtgtatttgttactgaaaacacaccagctgtctctggatgcttttctggttgccttgaagttcatgcaggtggaggacgtggacattgacgaagttcagtgtattctggctaacttgatatacatgggacacgtcaaaggctacatatcgcatcagcatcagaagctggtggtcagcaagcagaacccatttcctcccctgtccacggtgtgttgaaagtacacggagccccgaggacggcctgatgaaaacctggaattcctttttcacagactcggctggttctggagtctttgtgagacttctttgaaggaggctttgcgtgaaggctgctcggctcacttttcctaagtgtggttcctgaaggctgtctttgtaactttttgtagttctttgtgtaaaaagcgtattctgaatttatacacatggcatgttcttcattatatcttccaggatacatctatttttatatattaaatttgaatgtgttatcaaaatgcttggttaacttaaggcacctttttaaaagcagaatttaatttgatttaaattttccagattttatagcttgcctgtatggatgctcctcaatttatgatagggttacatcccaataaacttattttatttgcctttgc

SEQ ID NO: 21751 - DNA, 1671 bp, Homo sapiens
agacggaccgagggccggaagtgacgccagctggcccgcttgaggcgtagggggtggcgctctccgttcggcggcgctcccatggcgcacattaccattaaccagtacctgcagcaggtgtacgaagccatcgacagcagagatggagcatcttgtgcagagttggtgtcttttaaacatcctcatgttgcaaacccacgacttcaaatggcctctccagaggagaagtgtcaacaagtcttggaacccccttatgatgaaatgtttgcagctcatttaaggtgcacttatgcagtggggaatcatgacttcatagaggcatacaagtgccagaccgtgatagtccaatcattcttgcgagcattccaggcccacaaagaagaaaactgggctctgcctgtcatgtatgcagtagcgcttgaccttcgagtgtttgccaataatgcagatcaacagttggtaaagaaaggaaaaagcaaagttggggacatgttggaaaaagcagcagagttactgatgagctgtttccgggtctgtgccagcgacacccgtgctggtatagaggactctaagaagtggggcatgctgtttctggtgaaccagctgtttaaaatctacttcaagatcaacaaactccatttatgtaaacccctaattagagcaattgacagctcaaacctgaaagacgattacagcactgcacagagagtaacatacaaatactacgttggacgcaaggctatgtttgacagcgattttaagcaagctgaggagtacctgtcatttgcctttgagcattgtcaccgttctagtcagaagaacaaaaggatgattctgatctatttgcttccagtaaaaatgctattgggtcacatgcccactgtggagctcctgaaaaagtatcacctgatgcagtttgcggaagtaaccagagctgtgagcgagggcaacctgctgctgctgcacgaggcgctggcgaagcacgaggccttcttcattcgctgcggaatcttcctcatcctggagaagctgaagatcatcacctacaggaacctctttaagaaagtgtatttgttactgaaaacacaccagctgtctctggatgcttttctggttgccttgaagttcatgcaggtggaggacgtggacattgacgaagttcagtgtattctggctaacttgatatacatgggacacgtcaaaggctacatatcgcatcagcatcagaagctggtggtcagcaagcagaacccatttcctcccctgtccacggtgtgttgaaagtacacggagccccgaggacggactcggctggttctggagtctttgtgagacttctttgaaggaggctttgcgtgaaggctgctcggctcacttttcctaagtgtggttcctgaaggctgtctttgtaactttttgtagttctttgtgtaaaaagcgtattctgaatttatacacatggcatgttcttcattatatcttccaggatacatctatttttatatattaaatttgaatgtgttatcaaaatgcttggttaacttaaggcacctttttaaaagcagaatttaatttgatttaaattttccagattttatagcttgcctgtatggatgctcctcaatttatgatagggttacatcccaataaacttattttatttgcctttgc

SEQ ID NO: 21752 - DNA, 2372 bp, Homo sapiens
gttcggcggcgctcccatggcgcacattaccattaaccagtacctgcagcaggtgggtcctagccggggagcgcgcggcggcgtggttggccctcggcgtgttccgtgtgtcccctcctgccttggaccctcaggccttttcctttcccgcctcgccacccttcttccgttcgggtccccggcgggcagccgcgcgagccgaacagcggcggccgggactcgggaaggcggcccgagttctcccctgcagggccgccgtgggggccgggcggtgtccgtggatcgcggagtcgtcgcggtgtaagtagacgcggcggtcccaggtcgctgccctcacttgctggcacgtgtggccgcgctcccaggcggtccgaagggcctgcgggccacgccgagggcccgctgtgggcggtgctgtgtcggatggacgctgtttcccagcaggatgcgggatgaattcggggactccaggaggcgatggaggagtaagcgcgaggctgtggccgtgctgcaggccgggctcgtgcccctcgtcctcgctgtcgtttaacgcccttcactctccgagcacaatgcacacttcatatcgctcggtacatgcgtctgacagatgttgttcaacagcttgtgtacgaagccatcgacagcagagatggagcatcttgtgcagagttggtgtcttttaaacatcctcatgttgcaaacccacgacttcaaatggcctctccagaggagaagtgtcaacaagtcttggaacccccttatgatgaaatgtttgcagctcatttaaggtgcacttatgcagtggggaatcatgacttcatagaggcatacaagtgccagaccgtgatagtccaatcattcttgcgagcattccaggcccacaaagaagaaaactgggctctgcctgtcatgtatgcagtagcgcttgaccttcgagtgtttgccaataatgcagatcaacagttggtaaagaaaggaaaaagcaaagttggggacatgttggaaaaagcagcagagttactgatgagctgtttccgggtctgtgccagcgacacccgtgctggtatagaggactctaagaagtggggcatgctgtttctggtgaaccagctgtttaaaatctacttcaagatcaacaaactccatttatgtaaacccctaattagagcaattgacagctcaaacctgaaagacgattacagcactgcacagagagtaacatacaaatactacgttggacgcaaggctatgtttgacagcgattttaagcaagctgaggagtacctgtcatttgcctttgagcattgtcaccgttctagtcagaagaacaaaaggatgattctgatctatttgcttccagtaaaaatgctattgggtcacatgcccactgtggagctcctgaaaaagtatcacctgatgcagtttgcggaagtaaccagagctgtgagcgagggcaacctgctgctgctgcacgaggcgctggcgaagcacgaggccttcttcattcgctgcggaatcttcctcatcctggagaagctgaagatcatcacctacaggaacctctttaagaaagtgtatttgttactgaaaacacaccagctgtctctggatgcttttctggttgccttgaagttcatgcaggtggaggacgtggacattgacgaagttcagtgtattctggctaacttgatatacatgggacacgtcaaaggctacatatcgcatcagcatcagaagctggtggtcagcaagcagaacccatttcctcccctgtccacggtgtgttgaaagtacacggagccccgaggacgggtgagcagttgtttctttccactttggttgtgctgatgagaccggtccggtactgcaacaaggctccctgaagccggaactcttggaggcgcttttcccagggatgctgaggctgagattttcagcacacccgagttaatctccttcatttgtaactaatttcagcctgatgaaaacctggaattcctttttcacagactcggctggttctggagtctttgtgagacttctttgaaggaggctttgcgtgaaggctgctcggctcacttttcctaagtgtggttcctgaaggctgtctttgtaactttttgtagttctttgtgtaaaaagcgtattctgaatttatacacatggcatgttcttcattatatcttccaggatacatctatttttatatattaaatttgaatgtgttatcaaaatgcttggttaacttaaggcacctttttaaaagcagaatttaatttgatttaaattttccagattttatagcttgcctgtatggatgctcctcaatttatgatagggttacatcccaataaacttattttatttgc

SEQ ID NO: 21753 - DNA, 2546 bp, Homo sapiens
ctcacttccggtgggtggcaggcagggccacgcgtcttcccgaacggagagactaggggcgttgttgcctggcagcagacgggcaagcctggacttaggcggcgcgcaggacggtccgacttcgtgcggaggcctccctgaggtccgggtccttgcggccactgcggccactgaagcggcggcggcggctggcccaggaggaagaagtcgagcccaagctatttccggttccggtgtcagttcgaggcgccgccgccgccgccgcagccgccggagccgcaatgcctaaaggaggaagaaagggaggccacaaaggccgggcgaggcagtatacaagccctgaggagatcgacgcgcagctgcaggctgagaagcagaaggccagggaagaagaggagcaaaaagaaggtggagatggggctgcaggtgaccccaaaaaggagaagaaatctctagactcagatgagagtgaggatgaagaagatgactaccagcaaaagcgcaaaggcgttgaagggctcatcgacatcgagaaccccaaccgggtggcacagacaaccaaaaaggtcacacaactggatctggacgggccaaaggagctttcgaggagagaacgagaagagattgagaagcagaaggcaaaagagcgttacatgaaaatgcacttggccgggaagacagagcaagccaaggctgacctggcccggctggccatcatccggaaacagcgggaggaggctgcccggaagaaggaagaggaaaggaaagcaaaagacgatgccacattgtcaggaaaacgaatgcagtcactctccctgaataagtaactgcgacccgtgggaggagatgccggggacctgggccgcgctgccaggacctctgctgtgtctcgcccaccctgtgccctggcgccgctgcaacagcccctcatggccaggagccccccatggcctggggcctcctcttcatcttggcacagaaattgtttgggggatggggggggggactgggggaggggtagctgctatctttgagacagaaagatgcaggacagcatttcatatgtaaccatttgaatgtttttgctgtttttagaattcagagcccttgctggggggtgcctgggagatggggtaagaagagctttcatttgtctggtagatagatagcatgtaagggggtggttgtcccaggaggcagctgctgacaggtttgctacacacagccccggactgtgttgcctgggtgctcattcagagaggggctatcatctgggagcctgtgcccctgggtcctcgagggtcatggcttgtccctggtcagtcctgtctgactgacctcagggcctcacctctctgcccttccctgcccggttcctactcacctggctagggccagtgcccattttcagccctacccattgatcatttcaagaaacctctgtttactgtgtggcacccaggcaaaacatgctccacaaattcaacttgtatatttggcagattaaacttgacattatcgtaatctttgttttggcaatccatcctttggcttccgtgctcgagccgtttttacccagctgggtacggtgccacgttcaggcacgtgcacccggcaaggttcagggcacatacctacctggggcatgacatctgtcaggtggcaccgagcaggatgcggggatggaccctagataccacagcctgccccctcccctcctttagccaagtcaggatcttaggcctcagcaggcagggacccttccaggccacagtaggctgaagcagcaccaggatcctggcctggcctggcctgtaggtgtcccctggtggttataattctgtaactctaggggagaaggggaatagcactagcattggatgtcgccaaggcccacattttcctgagagaagccacaaaagatgtgcaaatgcccttcagcacaggacctggtgacatgacataaactccaagacagaacctcagtttacagcacacgaaaaaaatatcttgccaacattgtaatgacaaaataaattcccgtgaagttccacaaccaggccgggcatggtggctcatgcctgtaatcccagcactttgggaggtgaggtgggtggatcatctgaggtcaggagttcaagaccagcctggccaacatggagaaactccgtctctactaaaaatacaaaaattaaccaggcttggtggtgtatgcctgtaatcccagctacttgggaggctgaggcaggagaatcgcttgatcccaggaaggcagaggtggcagtgagctgagaacgcacaactgcactccagcctgggtgacgagcaaaactccatctcaaaacaaaagttccacaaccagcctggagtgtgtagcccctttgtccaggaatttgactagtcaatcagtgacacctggtactggcagttttgggagtggcagcccaggatggacagcagtggggagggaaccatttggcataaggccgttgggcttcaggatcaattttgttggcaagcagtaaaaataagctatctacctatgg

SEQ ID NO: 21754 - DNA, 2566 bp, Homo sapiens
gcgagctgcccgataatggcggcctgcagagcccatgagagggagaagcggcagcgtctaccctgagaaacctcgaccttgaagatggtgagtagccagccaaagtacgatctaatacgggaggtaggccgaggtagttacggtgttgtgtatgaagcagtcatcagaaagacctctgcacgggtggcagtgaagaaaattcgatgtcacgcacctgaaaatgttgaactagcccttcgtgagttctgggcactaagcagtatcaagagccaacatccaaatgtgattcacttggaggaatgcatcctacaaaaggatgggatggtgcaaaagatgtcccacggctctaattcttccctttatttacagcttgtagaaacttcattaaaaggagaaattgcctttgatcccagaagcgcctattatttgtggtttgtgatggatttttgtgacggaggagatatgaatgagtatctgttgtccaggaaacccaatcgtaaaactaacaccagcttcatgcttcagctgagcagtgccctggctttcttgcataaaaaccagatcatccaccgagatcttaagcctgataacatcctgatttctcaaaccaggttggataccagtgacttggaacctaccctcaaagtggctgattttggtctaagtaaagtttgttcagcctctgggcagaacccagaagaacctgtcagtgtaaacaagtgtttcctttccacagcatgtggaacagatttttacatggctcctgaagtttgggaaggacattacacagcaaaagctgacatctttgctctggggattatcatctgggcaatgctggaaaggatcacattcatagacacagagacaaagaaggaactcttggggagttatgtaaaacaaggaactgagattgtgcctgttggggaggcacttctggaaaatcccaaaatggaacttctcattcctgtgaagaaaaaatctatgaatgggcgaatgaaacaactgattaaggaaatgctggctgcaaaccctcaggatcgtccagatgcttttgaactagaactcagattagtacaaattgcatttaaagatagcagctgggaaacgtgacacatattatttgcaaataccatggatgatatgctgcttctgtttaacagtgatgcaacattatgtggctgaaaaagaatataaaaagctagactctaccctctaagggtttagattttttgtgggattttttttttcctcatttttcttaaatccaagttggccgttttattagtatgtttcaaatgtgtattaccaatgtgggtgtaaatttttaaaaaatgattattgatagaagtttggcaggaaaattctttaagagctaacaagagaagagagtccagttttctggaaatatgtctttaagtattttagacattcctcgtcagtattaggaatttccatgggaaaagaggtttgcatgctggtaatgcaacctttgaaactttgtaaaggaaacatatatgtatatatttatgtatatgtaagtatgtgaatgtgcgcattttgcattccatatgaaaaaaatgccacgtctgtttaaattatttgatgtaggtttgggtttttgagatttgctggtgaagtcagtgacgaaaaataaaccttcccttatcttcctactctgcccctccccctaatgaaatcatattaagttgtttttttttttttttgtaatatacagctttttttttaaggcatcattttcgagggtctaaaattatctggtaaaacaaatgaaattaagtgatccaaagctgctgaagtatgtttgaactctccagtgccctatagctgcaagagttgaattagtcatgcagtcatatggcagcaggttggtgattcagtccgaccttctttaggtaaccgagcatttatttaaccaactataccactgcattgggacgtctgcacttgagcttctacaatctgatataaatctgaatacaggattattctgtttgaaaactttgctatgtgtgaactgtaatacttgatacatttttggtttgaagactttgtctaagcctcattatactgaagttgaagaaaccaaatgagctccaccctcactttgcctgccctgatatgatcacttgttgagtcactggagttcctttcattttggcactgatgctgttttctcttgtctgatttgaaacagtactggtaataatatggttgttgaaaatgtgatcacctttatctaaagtgggagaagatacatacacagtatggcaaatggataaaatattgtggcatcaactacttttaaagtagaaaagctatccattttatacaatcactgatacagtctatgtcaaaaaaccaacagaccattattcctcttgaagttagtttgattttatctttgtatggttgtctacaatttgttttcctgtaaatgcagatagttaaaatctaaaggatagaatgctttcctaaaacagaacattagcctttaaggttaaatagactttacattgtatctaagttaatctttataaagcactag

SEQ ID NO: 21755 - DNA, 4279 bp, Homo sapiens
ggcagcggaggcgcgagctgcccgataatggcggcctgcagagcccatgagagggagaagcggcagcgtctaccctgaggaaggtgctcttccccatggggactgtaccaggctggagaggacatggcactgcttcagagacacgaaccaccttgagtggatgtgattggcgatccccgtagagcaggaaagctcgtctgctgtgcagccggcgcagaggattctgtggcaggaaattagacactaggaaattcagtagcgatttgaaggaaacctcgaccttgaagatggtgagtagccagccaaagtacgatctaatacgggaggtaggccgaggtagttacggtgttgtgtatgaagcagtcatcagaaagacctctgcacgggtggcagtgaagaaaattcgatgtcacgcacctgaaaatgttgaactagcccttcgtgagttctgggcactaagcagtatcaagagccaacatccaaatgtgattcacttggaggaatgcatcctacaaaaggatgggatggtgcaaaagatgtcccacggctctaattcttccctttatttacagcttgtagaaacttcattaaaaggagaaattgcctttgatcccagaagcgcctattatttgtggtttgtgatggatttttgtgacggaggagatatgaatgagtatctgttgtccaggaaacccaatcgtaaaactaacaccagcttcatgcttcagctgagcagtgccctggctttcttgcataaaaaccagatcatccaccgagatcttaagcctgataacatcctgatttctcaaaccaggttggataccagtgacttggaacctaccctcaaagtggctgattttggtctaagtaaagtttgttcagcctctgggcagaacccagaagaacctgtcagtgtaaacaagtgtttcctttccacagcatgtggaacagatttttacatggctcctgaagtttgggaaggacattacacagcaaaagctgacatctttgctctggggattatcatctgggcaatgctggaaaggatcacattcatagacacagagacaaagaaggaactcttggggagttatgtaaaacaaggaactgagattgtgcctgttggggaggcacttctggaaaatcccaaaatggaacttctcattcctgtgaagaaaaaatctatgaatgggcgaatgaaacaactgattaaggaaatgctggctgcaaaccctcaggatcgtccagatgcttttgaactagaactcagattagtacaaattgcatttaaagatagcagctgggaaacgtgacacatattatttgcaaataccatggatgatatgctgcttctgtttaacagtgatgcaacattatgtggctgaaaaagaatataaaaagctagactctaccctctaagggtttagattttttgtgggattttttttttcctcatttttcttaaatccaagttggccgttttattagtatgtttcaaatgtgtattaccaatgtgggtgtaaatttttaaaaaatgattattgatagaagtttggcaggaaaattctttaagagctaacaagagaagagagtccagttttctggaaatatgtctttaagtattttagacattcctcgtcagtattaggaatttccatgggaaaagaggtttgcatgctggtaatgcaacctttgaaactttgtaaaggaaacatatatgtatatatttatgtatatgtaagtatgtgaatgtgcgcattttgcattccatatgaaaaaaatgccacgtctgtttaaattatttgatgtaggtttgggtttttgagatttgctggtgaagtcagtgacgaaaaataaaccttcccttatcttcctactctgcccctccccctaatgaaatcatattaagttgtttttttttttttttgtaatatacagctttttttttaaggcatcattttcgagggtctaaaattatctggtaaaacaaatgaaattaagtgatccaaagctgctgaagtatgtttgaactctccagtgccctatagctgcaagagttgaattagtcatgcagtcatatggcagcaggttggtgattcagtccgaccttctttaggtaaccgagcatttatttaaccaactataccactgcattgggacgtctgcacttgagcttctacaatctgatataaatctgaatacaggattattctgtttgaaaactttgctatgtgtgaactgtaatacttgatacatttttggtttgaagactttgtctaagcctcattatactgaagttgaagaaaccaaatgagctccaccctcactttgcctgccctgatatgatcacttgttgagtcactggagttcctttcattttggcactgatgctgttttctcttgtctgatttgaaacagtactggtaataatatggttgttgaaaatgtgatcacctttatctaaagtgggagaagatacatacacagtatggcaaatggataaaatattgtggcatcaactacttttaaagtagaaaagctatccattttatacaatcactgatacagtctatgtcaaaaaaccaacagaccattattcctcttgaagttagtttgattttatctttgtatggttgtctacaatttgttttcctgtaaatgcagatagttaaaatctaaaggatagaatgctttcctaaaacagaacattagcctttaaggttaaatagactttacattgtatctaagttaatctttataaagcactagaatttttggtcaaaagtcaaaatagtattagaatattgaaattattgatagctttcataatctcagcttttttgaacttccacaatttttggaatatgtcataatttttttccctgtttcaaatgtgttcagaggaaatagaatgtaaaacatcacaaaaaaaattgcagtacataaaatttctggactatgttagttacttgatctggaagtttaaaatttggactaaaaggttttattgaaataaagcctcttaaaatgaaaaatcatatacttttaacatcacttttaagctaataaatataagaattcttttggaaattagaggtggaaacacactggaacctcatgataattgaccctctggatcaccagattagtttaatttaacagatatgtccaaggaagttgagctatagggagtaagaaaaagcatcatgataacgtctagtcaataacatggcacttcagcagagattcatagatgatggtatgcccatgcatcatttgctcttcaaatatctatgtgcttggagccacagtttcctaagcgcatagtttttggtcctgcctcatgtaaaatagttaatgattatcatttacttggaaagattttacctgtgaagtgaaattctttcattgggggtaagggtatgaggtgatcaggaagtttcttctggaattttatcaagtccttgtattctaaaatagccaagcaaaatgatagtaaattctttgtctttgttctttcagtcagaggtatttattaagtacctactgtgtgctcagcactaaaggtttgttgataaaatgacaattaaaaaatggcatttagccaaaggccttttcagccaggagtaagaaaagatggttagtgatatttggaaatacctggatatttgctagaggaaaaatgaaagcaaaacttcgtacacagtgccttgcccataataggtactcaataagcaattgttcctcatagagtcttttgccatgatttatggtgttttttgaaatttgtcttaattgaaaaaagaccaaatatttcaaatgagcttataggcagctgtggccagtgaaaatatggggttgtacagttagttcctagaatgttattttgcactagttgtcacttagaaagatggggttcctgtagattttttggtgctaagggatactttgtcattatgatgaagtaagtgttaagtgtcagataaatagcacacagaatagttctttctgctggtctgttttttctcttcgttgttgttgtttttaattgtaaattgttatcaatcaaactattgtagcagctacaaagtaattcaccagcatgacaaaatggtcaaaaaataagtcatcagcacttaagaaatgaaagcaacttttgaaattttctgttaaaattgtcaaatatattttatgaagaatttataaaaggggaaaatgattgtaatttattgttcatgacttttttttttaaataaagtgagtttcaacaaaaaaaaaa

SEQ ID NO: 21756 - DNA, 838 bp, Homo sapiens
gcacccagccccgcgccgccgccgccgccgccgtctccgcaactgcaccgcccgcaaacatggctcagtgactcggagaaaagctgcagtctccctcccggcggggcggacgccaggcctccttggtcgggccgcacctccccgcaggcccgccaaagagcaccgcgccccgcaggcacccgagacccgcgcggaagatgcaccgggcgttccaccccagcgagccccgcaccccagcccgcagctcgaaacctcgaccttgaagatggtgagtagccagccaaagtacgatctaatacgggaggtaggccgaggtagttacggtgttgtgtatgaagcagtcatcagaaagacctctgcacgggtggcagtgaagaaaattcgatgtcacgcacctgaaaatgttgaactagcccttcgtgagttctgggcactaagcagtatcaagagccaacatccaaatgtgattcacttggaggaatgcatcctacaaaaggatgggatggtgcaaaagatgtcccacggctctaattcttccctttatttacagcttgtagaaacttcattaaaaggagaaattgcctttgatcccagaagcgcctattatttgtggtttgtgatggatttttgtgacggaggagatatgaatgagtatctgttgtccaggaaacccaatcgtaaaactaacaccagcttcatgcttcagctgagcagtgccctggctttcttgcataaaaaccagatcatccaccgagatcttaagcctgataacatcctgatttctcaaaccaggttggataccagtgacttggaacctaccctcaaagtggctgatttt

SEQ ID NO: 21757 - DNA, 7176 bp, Homo sapiens
ggccggcggaggaaggggagggagcgaggagcgcgcgctgctctcgcgtgctctcgcgccgctcgcgtgaccggccggtgtgtgcgcgaggccccggctcccggggcacggacggccgggcgcgcgcctctgcgaggggcgtccgggtccgagtcggcggtccgggccggcgcgaggtgcgtgcgggcgggccgcgggggtcccggacggacacaagcgcacacactcccggaggagccttcgaggctgctcttcctcggccagacggagagcggcactgtctccccgcccagcgctcactcgccccgcgtctccccccgcggcggctgctcctcctcggcaccgccagccccagcgccgctcccgggcgggcgggcggcggcggcggcggcggcgggacccgcggagccgctttgtgtgcagcccgactaggggcggcggcgcaaccacctgacagaggcccgggcgctcgatgcaccttccgcccgcatgaggaggagaggccggtagaggactgtgaaccaaaagttgtcccccaggatggacttcaccgcgcagcccaagcctgccactgccctctgtggcgtcgtgagtgccgacgggaagatcgcttaccctccgggggtaaaagagatcaccgacaagatcaccacggacgagatgatcaaacgcctgaagatggtagtgaaaacctttatggatatggatcaggactcagaagatgaaaaacagcagtatctcccactagccttgcatcttgcatctgaattcttcctcaggaaccccaataaagatgtgcgtctccttgtagcatgttgtttggctgatatctttcgtatctatgccccagaagctccatatacttcccatgataaacttaaggacatatttttgtttattaccagacaattaaaaggtttggaggatacaaagagtccacagtttaatagatacttttatttattagagaatttagcttgggttaaatcatataacatctgctttgaattggaagattgcaatgaaatttttattcagctttttagaactctcttctcagtgatcaacaatagccacaataagaaggtacaaatgcacatgctagatttgatgagttctatcatcatggaaggtgatggagttactcaagaattattggactccattcttattaacctcattcctgcacataagaacttaaataaacagtcctttgaccttgcaaaagtgctattgaaaagaacagtccagactattgaggcatgcattgctaattttttcaatcaagtcctggtgctgggaagatcatcagtaagtgatttgtcagaacatgtatttgatctgattcaggaactttttgctatagatcctcatttattattatccgtcatgccacagcttgaattcaaactaaagagcaatgatggagaagagcgattagctgttgttcgacttctagctaaattgtttggctccaaagattctgatttggcaacacagaatcgtcctctttggcaatgttttcttggacgatttaatgatattcatgttcctgtgagattagaaagtgtgaaatttgccagtcattgtttaatgaatcacccagatttagcgaaggatctcacagaatatttaaaggttagatcacatgatccagaagaagctattcgtcatgatgtcattgttactataataacagctgccaagagggacctggccttagtaaatgatcagctgcttggctttgtaagggaaagaacactggataaacggtggcgagtaagaaaagaagctatgatgggtctggctcagctttataagaaatactgtcttcatggtgaagcaggaaaggaagctgcagagaaagtcagctggataaaggacaaacttctgcatatttattatcagaacagcattgacgacaaactgttggtagagaaaatctttgctcagtatcttgtcccccacaacctggaaacagaagagagaatgaaatgcttatattacttatatgctagtttggatccaaatgctgtaaaagctctcaacgaaatgtggaagtgtcagaacatgcttcggagccatgtacgcgaactattggatttgcacaagcagcctacatcagaggctaactgttctgccatgtttggaaaactgatgaccatagcaaagaatttgcctgaccccgggaaagcacaagattttgtgaagaaatttaaccaggttctcggcgatgatgagaaacttcggtctcagttggagttattaattagcccaacctgttcttgcaaacaagcagatatttgtgtgagagaaatagcccggaaacttgcaaatcctaagcaaccaacaaatccttttctagagatggtcaaatttctgttggaaagaatcgcacctgtgcacattgattcagaagccataagtgcactagtgaaattgatgaataagtcaatagaggggacagcagatgatgaagaggagggtgtaagtccagatacagctatccgttcaggacttgaacttcttaaggttctgtcttttacacatcctacctcgttccactctgcagagacatatgagtccttgttacagtgcctaagaatggaggatgacaaggtagcagaagctgctattcaaatttttagaaatacaggtcacaaaatagaaacagaccttccccagatacgatcgaccttaattcccattttacatcaaaaagcaaagaggggtactccacaccaagcaaaacaggctgtgcactgtatacacgccatattcacaaataaagaagtccagcttgcacagatttttgagccactcagtaggagtctgaatgctgatgtgccagaacaacttataactccattagtttcattgggccacatttctatgttagcaccagatcagtttgcttccccaatgaaatctgtagtagcaaattttattgtgaaagatctgctaatgaatgacaggtcaacaggtgaaaagaatggaaaactgtggtctccagatgaagaggtttcccctgaagtactagcaaaggtacaggcaattaaacttctggtaaggtggctgttgggtatgaaaaacaaccagtctaaatctgccaattcaacccttcggttattatcagcgatgttggttagtgagggtgacctgacagagcaaaagaggatcagtaaatctgatatgtctcgcttgcgattagctgctggtagtgccataatgaagcttgctcaggaaccttgttaccatgaaattattaccccagaacagtttcagctctgtgcacttgttattaatgatgagtgttaccaagtaaggcagatatttgctcagaagctgcataaggcacttgtgaagttactgctcccattggagtatatggcgatctttgccttgtgtgccaaagatcctgtgaaggagagaagagcacacgcacgacaatgtttactgaaaaatatcagtatacgcagggaatacattaagcagaatcctatggctactgagaaattattatcactgttgcctgaatatgtagttccatacatgattcacctgctagcccatgatccagattttacaagatcacaagatgttgatcagcttcgtgatatcaaagagtgcctatggttcatgcttgaagttttaatgacaaagaatgaaaacaatagccatgcctttatgaagaagatggcagagaacatcaagttaaccagagatgcccagtctccagatgaatccaagacaaatgaaaaactgtatacagtatgtgatgtggctctctgtgttataaatagtaaaagtgctttgtgcaatgcagattcaccaaaggacccagtcctcccaatgaaattttttacacaacctgaaaaggacttctgtaacgataagagttatatttcagaagagacaagagtacttctgttaacaggaaagccaaagcctgctggagtactaggtgcagtaaataagcctttatcagcaacgggaaggaaaccctatgttagaagcactggcactgagactggaagcaatattaatgtaaattcagagctgaacccttcaaccggaaatcgatcaagggaacagagttcagaggcagcagaaactggagttagtgaaaatgaagagaaccctgtgaggattatttcagtcacacctgtaaagaatattgacccagtaaagaataaggaaattaattctgatcaggctacccagggcaacatcagcagtgaccgaggaaagaaaagaacagtaacagcagctggtgcagagaatatccaacaaaaaacagatgagaaagtagatgaatcgggacctcccgccccttccaaacccaggagaggacgtcgacccaagtctgaatctcagggcaatgctaccaaaaatgatgatctaaataaacctattaacaagggaaggaagagagctgcagtgggtcaggagagccctgggggtttggaagcaggtaatgccaaagcacccaaactgcaagatttagccaaaaaggcagcaccagcagaaagacaaattgacttacaaaggtaaaaatgcatttgcaaagggagaaaatgaaggccaaacagaagcaggctccagcttctgcaaaaacttggattcacaaatgtccctgaacagaaaatgaagctcacttcagaacacacactctctgccttgaaaactaaagagactattacttccttttcacatgaccacaagtcctctgatggaaatgtacagcagaaactcttgagagagaggctaaaagcaactctgttctcccccttcccctagacttttcttacgaaaagtcaataattaagcaaattgcttaacacttggttccagttcctgcctatctggagtttaaatgcgtaatacaccattaatttccacgctgcagtttttattttaaagaaagtaacaagatgtctttacactgacactgaaaattcatccattttagagccaggaattcccatgttacacaggaaaaaatagaagtctactgaattaattttttaaaagaaaagagatcagattaaatatttctttgtttttccttttggaaacttttatgtataattctttctgcctgcctacttttctgcaaaaatgagatgtacagatttcggttccctgctatgaaaagtgatgtggtagcaattttataaatgttgctttctgatttttatcagagtgagaaaattaaaattattgatttgcaagtagtaaacagttcatattttgatttcccctcattttagtttaatataatttgcaataaatgtacatattgttgtttgtttcataaagcatatcactttaaaatggtttttactcctgtgattatgttggaatatttggaattttaaaggagtaaagactgtccagcatttggttttataatgtttgtcaccagatttttattaatgtaaaaaaaatcaatttttaaaaaatagttggactttggcagcttttaaggaaagttggaggtgttttaggattgctatcaattttcagcattgtgctatttggaaataagtgttttgcttttgtctgatggtctgggctcatttttatgtttattttagaaaactgttgcatcaatatattatgtttcttggcattgttcagcataggtaatgtgtgcactttatgtgtacacataatcatatttaagttttttgcataaaataaatgcttctagatgtcatggcagtctttttaatctttttatcatatgctttcttgtgaattttttcatgttaaagagctaaagtcataacatgattacagtcaactctccattatctatataaaatagtgactaagcctcaggtttttaattttgtgataacaaaataacgaaggcatgtaagacctgattctggaggaacatgaaatttgtcttttctcatgtccagagttctatcctgcccccactgtccactgtagggtcatccgcaaagccctagcagaatgtgctcactccatttccttacacgtttctagcatgggtcagaggaaacaacatttgtgttataacttcgtcttgataggctgtagtgtacatgggatgtaaaacaaacaagtgtatcaaaggtggatgattctgttagagtgaagtttgagagtaaatgtcacttacgtttctcatagataatcaagagttggctgtgtattgactgaaagatgggtaattattttaaatatgcatttacacacatttaggtatcagaagatgcttagggaacaatggataccaatgatagaaaatgatacctttacaggggcagaaaaatccccactcttccttattgcctcttcagaaccctttagaaagtataaaatattgcctccaacatgctgaaaaagagtatctatgcataagtatcagagaagtccctcaagcaatcagtaggtgtgttctatttagagagagtttaaagttctcttagcatcagacaacttgattcctaaggtttccagtgtgtcaccaacaaaaagtgcattgatagggacctttgtctcttcctccctttgattaattgcccggcatcacagtttactagattaccaagtgttacatcatattaaataaaatgtagcagaaccatctgcatcaatatattcctgtttagatttttgcaggagagaagttaaaaggatttgctccttgtatgatgtaagtggcccaccccaattttgtaacatgatgcaagtgtctggcactaagggaagcaagagtagggttgtggaaagaccaagctgatggggagggacttgtttacgggaatttttttagttttccttttcaaaggaaaacattaaaatcccttaggaatttggtattcacatctcagagaactacaacacaaaagtgcagacttatatttgagaattaatgttaaccctttgtgtctagtttgaagcttcttgtatttgtctaaaacaacaagccagaattttgtatctcctttgataaaaagtgtgtataatgtaaagtagttttgcatattcttgtgctgcacatgggctgaatttttaaattttttttaaaaacttgaagcagaaccttgtaatttgtgtaaatgacaagtgtaaaatcctaccataaaatgctaaaaatatgcactgtttcaaataaaaccaagaaatgcagcatta

SEQ ID NO: 21758 - DNA, 2685 bp, Homo sapiens
ggccggcggaggaaggggagggagcgaggagcgcgcgctgctctcgcgtgctctcgcgccgctcgcgtgaccggccggtgtgtgcgcgaggccccggctcccggggcacggacggccgggcgcgcgcctctgcgaggggcgtccgggtccgagtcggcggtccgggccggcgcgaggtgcgtgcgggcgggccgcgggggtcccggacggacacaagcgcacacactcccggaggagccttcgaggctgctcttcctcggccagacggagagcggcactgtctccccgcccagcgctcactcgccccgcgtctccccccgcggcggctgctcctcctcggcaccgccagccccagcgccgctcccgggcgggcgggcggcggcggcggcggcggcgggacccgcggagccgctttgtgtgcagcccgactaggggcggcggcgcaaccacctgacagaggcccgggcgctcgatgcaccttccgcccgcatgaggaggagaggccggtagaggactgtgaaccaaaagttgtcccccaggatggacttcaccgcgcagcccaagcctgccactgccctctgtggcgtcgtgagtgccgacgggaagatcgcttaccctccgggggtaaaagagatcaccgacaagatcaccacggacgagatgatcaaacgcctgaagatggtagtgaaaacctttatggatatggatcaggactcagaagatgaaaaacagcagtatctcccactagccttgcatcttgcatctgaattcttcctcaggaaccccaataaagatgtgcgtctccttgtagcatgttgtttggctgatatctttcgtatctatgccccagaagctccatatacttcccatgataaacttaaggacatatttttgtttattaccagacaattaaaaggtttggaggatacaaagagtccacagtttaatagatacttttatttattagagaatttagcttgggttaaatcatataacatctgctttgaattggaagattgcaatgaaatttttattcagctttttagaactctcttctcagtgatcaacaatagccacaataagaaggtacaaatgcacatgctagatttgatgagttctatcatcatggaaggtgatggagttactcaagaattattggactccattcttattaacctcattcctgcacataagaacttaaataaacagtcctttgaccttgcaaaagtgctattgaaaagaacagtccagactattgaggcatgcattgctaattttttcaatcaagtcctggtgctgggaagatcatcagtaagtgatttgtcagaacatgtatttgatctgattcaggaactttttgctatagatcctcatttattattatccgtcatgccacagcttgaattcaaactaaagagcaatgatggagaagagcgattagctgttgttcgacttctagctaaattgtttggctccaaagattctgatttggcaacacagaatcgtcctctttggcaatgttttcttggacgatttaatgatattcatgttcctgtgagattagaaagtgtgaaatttgccagtcattgtttaatgaatcacccagatttagcgaaggatctcacagaatatttaaaggttagatcacatgatccagaagaagctattcgtcatgatgtcattgttactataataacagctgccaagagggacctggccttagtaaatgatcagctgcttggctttgtaagggaaagaacactggataaacggtggcgagtaagaaaagaagctatgatgggtctggctcagctttataagaaatactgtcttcatggtgaagcaggaaaggaagctgcagagaaagtcagctggataaaggacaaacttctgcatatttattatcagaacagcattgacgacaaactgttggtagagaaaatctttgctcagtatcttgtcccccacaacctggaaacagaagagagaatgaaatgcttatattacttatatgctagtttggatccaaatgctgtaaaagctctcaacgaaatgtggaagtgtcagaacatgcttcggagccatgtacgcgaactattggatttgcacaagcagcctacatcagaggctaactgttctgccatgtttggaaaactgatgaccatagcaaagaatttgcctgaccccgggaaagcacaagattttgtgaagaaatttaaccaggttctcggcgatgatgagaaacttcggtctcagttggagttattaattagcccaacctgttcttgcaaacaagcagatatttgtgtggttagtaaatcatacttcacactttttctctagctttacttacagaaatatgtattttattaaagcctgttttacatacagtgatttgtgtaaatgtaacaatattgtgagctctgaattactttggagtatatctattgtcaagttaattctctatttaccattcactctcagccacattccaggaaaataactaaagaactaagccagggagattggtcttaggaattttacaagataaagtactttgaacttagtagacattcattgagtaatgataagtattttctgaatgcttgtgtacatgtgcattttcttctttcatgtattagaatggaaataatcgtcaataaattagtagtagtaacattgcca

SEQ ID NO: 21759 - DNA, 1452 bp, Homo sapiens
gcccgcgccgcgccgctctttctccgacagccgccgggggtgccctgcaagctgttccgcgcgtcctgcccgtctgtccccgcgggtcgtcgcccgccacagccgcgccatgaccacccagcagatagacctccagggcccggggccgtggggcttccgcctcgtgggcggcaaggacttcgagcagcctctcgccatttcccgggtcactcctggaagcaaggcggctctagctaatttatgtattggagatgtaatcacagccattgatggggaaaatactagcaatatgacacacttggaagctcagaacagaatcaaaggctgcacagacaacttgactctcactgtagccagatctgaacataaagtctggtctcctctggtgacggaggaagggaagcgtcatccatacaagatgaatttagcctctgaaccccaggaggtcctgcacataggaagcgcccacaaccgaagtgccatgccctttaccgcctcgcctgcctccagcactactgccagggtcatcacaaaccagtacaacaacccagctggcctctactcttctgaaaatatctccaacttcaacaatgccctggagtcaaagactgctgccagcggggtggaggcgaacagcagacccttagaccatgctcagcctccaagcagccttgtcatcgacaaagaatctgaagtttacaagatgcttcaggagaaacaggagttgaatgagcccccgaaacagtccacgtctttcttggttttgcaggaaatcctggagtctgaagaaaaaggggatcccaacaagccctcaggattcagaagtgttaaagctcctgtcactaaagtggctgcgtcgattggaaatgctcagaagttgcctatgtgtgacaaatgtggcactgggattgttggtgtgtttgtgaagctgcgggaccgtcaccgccaccctgagtgttatgtgtgcactgactgtggcaccaacctgaaacagaagggccatttctttgtggaggatcaaatctactgtgagaagcatgcccgggagcgagtcacaccacctgagggttatgaagtggtcactgtgttccccaagtgagccagcagatctgaccactgttctccagcaggcctctgctgcagctttttctctcagtgttctggccctctcctctcttgaaagttctctgcttactttggttttccctctgcttgtaaaacattgagtcccctccctgccttggttaattgactcacaccagctgtgcgatgcccgcttttacaattaaaggaaaactgttttgttcagtgtcaccttgtcagcaacactgtgtcccttcgccccaccgttcttctctgctgcatttggacatcagccaaatttgaacccaatcaaatataacgtgtctgacactgattttgtttttactcaataaatgtatagactacaaa

SEQ ID NO: 21760 - DNA, 4592 bp, Homo sapiens
ccgggagctgtggtgccctctccttctccctttggctcctctcctgctgccttacagtgcccccagagccggctaggggcatggacttcacctcctggtcctctcttcctcaggtatggcgttgacggtggatgtggccgggccagcgccctggggcttccgtatcacagggggcagggatttccacacgcccatcatggtgactaaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtctcaggctacgtctccagggcagaccaatggggacagctccttggaagtgctggcgactcgcttccagggctccgtgaggacatacactgagagtcagtcctccttaaggtcctcctactccagcccaacctccctcagcccgagggccggcagccccttctcaccaccaccctctagcagctccctcactggagaggcagccatcagccgcagcttccagagtctggcatgttccccgggcctccccgctgctgaccgcctgtcctactcaggccgccctggaagccgacaggccggcctcggccgcgctggcgactcggcggtgctggtgctgccgccttccccgggccctcgttcctccaggcccagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagaggtggcacgccagccttcttgcccagctcactgagcccccagtcctccctgcccgcctccagggccctggccacccctcccaagctccacacttgtgagaagtgcagtaccagcatcgcgaaccaggctgtgcgcatccaggagggccggtaccgccaccccggctgctacacctgtgccgactgtgggctgaacctgaagatgcgcgggcacttctgggaggacgcttgtgctatggagggaatgagattgtcactggaagctttggaggggatggtggagggcgccaagcggagggacaggaggaagaccaggagacccatccagccaagctggtgagacaacctctgatcctgaggaccggccgcccaccaagggttgggcccccggggccaggttgatctaccgacaccttccacttctttcctgggagagactgctggcttcattggtgattgatttggaggggggaaaaagggcagggtggctcaggctttaggcccaggtactggggaggcctgaggagccctcctggagctcaggaggccgaggctgccttaagctgtgatcatgccactgcattccagcctgggagagagagaggacctgtctgttgaaaaaaacacaaaaacaaatgaatgcatgtggccagtgccaggtgagctgccctgggggttcactggagttgaggcaggggacagtagtctcccctgccagcctaggattttgggcgtcattcacccactacccctagtgctagtcccagaggatgctgcggagggggcagcctcagctctcttttcagagaagatcaaagctgggcttcccagggtgcctggctggtccctgccggcagctttgtgctctccggctctttgtgaaaggaatcttggcgcagatgtttgtgttgcctcctcaggcacctgtagatataatttacaccatgatatcattgtctcaccttttgcctgggtggctgcctgagaaaggtctttctttttatagaaaagatcaaggctgtctggcgcgggactccatgagccccaggcgctggtcagaaacggggtagtctctttggcgccacctagtgtccagtttggcccatggcggggcccattcacggggcaacactgggcttctgggcacagcgggaatacagaaagatacagcactcctcatgccttcctggaggtagaaggccagtggcagcgactgagctggcatgaatgaataagaggatgtggcactgagcgccaagggctaccttggaacgcaccgaggagcgtcccgtgagttcaaagcagtggccgtgatgcaaaaggagggctgggtcttggagacgtggagaagaggaatgctgagtgatggggtggctgctggggggatgcttagctcagagcagtggctgatggggacactgagataagatcggaggggagctgtcaatgccagaagtggtttgaacttccccttgaggctctagggacattttgttttgagacatggtcttgctctattgcccaggctggagtgcagtggtacaatcttagctcactgcagcctccacctcccaggctcaagagatcctcccacagcctcccaggtagctgggactacaggcgtgcaccaccacacccagctaatttttaagtttttttttttttttaagagatggggtctcactatgttgcccaggctggtctcgaacttcgggccccaagccatcctcccaccttggctttccaaagtgttgggattacaagcgtgagctaaccttgcccagcctctgggaacacttggaaggttttaagcagagaagtgacaggttggaaaagatggtttggattattgatatggacagattcccacctgtatgtagcacgccatgctgggccagcagtgtcataggagtggagggggataagtggggactggggacatgtgaaatgatgggcattccagtgaggcatcgaatgccttctgagggctttgtaggttccagctcaaatccccctctggctcttgttctttggtgtggcagccatctctcctcccaggggtcctgagggtttcagcaccagggttctctgcagccacacaatcagcccggctcgggagcaaactcccctggaagaacggagttatgagttggtcagcagaggaggctggggacaggcagtttttggtcttttacctctgatcttgtccccaacctaagccagctagctgcgtgctcccactccctctgccgcacgccgcccgtctatgttcccggactttgtccagtgcagtgccctcttcccttcctgcactgaggagattaactgaagtgacagattagagttagaagtggcccaaaggagcatctggtacaaccccctttggttagagaagggaaagtgacttttccaaagctgcacagctagacagtcataatggctaagctctgggggtgcttttgatgtgctagggatacttccaatgctttaactcacttaatcctcacaacccgagataggtactgttaccatcctctctgcagacgaggaaaccgaggaccaggaggttcagtaaatggtccaagtactcctagctagtaaggaatggatctacagcctgcctcccaggtttctggcttgtggggggcagagtttgtccctctgtcatcagaggcagccttccaggcacagctctggtcacctctggtcacaactggaggtcaccacagccctccccagcgctctgtaggctctcagctttgtgcttcctcccacgggtactagctccagctgagcttgcaggaaacccacttcctgaagccaggacttccccatgggaagtgcaggggccactgggcagcctgagggctgaccctgctcaggacactgtctgtctcaggaactcatggcagtggtttaccttgtcaggagtgcatggacgggctgcccctcccattccttcaagcatcactcagagagccctggcctggctctaggcttgggactgcggctgccacaggaagggggcatccccctactttgggtgttgggtcagatcctgcccccgtgcccgccagggctcaggttcctctgagctggtcctgggccaggacgcatctgcatggcggtggtggggaggaggggtgcgccatggcctggaggggagtgtgtgttggggtgtgtgtgtggaggttcttttgagtcacacacaaagcattgtgctgagacactgcattcctgctggctgggcttcctgtttccagatgcattcctgtcccagagtcaccacagagactgtttggaatcccgccccacattctccaaattcagggcgcgatctggcaaaggctccctcccccaccctcttactttggagggagtctgggctccctcctacccagggagggctggcagggctctggcacggccggggtgtgattccacacatcttcttggtcttgcataaggcagttcctggagacccagcactctggttctctctctgcctgtgagaagcggaatgggtactgtctaggaggactgggcagggtgggggcaacccagaggacccatggctagcagggaagggcctgggcttgaatgtgactctgttgagacatggccagcaattctggcacttggctgtcattcggctggcctgcgcagagattggctgtgggcctcagtttccccattttataaagttttaaaatctg

SEQ ID NO: 21761 - DNA, 2236 bp, Homo sapiens
agacacacccaggcagcccaccctgcccaggacctggggatgcggggcgggagagcgcggccggcgtgggagagctttatggggctgccccctcgatcgtctgcgaagtggggcgcggggcagtccctggaccggctctgctgtgctccgggcagtcgggggcttgcgggcgctccggggaggatgcgggcaccaccggctggacggtcgcagcctgcagggggccctggggacagcctgcctcatccccccggcgggctcgggccaggtggcagcgcctgggctcgccgcgcggaggcggcggcttctcgggctaggggcggcggcaggggcggccccgggatcacatgggcggaggcaggtccgggagccccgggcgggctctccccagagtcgggtagacggcagcgggagcggtggcgtctccccgccttccctccctcccgggcctgggcgcccagccggacaggtgagcggcagccaggtgagcgcgcccacctgcgcctctccgcgcggcccgccctccccggcgccgggctcctctccgcgcccctgtcggcgcggaaccctggcctcgtccgcggcccagctccctggagcctcgcatcagcgggggcgcccccgcgagctgcgctctccccggccggagcgctcctcctccagcccccagcccgcagggtactttgccctcggagcgaaggaggctccagaactggtagagccgggccatcgggctgggcacctccccgcggcgcccgcagcgcggagtccactgaccggctcaaaggtatggcgttgacggtggatgtggccgggccagcgccctggggcttccgtatcacagggggcagggatttccacacgcccatcatggtgactaaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtctcaggctacgtctccagggcagaccaatggggacagctccttggaagtgctggcgactcgcttccagggctccgtgaggacatacactgagagtcagtcctccttaaggtcctcctactccagcccaacctccctcagcccgagggccggcagccccttctcaccaccaccctctagcagctccctcactggagaggcagccatcagccgcagcttccagagtctggcatgttccccgggcctccccgctgctgaccgcctgtcctactcaggccgccctggaagccgacaggccggcctcggccgcgctggcgactcggcggtgctggtgctgccgccttccccgggccctcgttcctccaggcccagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagaggtggcacgccagccttcttgcccagctcactgagcccccagtcctccctgcccgcctccagggccctggccacccctcccaagctccacacttgtgagaagtgcagtaccagcatcgcgaaccaggctgtgcgcatccaggagggccggtaccgccaccccggctgctacacctgtgccgactgtgggctgaacctgaagatgcgcgggcacttctgggtgggtgacgagctgtactgtgagaagcatgcccgccagcgctactccgcacctgccaccctcagctctcgggcctgagcccgccatgccctcagcctgcctcactgctgggccagggtcatgcctatataagttggcatggcagggacaatggtgggcagttgctcttacatgagctaagtttggagacctgaggcccctttgtcctcgctgggtgggccaaggtctgggacctgtcttggactgtgggagactcaccctcaccttgccaggcctctcccctgcaggactggcattgcactagtctgaggtggccactgcctttgatcaacctttgtgtgcgagggtctaagtagggtcgaacacagaagtgggaaggagaggggtgggccaggggctaatggtgtcactgtgtaaagtttttgacatactagctctataaatatatgaatatggacaaaataaa

SEQ ID NO: 21762 - DNA, 1719 bp, Homo sapiens
agagtcgggtagacggcagcgggagcggtggcgtctccccgccttccctccctcccgggcctgggcgcccagccggacaggtgagcggcagccaggtgagcgcgcccacctgcgcctctccgcgcggcccgccctccccggcgccgggctcctctccgcgcccctgtcggcgcggaaccctggcctcgtccgcggcccagctccctggagcctcgcatcagcgggggcgcccccgcgagctgcgctctccccggccggagcgctcctcctccagcccccagcccgcagggtactttgccctcggagcgaaggaggctccagaactggtagagccgggccatcgggctgggcacctccccgcggcgcccgcagcgcggagtccactgaccggctcaaaggtatggcgttgacggtggatgtggccgggccagcgccctggggcttccgtatcacagggggcagggatttccacacgcccatcatggtgactaaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtctcaggctacgtctccagggcagaccaatggggacagctccttggaagtgctggcgactcgcttccagggctccgtgaggacatacactgagagtcagtcctccttaaggtcctcctactccagcccaacctccctcagcccgagggccggcagccccttctcaccaccaccctctagcagctccctcactggagaggcagccatcagccgcagcttccagagtctggcatgttccccgggcctccccgctgctgaccgcctgtcctactcaggccgccctggaagccgacaggccggcctcggccgcgctggcgactcggcggtgctggtgctgccgccttccccgggccctcgttcctccaggcccagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagaggaaccaggctgtgcgcatccaggagggccggtaccgccaccccggctgctacacctgtgccgactgtgggctgaacctgaagatgcgcgggcacttctgggtgggtgacgagctgtactgtgagaagcatgcccgccagcgctactccgcacctgccaccctcagctctcgggcctgagcccgccatgccctcagcctgcctcactgctgggccagggtcatgcctatataagttggcatggcagggacaatggtgggcagttgctcttacatgagctaagtttggagacctgaggcccctttgtcctcgctgggtgggccaaggtctgggacctgtcttggactgtgggagactcaccctcaccttgccaggcctctcccctgcaggactggcattgcactagtctgaggtggccactgcctttgatcaacctttgtgtgcgagggtctaagtagggtcgaacacagaagtgggaaggagaggggtgggccaggggctaatggtgtcactgtgtaaagtttttgacatactagctctataaatatatgaatatgg

SEQ ID NO: 21763 - DNA, 1757 bp, Homo sapiens
agagtcgggtagacggcagcgggagcggtggcgtctccccgccttccctccctcccgggcctgggcgcccagccggacaggtgagcggcagccaggtgagcgcgcccacctgcgcctctccgcgcggcccgccctccccggcgccgggctcctctccgcgcccctgtcggcgcggaaccctggcctcgtccgcggcccagctccctggagcctcgcatcagcgggggcgcccccgcgagctgcgctctccccggccggagcgctcctcctccagcccccagcccgcagggtactttgccctcggagcgaaggaggctccagaactggtagagccgggccatcgggctgggcacctccccgcggcgcccgcagcgcggagtccactgaccggctcaaaggtatggcgttgacggtggatgtggccgggccagcgccctggggcttccgtatcacagggggcagggatttccacacgcccatcatggtgactaaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtctcaggctacgtctccagggcagaccaatggggacagctccttggaagtgctggcgactcgcttccagggctccgtgaggacatacactgagagtcagtcctccttaaggtcctcctactccagcccaacctccctcagcccgagggccggcagccccttctcaccaccaccctctagcagctccctcactggagaggcagccatcagccgcagccggcctcggccgcgctggcgactcggcggtgctggtgctgccgccttccccgggccctcgttcctccaggcccagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagaggtggcacgccagccttcttgcccagctcactgagcccccagtcctccctgcccgcctccagggccctggccacccctcccaagctccacacttgtgagaagtgcagtaccagcatcgcgaaccaggctgtgcgcatccaggagggccggtaccgccaccccggctgctacacctgtgccgactgtgggctgaacctgaagatgcgcgggcacttctgggtgggtgacgagctgtactgtgagaagcatgcccgccagcgctactccgcacctgccaccctcagctctcgggcctgagcccgccatgccctcagcctgcctcactgctgggccagggtcatgcctatataagttggcatggcagggacaatggtgggcagttgctcttacatgagctaagtttggagacctgaggcccctttgtcctcgctgggtgggccaaggtctgggacctgtcttggactgtgggagactcaccctcaccttgccaggcctctcccctgcaggactggcattgcactagtctgaggtggccactgcctttgatcaacctttgtgtgcgagggtctaagtagggtcgaacacagaagtgggaaggagaggggtgggccaggggctaatggtgtcactgtgtaaagtttttgacatactagctctataaatatatgaatatgg

SEQ ID NO: 21764 - DNA, 1837 bp, Homo sapiens
agagtcgggtagacggcagcgggagcggtggcgtctccccgccttccctccctcccgggcctgggcgcccagccggacaggtgagcggcagccaggtgagcgcgcccacctgcgcctctccgcgcggcccgccctccccggcgccgggctcctctccgcgcccctgtcggcgcggaaccctggcctcgtccgcggcccagctccctggagcctcgcatcagcgggggcgcccccgcgagctgcgctctccccggccggagcgctcctcctccagcccccagcccgcagggtactttgccctcggagcgaaggaggctccagaactggtagagccgggccatcgggctgggcacctccccgcggcgcccgcagcgcggagtccactgaccggctcaaaggtatggcgttgacggtggatgtggccgggccagcgccctggggcttccgtatcacagggggcagggatttccacacgcccatcatggtgactaaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtctcaggctacgtctccagggcagaccaatggggacagctccttggaagtgctggcgactcgcttccagggctccgtgaggacatacactgagagtcagtcctccttaaggtcctcctactccagcccaacctccctcagcccgagggccggcagccccttctcaccaccaccctctagcagctccctcactggagaggcagccatcagccgcagcttccagagtctggcatgttccccgggcctccccgctgctgaccgcctgtcctactcaggccgccctggaagccgacaggccggcctcggccgcgctggcgactcggcggtgctggtgctgccgccttccccgggccctcgttcctccaggcccagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagaggtggcacgccagccttcttgcccagctcactgagcccccagtcctccctgcccgcctccagggccctggccacccctcccaagctccacacttgtgagaagtgcagtaccagcatcgcgaaccaggctgtgcgcatccaggagggccggtaccgccaccccggctgctacacctgtgccgactgtgggctgaacctgaagatgcgcgggcacttctgggtgggtgacgagctgtactgtgagaagcatgcccgccagcgctactccgcacctgccaccctcagctctcgggcctgagcccgccatgccctcagcctgcctcactgctgggccagggtcatgcctatataagttggcatggcagggacaatggtgggcagttgctcttacatgagctaagtttggagacctgaggcccctttgtcctcgctgggtgggccaaggtctgggacctgtcttggactgtgggagactcaccctcaccttgccaggcctctcccctgcaggactggcattgcactagtctgaggtggccactgcctttgatcaacctttgtgtgcgagggtctaagtagggtcgaacacagaagtgggaaggagaggggtgggccaggggctaatggtgtcactgtgtaaagtttttgacatactagctctataaatatatgaatatgg

SEQ ID NO: 21765 - DNA, 1491 bp, Homo sapiens
gggagcggtggcgtctccccgccttccctccctcccgggcctgggcgcccagccggacaggtgagcggcagccaggtatggcgttgacggtggatgtggccgggccagcgccctggggcttccgtatcacagggggcagggatttccacacgcccatcatggtgactaaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtctcaggctacgtctccagggcagaccaatggggacagctccttggaagtgctggcgactcgcttccagggctccgtgaggacatacactgagagtcagtcctccttaaggtcctcctactccagcccaacctccctcagcccgagggccggcagccccttctcaccaccaccctctagcagctccctcactggagaggcagccatcagccgcagcttccagagtctggcatgttccccgggcctccccgctgctgaccgcctgtcctactcaggccgccctggaagccgacaggccggcctcggccgcgctggcgactcggcggtgctggtgctgccgccttccccgggccctcgttcctccaggcccagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagaggtggcacgccagccttcttgcccagctcactgagcccccagtcctccctgcccgcctccagggccctggccacccctcccaagctccacacttgtgagaagtgcagtaccagcatcgcgaaccaggctgtgcgcatccaggagggccggtaccgccaccccggctgctacacctgtgccgactgtgggctgaacctgaagatgcgcgggcacttctgggtgggtgacgagctgtactgtgagaagcatgcccgccagcgctactccgcacctgccaccctcagctctcgggcctgagcccgccatgccctcagcctgcctcactgctgggccagggtcatgcctatataagttggcatggcagggacaatggtgggcagttgctcttacatgagctaagtttggagacctgaggcccctttgtcctcgctgggtgggccaaggtctgggacctgtcttggactgtgggagactcaccctcaccttgccaggcctctcccctgcaggactggcattgcactagtctgaggtggccactgcctttgatcaacctttgtgtgcgagggtctaagtagggtcgaacacagaagtgggaaggagaggggtgggccaggggctaatggtgtcactgtgtaaagtttttgacatacta

SEQ ID NO: 21766 - DNA, 1463 bp, Homo sapiens
aagcccctgagtagctgctccgggagctgtggtgccctctccttctccctttggctcctctcctgctgccttacagtgcccccagagccggctaggggcatggacttcacctcctggtcctctcttcctcaggtatggcgttgacggtggatgtggccgggccagcgccctggggcttccgtatcacagggggcagggatttccacacgcccatcatggtgactaaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtctcaggctacgtctccagggcagaccaatggggacagctccttggaagtgctggcgactcgcttccagggctccgtgaggacatacactgagagtcagtcctccttaaggtcctcctactccagcccaacctccctcagcccgagggccggcagccccttctcaccaccaccctctagcagctccctcactggagaggcagccatcagccgcagcttccagagtctggcatgttccccgggcctccccgctgctgaccgcctgtcctactcaggccgccctggaagccgacaggccggcctcggccgcgctggcgactcggcggtgctggtgctgccgccttccccgggccctcgttcctccaggcccagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagaggaaccaggctgtgcgcatccaggagggccggtaccgccaccccggctgctacacctgtgccgactgtgggctgaacctgaagatgcgcgggcacttctgggtgggtgacgagctgtactgtgagaagcatgcccgccagcgctactccgcacctgccaccctcagctctcgggcctgagcccgccatgccctcagcctgcctcactgctgggccagggtcatgcctatataagttggcatggcagggacaatggtgggcagttgctcttacatgagctaagtttggagacctgaggcccctttgtcctcgctgggtgggccaaggtctgggacctgtcttggactgtgggagactcaccctcaccttgccaggcctctcccctgcaggactggcattgcactagtctgaggtggccactgcctttgatcaacctttgtgtgcgagggtctaagtagggtcgaacacagaagtgggaaggagaggggtgggccaggggctaatggtgtcactgtgtaaagtttttgacatactagctctataaatatatgaatatggacaaaataaa

SEQ ID NO: 21767 - DNA, 1487 bp, Homo sapiens
tctcctgctgccttacagtgcccccagagccggctaggggcatggacttcacctcctggtcctctcttcctcaggtatggcgttgacggtggatgtggccgggccagcgccctggggcttccgtatcacagggggcagggatttccacacgcccatcatggtgactaaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtctcaggctacgtctccagggcagaccaatggggacagctccttggaagtgctggcgactcgcttccagggctccgtgaggacatacactgagagtcagtcctccttaaggtcctcctactccagcccaacctccctcagcccgagggccggcagccccttctcaccaccaccctctagcagctccctcactggagaggcagccatcagccgcagcttccagagtctggcatgttccccgggcctccccgctgctgaccgcctgtcctactcaggccgccctggaagccgacaggccggcctcggccgcgctggcgactcggcggtgctggtgctgccgccttccccgggccctcgttcctccaggcccagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagaggtggcacgccagccttcttgcccagctcactgagcccccagtcctccctgcccgcctccagggccctggccacccctcccaagctccacacttgtgagaagtgcagtaccagcatcgcgaaccaggctgtgcgcatccaggagggccggtaccgccaccccggctgctacacctgtgccgactgtgggctgaacctgaagatgcgcgggcacttctgggtgggtgacgagctgtactgtgagaagcatgcccgccagcgctactccgcacctgccaccctcagctctcgggcctgagcccgccatgccctcagcctgcctcactgctgggccagggtcatgcctatataagttggcatggcagggacaatggtgggcagttgctcttacatgagctaagtttggagacctgaggcccctttgtcctcgctgggtgggccaaggtctgggacctgtcttggactgtgggagactcaccctcaccttgccaggcctctcccctgcaggactggcattgcactagtctgaggtggccactgcctttgatcaacctttgtgtgcgagggtctaagtagggtcgaacacagaagtgggaaggagaggggtgggccaggggctaatggtgtcactgtgtaaagtttttgacata

SEQ ID NO: 21768 - DNA, 2084 bp, Homo sapiens
ggtctcattctgttgcccaggctggagtgcagtggtgcgatctcggctcacagcaacctctctgcctccagaaatgacctccaccttcaacccccgagaatgtaaactgtccaagcaagaagggcaaaactatggcttcttcctgcgaattgagaaggacaccgagggccacctggtccgggtggttgagaagtgtagcccagcagagaaggctggccttcaagatggagacagagttcttaggatcaatggtgtctttgtggacaaagaagaacatatgcaggttgtggatctggtcagaaagagtgggaattcagtgactttactagttctggatggggattcctatgagaaagcagtgaaaacacgggtggacttgaaagagttgggtcaaagtcagaaggagcaaggtttgagtgataatatactttcccctgtgatgaatggaggtgtgcaaacttggacccagccccggctctgctatctcgtgaaggaaggaggcagctatggcttctctctgaaaactgtccaaggtaaaaagggggtgtacatgactgatattacacctcaaggtgtggctatgagagctggagttctggctgatgatcacttgattgaagtgaatggagagaatgtagaggatgccagccatgaggaagtggttgaaaaggtgaagaagtcaggaagccgtgtcatgttcctgctggtggacaaagaaactgacaagcgtcatgttgagcagaagatacaattcaaaagagaaacagccagtttgaaactgttaccccaccagccccgaattgtggagatgaagaaaggaagcaatggctatggtttctatctgagggcaggctcagaacagaaaggtcaaatcatcaaggacatagattctggaagtccagcagaggaggctggcttgaagaacaatgatctggtagttgctgtcaacggcgagtctgtggaaaccctggatcatgacagtgtggtagaaatgattagaaagggtggagatcagacttcactgttggtggtagacaaagagacggacaacatgtacagactggctcatttttctccatttctctactatcaaagtcaagaactgcccaatggctctgtcaaggaggctccagctcctactcccacttctctggaagtctcaagtccaccagatactacagaggaagtagatcataagcctaaactctgcaggctggctaaaggtgaaaatggctatggctttcacttaaatgcgattcggggtctgccaggctcattcatcaaagaggtacagaagggcggtcctgctgacttggctgggctagaggatgaggatgtcatcattgaagtgaatggggtgaatgtgctagatgaaccctatgagaaggtggtggatagaatccagagcagtgggaagaatgtcacacttctagtctgtggaaagaaggcctatgattatttccaagctaagaaaatccctattgtttcctccctggctgatccacttgacacccctccagattctaaagaaggaatagtggtggagtcaaaccatgactcgcacatggcaaaagaacgggcccacagtacagcctcacattcttcttccaattctgaagatacagagatgtgatgaaaacaagtaatagctttggctgtttatttgatagctgtttctgggtatttaataggaatcctttctcaaggaatgagttgtgacctgtttactgtctctttagaagaaaaactccactggaaaccattcaccatgtgtgattgtcttctgttatcatttgtcttacaggcggctattgcagacggctaatttatgcttaacttaggaagagataaggcaagagctagatttttttcatgtgatcttttccaagcttcaacttaacttaactacatttctctgtatgatgatgtctcttacttctacaggttccttgagcaccaaagatgattcataactctgtataggtgacagctgcttataaaagcatcttagcagataagcctattaaaattgtgcttttgtaacaatgttgtggttgctagaataaataccattaacaaatgcc

SEQ ID NO: 21769 - DNA, 2032 bp, Homo sapiens
cagagcagctcctcttccatctccagaaatgacctccaccttcaacccccgagaatgtaaactgtccaagcaagaagggcaaaactatggcttcttcctgcgaattgagaaggacaccgagggccacctggtccgggtggttgagaagtgtagcccagcagagaaggctggccttcaagatggagacagagttcttaggatcaatggtgtctttgtggacaaagaagaacatatgcaggttgtggatctggtcagaaagagtgggaattcagtgactttactagttctggatggggattcctatgagaaagcagtgaaaacacgggtggacttgaaagagttgggtcaaagtcagaaggagcaaggtttgagtgataatatactttcccctgtgatgaatggaggtgtgcaaacttggacccagccccggctctgctatctcgtgaaggaaggaggcagctatggcttctctctgaaaactgtccaaggtaaaaagggggtgtacatgactgatattacacctcaaggtgtggctatgagagctggagttctggctgatgatcacttgattgaagtgaatggagagaatgtagaggatgccagccatgaggaagtggttgaaaaggtgaagaagtcaggaagccgtgtcatgttcctgctggtggacaaagaaactgacaagcgtcatgttgagcagaagatacaattcaaaagagaaacagccagtttgaaactgttaccccaccagccccgaattgtggagatgaagaaaggaagcaatggctatggtttctatctgagggcaggctcagaacagaaaggtcaaatcatcaaggacatagattctggaagtccagcagaggaggctggcttgaagaacaatgatctggtagttgctgtcaacggcgagtctgtggaaaccctggatcatgacagtgtggtagaaatgattagaaagggtggagatcagacttcactgttggtggtagacaaagagacggacaacatgtacagactggctcatttttctccatttctctactatcaaagtcaagaactgcccaatggctctgtcaaggaggctccagctcctactcccacttctctggaagtctcaagtccaccagatactacagaggaagtagatcataagcctaaactctgcaggctggctaaaggtgaaaatggctatggctttcacttaaatgcgattcggggtctgccaggctcattcatcaaagaggtacagaagggcggtcctgctgacttggctgggctagaggatgaggatgtcatcattgaagtgaatggggtgaatgtgctagatgaaccctatgagaaggtggtggatagaatccagagcagtgggaagaatgtcacacttctagtctgtggaaagaaggcctatgattatttccaagctaagaaaatccctattgtttcctccctggctgatccacttgacacccctccagattctaaagaaggaatagtggtggagtcaaaccatgactcgcacatggcaaaagaacgggcccacagtacagcctcacattcttcttccaattctgaagatacagagatgtgatgaaaacaagtaatagctttggctgtttatttgatagctgtttctgggtatttaataggaatcctttctcaaggaatgagttgtgacctgtttactgtctctttagaagaaaaactccactggaaaccattcaccatgtgtgattgtcttctgttatcatttgtcttacaggcggctattgcagacggctaatttatgcttaacttaggaagagataaggcaagagctagatttttttcatgtgatcttttccaagcttcaacttaacttaactacatttctctgtatgatgatgtctcttacttctacaggttccttgagcaccaaagatgattcataactctgtataggtgacagctgcttataaaagcatcttagcagataagcctattaaaattgtgcttttgtaacaatgttgtggttgctagaataaataccattaac

SEQ ID NO: 21770 - DNA, 1010 bp, Homo sapiens
gcaaggcagcaggatggaggggtttgtaaaaatgccttccacctaccctgctgggcttgcccgagaggctctgagtgtgtgaaggggaagacaattatcgctaggctggagaatagaaagagcaccatcagtccagtgagttgcaagcctaatgctcacctgcagagacagaattcctgagtgaacgaacagagcagctcctcttccatctccagaaatgacctccaccttcaacccccgagaatgtaaactgtccaagcaagaagggcaaaactatggcttcttcctgcgaattgagaaggacaccgagggccacctggtccgggtggttgagaagtgtagcccagcagagaaggctggccttcaagatggagacagagttcttaggatcaatggtgtctttgtggacaaagaagaacatatgcaggttgtggatctggtcagaaagagtgggaattcagtgactttactagttctggatggggattcctatgagaaagcagtgaaaacacgggtggacttgaaagagttgggtcaaagtcagaaggagcaaggtttgagtgataatatactttcccctgtgatgaatggaggtgtgcaaacttggacccagccccggctctgctatctcgtgaaggaaggaggcagctatggcttctctctgaaaactgtccaaggtaaaaagggggtgtacatgactgatattacacctcaaggtgtggctatgagagctggagttctggctgatgatcacttgattgaagtgaatggagagaatgtagaggatgccagccatgaggaagtggttgaaaaggtgaagaagtcaggaagccgtgtcatgttcctgctggtggacaaagaaactgacaagcgtcatgttgagcagaagatacaattcaaaagagaaacagccagtttgaaactgttaccccaccagccccgaattgtggagatgaagaaaggaagcaatggctatggtttctatctgagggcaggctcagaacagaaag

SEQ ID NO: 21771 - DNA, 1424 bp, Homo sapiens
agagcagctcctcttccatctccagaaatgacctccaccttcaacccccgagaatgtaaactgtccaagcaagaagggcaaaactatggcttcttcctgcgaattgagaaggacaccgagggccacctggtccgggtggttgagaagtgtagcccagcagagaaggctggccttcaagatggagacagagttcttaggatcaatggtgtctttgtggacaaagaagaacatatgcaggttgtggatctggtcagaaagagtgggaattcagtgactttactagttctggatggggattcctatgagaaagcagtgaaaacacgggtggacttgaaagagttgggtcaaagtcagaaggagcaaggtttgagtgataatatactttcccctgtgatgaatggaggtgtgcaaacttggacccagccccggctctgctatctcgtgaaggaaggaggcagctatggcttctctctgaaaactgtccaaggtcaaatcatcaaggacatagattctggaagtccagcagaggaggctggcttgaagaacaatgatctggtagttgctgtcaacggcgagtctgtggaaaccctggatcatgacagtgtggtagaaatgattagaaagggtggagatcagacttcactgttggtggtagacaaagagacggacaacatgtacagactggctcatttttctccatttctctactatcaaagtcaagaactgcccaatggctctgtcaaggaggctccagctcctactcccacttctctggaagtctcaagtccaccagatactacagaggaagtagatcataagcctaaactctgcaggctggctaaaggtgaaaatggctatggctttcacttaaatgcgattcggggtctgccaggctcattcatcaaagaggtacagaagggcggtcctgctgacttggctgggctagaggatgaggatgtcatcattgaagtgaatggggtgaatgtgctagatgaaccctatgagaaggtggtggatagaatccagagcagtgggaagaatgtcacacttctagtctgtggaaagaaggcctatgattatttccaagctaagaaaatccctattgtttcctccctggctgatccacttgacacccctccagattctaaagaaggaatagtggtggagtcaaaccatgactcgcacatggcaaaagaacgggcccacagtacagcctcacattcttcttccaattctgaagatacagagatgtgatgaaaacaagtaatagctttggctgtttatttgatagctgtttctgggtatttaataggaatcctttctcaaggaatgagttgtgacctgtttactgtctctttagaagaaaaactccactggaaaccattcaccatgtgtgattgtcttctgttatcatttgtcttaca

SEQ ID NO: 21772 - DNA, 1043 bp, Homo sapiens
ggagggtcagctcgttgcaccctggcccggcctcttttcgaccctgcggagcatccgcttccggttcccagactgaattgtcagtgagcggagtctgaggtcgctgtggactgcccactgggccttgcccgagatggacagccggattccttatgatgactacccggtggttttcttgcctgcctatgagaatcctccagcatggattcctcctcatgagagggtacaccacccggactacaacaatgagttgacccagtttctgccccgaaccatcacactgaagaagcctcctggagctcagttgggatttaacatccgaggaggaaaggcctcccagctaggcatcttcatctccaaggtgattcctgactctgatgcacatagagcaggactgcaggaaggggaccaagttctagctgtgaatgatgtggatttccaagatattgagcacagcaaggctgttgagatcctgaagacagctcgtgaaatcagcatgcgtgtgcgcttctttccctacaattatcatcgccaaaaagagaggactgtgcactagaaagttgcagcccacagcccttcatgtggactctgtcatgacatgctaactagacttcaggggagccacttctgttttcagcccctccctggaatagtgagttgggaggatggggagacagctaaccaactgcattacccaaaccatattgcacttttagttccctagttttctaggtgagcttcattccctgaaaggaggatgatgatatctaggcataacctagcctgtgaggaacctagttaggaaagacaactgacatttattgaatatcatgcactagtcccttacatatgtcatattttaattatagaaatcagtagcaaaaagaatcttggggattttccatctgacttccctggccatcttatcccatccttgcactaccagaagattcatacacttttgagactccagtgagacgctgttttcaccccttcctcctcctagcctctctcccaaaaagtaaaacacaatgctgaagaaa

SEQ ID NO: 21773 - DNA, 784 bp, Homo sapiens
ttttcgaccctgcggagcatccgcttccggttcccagactgaattgtcagtgagcggagtctgaggtcgctgtggactgcccactggattgtgaaaaatgaggtcctctttctagagtacctgacaggttgcttggcatccagaagatgtttagctaaggccttgcccgagatggacagccggattccttatgatgactacccggtggttttcttgcctgcctatgagaatcctccagcatggattcctcctcatgagagggtacaccacccggactacaacaatgagttgacccagtttctgccccgaaccatcacactgaagaagcctcctggagctcagttgggatttaacatccgaggaggaaaggcctcccagctaggcatcttcatctccaaggtgattcctgactctgatgcacatagagcaggactgcaggaaggggaccaagttctagctgtgaatgatgtggatttccaagatattgagcacagcaaggctgttgagatcctgaagacagctcgtgaaatcagcatgcgtgtgcgcttctttccctacaattatcatcgccaaaaagagaggactgtgcactagaaagttgcagcccacagcccttcatgtggactctgtcatgacatgctaactagacttcaggggagccacttctgttttcagcccctccctggaatagtgagttgggaggatggggagacagctaaccaactgcattacccaaaccatattgcacttttagttccctagttttctaggtgagcttcattcc

SEQ ID NO: 21774 - DNA, 11641 bp, Homo sapiens
gctggagggatcctccattcctgtgtcatttgcatgggtcctgctgtgaaatgaacctggcagggacttgttagacacttccttccttccctcattgagcactccagtgccattgttccacagttgttctaattgggtcctagcttcctcctgccaaggcaaacagcatagtctcgagtaggtgtccctaggctcatctgccagcctgaacatgaacacaggcaaagctgatgatggccagggaccccaggggacgtggggccctgtggggtctggcccccaggagcaagacctctgatgatgctggtgtctgggagtgagcaccatgcccatcacccaggacaatgccgtgctgcacctgcccctcctctaccagtggctgcagaacagcctgcaggaaggtggggatgggccggagcagcggctctgccaggcggccatccagaagctgcaggagtacatccagctgaactttgctgtggatgagagtacggtcccacctgatcacagcccccccgaaatggagatctgtactgtgtacctcaccaaggagctgggggacacagagactgtgggcctgagttttgggaacatccctgttttcggggactatggtgaaaagcgcagggggggcaagaagaggaaaacccaccagggtcctgtgctggatgtgggctgcatctgggtgacagagctgaggaagaacagcccagcagggaagagtgggaaggtccgactgcgggatgagatcctctcactgaatgggcagctgatggttggagttgatgtcagtggggccagttacctggctgagcagtgctggaatggcggctttatctacctgatcatgctgcgtcgctttaagcacaaagcccactccacttataatggcaacagtagcaacagctctgaaccaggagaaacacctaccttggagctgggtgaccgaactgcgaaaaaggggaaacgaaccagaaagtttggggtcatctccaggcctcctgccaacaaggcccctgaagaatccaagggcagcgctggctgtgaggtgtccagtgaccccagcactgagctggagaacggccctgaccctgaacttggaaacggccatgtctttcagctagaaaatggcccagattctctcaaggaggtggctggaccccatctagagaggtcagaagtggacagagggacagagcatagaattccaaagacagatgctcctctgaccacaagcaatgacaaacgccgcttctcaaaaggtgggaagacggacttccaatcgagtgactgcctggcacgggaggaagttggccgaatatggaagatggagctgctcaaagaatcggatgggctgggaattcaggttagtggaggccgaggatcaaagcgctcacctcacgctatcgttgtcactcaagtgaaggaaggaggtgccgctcacagggatggcaggctgtccttaggagatgagctgctggtaatcaatggtcatttactggtcgggctctcccacgaggaagcagtggccattcttcgctccgccacgggaatggtgcagcttgtggtggccagcaaggaaaactccgcagaggacctcctcaggttaacatctaagagcttgccagatctgaccagctcggtagaagatgtgtcctcctggactgataacgaagaccaggaggcagacggggaagaggacgaaggaaccagctcttctgtccagagagcaatgcctgggacagatgaaccccaagatgtgtgcggtgctgaggaatccaaggggaacttggaaagtcccaaacagggcagcaataaaatcaagctcaagagtcgcctttcagggggtgtacaccgccttgagtcagttgaagaatataacgagctgatggtgcggaatggggacccccggatccggatgttggaggtctcccgagatggccggaaacactccctcccgcagctgctggactcttccagtgcctcacaggaataccacattgtgaagaagtctacccgctccttaagcacgactcaggtggaatctccttggaggctcattcggccatccgtcatctcgatcattgggttgtacaaagaaaaaggcaagggccttggctttagtattgctggaggtcgagactgcattcgtggacagatggggatttttgtcaagaccatcttcccaaatggatcagctgcagaggacggaagacttaaagaaggggatgaaatcctagatgtaaatggaataccaataaagggcttgacatttcaagaagccattcatacctttaagcaaatccggagtggattatttgttttaacggtacgcacaaagttggtgagccccagcctcacaccctgctcgacacccacacacatgagcagatccgcctccccgaacttcaataccagtgggggagcctcagcgggaggttccgatgaaggcagttcttcatccctgggtcggaagacccctgggcccaaggacaggatcgtcatggaagtaacactcaacaaagagccaagagttggattaggcattggtgcctgctgcttggctctggaaaacagtcctcctggcatctacattcacagccttgctccaggatcagtggccaagatggagagcaacctgagccgcggggatcaaatcctggaagtgaactccgtcaacgtccgccatgctgctttaagcaaagtccacgccatcttgagtaaatgccctccaggacccgttcgccttgtcatcggccggcaccctaatccaaaggtttccgagcaggaaatggatgaagtcatagcacgcagcacttatcaggagagcaaagaggccaattcctctcctggcttaggtacccccttgaagagtccctctcttgcaaaaaaggactcccttatttctgaatctgaactctcccagtactttgcccacgatgtccctggccccttgtcagacttcatggtggccggttctgaggacgaggatcacccgggaagtggctgcagcacgtcggaggagggcagcctgcctcccagcacctccactcacaaggagcctggaaaacccagagccaacagcctcgtgactcttgggagccatcgggcttctgggctcttccacaagcaggtgacagttgccagacaagccagtctccccggaagcccacaggccctccgaaaccctctcctccgccagaggaaggtaggctgctacgatgccaacgatgccagtgatgaggaagagtttgacagagaaggggactgcatttcactcccaggggccctcccgggtcccatcaggcctctgtcagaggatgacccgaggcgtgtctcaatttcctcttccaagggcatggacgtccacaaccaagaggaacgaccccggaaaacactggtgagcaaggccatctcggcacctcttcttggtagctcagtggacttagaggagagtatcccagagggcatggtggatgctgcgtcctatgcagccaacctcacggactctgcagaggcccccaaggggagccctggaagctggtggaagaaggaactgtcaggatcaagtagcgcacccaaattggaatacacagtccgtacagacacccagagtccgacgaacactgggagccccagttccccccagcagaaaagtgaaggcctgggctccaggcacagaccagtggccagggtaagcccccactgcaagagatccgaggctgaggccaagcccagtggctcacagacagtgaacctgactggcagagccaatgatccatgcgatctggactcgagagtccaggccacttctgtcaaagtgactgtcgctggctttcagccaggtggagctgtggagaaggaatctctgggaaagctgaccactggagatgcttgtgtctctaccagctgtgaactagccagtgctctgtcccatctggatgccagccacctcacagagaacctgcccaaagctgcatcagagctggggcaacaacccatgactgaactggacagctcctcagacctcatctcttccccagggaagaagggggccgctcatcctgaccccagcaagacctctgtagacacagggcaagtcagtcggccagagaatcccagccagcctgcatcgcccagggtcaccaagtgcaaggccaggtctccagtcaggctcccccatgagggcagcccctccccgggggagaaagcagcggctccccctgactacagcaagactcgatcagcatcggaaaccagcacaccccacaataccaggagggtggctgccctcaggggagcgggacctggagcagagggaatgacaccagctggtgctgtcctgccaggagaccccctcacatcccaggagcagagacagggagctccaggtaaccacagtaaggctctggaaatgacaggaatccatgcacctgaaagctcccaggagccttccctgctggagggagcagattctgtgtcctcaagggcaccgcaggccagcctctccatgctgccatccactgacaacaccaaagaagcatgtggccatgtctcggggcactgctgcccaggggggagtagagagagccctgtgacggacattgacagcttcatcaaggagctggatgcttctgcagcaaggtctccgtcttcccagacgggggacagtggctctcaggagggcagtgctcagggccacccaccagccggggctggaggtgggagctcctgccgtgccgaaccagtcccggggggccagacctcctccccgaggagggcctgggctgctggtgcccccgcctacccacaatgggcctcccagccttcggttttagattcaattaatcccgacaaacattttactgtgaacaaaaactttctgagcaactactctagaaattttagcagttttcatgaagacagcacctccctatcaggcctgggtgacagcacggagccgtctctgtcatccatgtatggcgatgctgaggattcttcttctgaccctgagtcactcactgaagccccacgagcttctgccagggacggctggtcccctcctcgttcccgtgtgtctttgcacaaggaagatccttcggagtcagaagaggaacagattgagatttgttccacacgtggctgccccaatccaccctcgagtcctgctcatcttcccacccaggctgccatctgtcctgcctcagccaaagttctgtcattaaaatacagcactccgagagagtcggtggccagtccccgtgagaaggccgcctgcttgccaggctcatacacttcaggcccagactcttcccagccatcatcactcttggagatgagctctcaggagcatgaaactcatgcggacataagcacttcacagaaccacaggccctcgtgtgcagaagaaaccacagaagtcaccagcgctagctcagccatggaaaacagtccgctgtctaaagtagccaggcattttcacagtccgcccatcattctcagctcccccaacatggtaaatggcttggaacatgacctgctagatgacgaaaccctgaatcaatacgaaacaagcattaatgcagctgccagtctgtcctccttcagtgtggatgtccctaagaatggagaatctgttttggaaaacctccacatctctgaaagtcaagacctggatgacttgctacagaaaccaaaaatgatcgctaggaggcccatcatggcctggtttaaagaaataaataaacataaccaaggcacacatttgaggagcaaaaccgagaaggaacaacctctaatgcctgccagaagtcccgactccaagattcagatggtgagttcaagccaaaaaaagggcgttactgtgcctcatagccctcctcagccgaaaacaaacctggaaaataaggacctgtctaagaagagtccggcagaaatgcttctgactaatggtcagaaggcaaagtgtggtccgaagctgaagaggctcagcctcaagggcaaggccaaagtcaactctgaggcccctgctgcgaatgctgtgaaggctggggggacggaccacaggaaacccttgatctcaccccagacctcccacaaaacactttctaaggcagtgtcacagcggctccatgtagccgaccacgaggaccctgacagaaacaccacagctgcccccaggtccccccagtgtgtgctggaaagcaagccacctcttgccacctctgggccactgaaaccctcagtgtctgacacgagcatcaggacatttgtctcgcccctgacctctcccaagcctgttcctgagcaaggcatgtggagcaggttccacatggctgtcctctctgaacccgacagaggttgcccaaccacccctaaatctcctaagtgtagagcagagggcagggcgccccgtgctgactccgggccggtgagtccggcagcgtctaggaacggcatgtccgtggcagggaacagacagagtgagccgcgcctggccagccatgtggcagcagacacagcccaacccaggccgactggcgaaaaaggaggcaacataatggccagcgatcgcctcgaaagaacaaaccagctgaaaatcgtggagatttctgctgaagcagtgtcagagactgtatgtggtaacaagccagctgaaagcgacagacggggagggtgcttggcccagggcaactgtcaggagaagagtgaaatcaggctctatcgccaggtcgcagaatcatccacaagtcatccatcctcactcccatctcatgcctcccaggcagagcaggaaatgtcacgatcattcagcatggcaaaactggcgtcctcctcctcctcccttcaaacagccattagaaaggcagaatactcccagggaaaatcaagcctgatgtcagactcccgaggggtgcccagaaacagcattccagggggcccctcgggggaggaccatctctacttcaccccaaggccagcgaccaggacctactccatgccagcccagttctcaagccattttggacgggagggtcaccccccacacagcctgggtcgctctcgggacagccaggtccctgtgacaagcagtgttgtccccgaggcaaaggcatccagaggtggtcttcccagcctggctaatggacagggcatatatagtgtaaagccgctgctggacacatcgaggaatcttccagccacagatgaaggggatatcatttcagtccaggagacgagctgcctagtcacagacaaaatcaaagtcaccagacgacactactgctatgagcagaactggccccatgaatctacctcatttttctctgtgaagcagcggatcaagtcttttgagaacctggccaatgctgaccggcctgtagccaagtccggggcttccccatttttgtcggtgagctccaagcctcccattgggaggcggtcttccggcagcattgtttccgggagcctgggccacccaggtgacgcagcagcaaggttgttgagacgcagcttgagttcctgcagcgaaaaccaaagcgaagccggcaccctcctgccccagatggccaagtctccctcaatcatgacactgaccatctctcggcagaacccaccagagaccagtagcaagggctctgattcggaactaaagaaatcacttggtcctttgggaattcccaccccaacgatgaccctggcttctcctgttaagaggaacaagtcctcggtacgccacacgcagccctcgcccgtgtcccgctccaagctccaggagctgagagccttgagcatgcctgaccttgacaagctctgcagcgaggattactcagcagggccgagcgccgtgctcttcaaaactgagctggagatcacccccaggaggtcacctggccctcctgctggaggcgtttcgtgtcccgagaagggcgggaacagggcctgtccaggaggaagtggccctaaaaccagtgctgctgagacacccagttcagccagtgatacgggtgaagctgcccaggatctgccttttagaagaagctggtcagttaatttggatcaacttctagtctcagcgggggaccagcaaagattacagtctgttttatcgtcagtgggatcgaaatctaccatcctaactctcattcaggaagcgaaagcacaatcagagaatgaagaagatgtttgcttcatagtcttgaatagaaaagaaggctcaggtctgggattcagtgtggcaggagggacagatgtggagccaaaatcaatcacggtccacagggtgttttctcagggggcggcttctcaggaagggactatgaaccgaggggatttccttctgtcagtcaacggcgcctcactggctggcttagcccacgggaatgtcctgaaggttctgcaccaggcacagctgcacaaagatgccctcgtggtcatcaagaaagggatggatcagcccaggccctctgcccggcaggagcctcccacagccaatgggaagggtttgctgtccagaaagaccatccccctggagcctggcattgggagaagtgtggctgtacacgatgctctgtgtgttgaagtgctgaagacctcggctgggctgggactgagtctggatgggggaaaatcatcggtgacgggagatgggcccttggtcattaaaagagtgtacaaaggtggtgcggctgaacaagctggaataatagaagctggagatgaaattcttgctattaatgggaaacctctggttgggctcatgcactttgatgcctggaatattatgaagtctgtcccagaaggacctgtgcagttattaattagaaagcataggaattcttcatgaattttaacaagaatcattttctcagttctcttctttctttagcaaatcagagtgacttctttaaaccacaggttgttgaaatggccaacactggtacagacacggactataaaaatctccaagcttgtgcttacacatgaagcctgacttaactgtatgtgcaacagcaatgaaattaactccagaagccttccacctgcgtcacccaggccgggagggttccttcgttccagtgcctgtcccctacctttatgttatgtttactgatggggatacaagatgtgacacacccttctttatttgaaacaaacaaacatttagctagacctttgcttccttcttgccagctctcccaacatacccaatcctggtgatcagggaactaaaagtctgagggggacacaaatgtcacacctaagaggacaatcaatcattttgtatgattttgtaagtaaatgacagaatgcttttaggcacattcaatggaaggaggagatgtaggtctgtatatgttaccctgaaaagagaataagacttacttaaaaaaatgaattatgacctgttaggctgagctcaggaattgtccaaaaaggaaaaagcaaaataattaattgagagtattttttagtgagtgtaatgtataatgtacgtatgcaaagttcaactcaataggttattgatcaccatgaagtattgatcattttctatctcaaaagtgtaagccataaggctgttttacagaatagcacttctgataagctgtattaaatagccatgagcttcactgcttagagggagcagaaaggtcaacatctaaaagcaccttacaactagtttttgaacctgtcttgataagtgcttgaattcaagactggtcagtccaagagcagacaaaaatatcacaagtcagtcagtcactgggtttccatttctgaattttatgcactccaaccatgaatttaaactaaatttttagaaatcaagtatctttctaagtgtccttggatttatagacaatgtatgtacaatccaaatagaggagcttaatggaatccttttaggagactggttggtttttttccctctttcccaacatgtttaagaaatgtaacattctaagtattggatctcttttcttgacctagtataatgacaactgcagtgacttaagtttttgctgttttcgttttcccgctttgcaatttcctccttttgccaaaaatgttttcctacagaagactgtcgtgactcacgctacttgggaaactcactctggccactcctcctctggtggcatgagctgcttcccagtagctattccgattggatattccgttcgtcgtcacatagctggcttttctctcctcatgatgtaccttattttcttaggtaaataattccaaactctcatcgggtcataaagaggaggagaaacagggtgagtcaaggtaaaggagcagaaatgtagttacaagccaggtcgtcttcagtggcacaaaccaacccgttgagccctgacaacatgagtggagagtgcatttgccatacctgtgtgcatgacactaagattttatgttggagatacttctttaaataacctacagcttgggtctatggctgtgacccccagattcatggaggggctttagccatcagctttgtacatcatcatttttctgaatgaccaatcccactaaacatctttgaagtcggcctagagaggtccttcagatgagagagaaatagctggcttgtctgagtccagatttctcatcaactggcaatacaaaggaaaatatggtacaggagttagttagaaaggtcttattgattttacttctacttttcactacagttacaggtagaatactgtaggaagtcagtgcaaggtgcatgcttgattgatagatattgattgattgtttttcagtctctggggtcagttttgtggtttctgctttcttgcctaaatcaaagactatttcaagtcaacaacactgaaaactgcttttcgcctccactcttacagctgtgcctaataataattaattaataaacgcacagccctatgtgaacagacaggaatttcttgtgcaatgtggagcaaatggaatggtctccttccgcaagtctttttaatcctcatatctggagtacaagggtagacctctggcttaccacatacactatgctaaagtcatcagccactgctactacatcttgccagaaggtttccctcgccaacaaacagttgaaatttaagggaagaagcaaaagctaaactgtctttgaccctaagatagatagaaagctatttatttgtcttcagtgttcaaggcatgactagtatttctaattagcctaataaattcccacactttctgaagtgaacactaatggtattgtcctactaaaactgtcattgtttctttttttttaactggtcagtcattcacaataagctatgagggtaaataaatatgtgttataacaagtaaaccgtagttgcaagaatataccatgaagattaaagtaggctgggtttcatttccatcttcccacacatctcattgaatttgatggttgacttaattggcaccataactttgtatgatattatacattaacctttatttatgtaaagtaaaatgccttatatattaaagagtaagtgcaataatatgaaatagcctgtacattttaaaaatgttgtcaccaagttatataaatccacatctctgtaaacaaccttttttaagtaattttaaaaaaaataaacactctgcttactacttg

SEQ ID NO: 21775 - DNA, 11107 bp, Homo sapiens
gcgggagcctcggccaagccgcgagcaggtgtgaatgagcccagggaaggacacacggccactgctggagggatcctccattcctgtgtcatttgcatgggtcctgctgtgaaatgaacctggcagggacttgttagacacttccttccttccctcattgagcactccagtgccattgttccacagttgttctaattgggtcctagcttcctcctgccaaggcaaacagcatagtctcgagtaggtgtccctaggctcatctgccagcctgaacatgaacacaggcaaagctgatgatggccagggaccccaggggacgtggggccctgtggggtctggcccccaggagcaagacctctgatgatgctggtgtctgggagtgagcaccatgcccatcacccaggacaatgccgtgctgcacctgcccctcctctaccagtggctgcagaacagcctgcaggaaggtggggatgggccggagcagcggctctgccaggcggccatccagaagctgcaggagtacatccagctgaactttgctgtggatgagagtacggtcccacctgatcacagcccccccgaaatggagatctgtactgtgtacctcaccaaggagctgggggacacagagactgtgggcctgagttttgggaacatccctgttttcggggactatggtgaaaagcgcagggggggcaagaagaggaaaacccaccagggtcctgtgctggatgtgggctgcatctgggtgacagagctgaggaagaacagcccagcagggaagagtgggaaggtccgactgcgggatgagatcctctcactgaatgggcagctgatggttggagttgatgtcagtggggccagttacctggctgagcagtgctggaatggcggctttatctacctgatcatgctgcgtcgctttaagcacaaagcccactccacttataatggcaacagtagcaacagctctgaaccaggagaaacacctaccttggagctgggtgaccgaactgcgaaaaaggggaaacgaaccagaaagtttggggtcatctccaggcctcctgccaacaaggcccctgaagaatccaagggcagcgctggctgtgaggtgtccagtgaccccagcactgagctggagaacggccctgaccctgaacttggaaacggccatgtctttcagctagaaaatggcccagattctctcaaggaggtggctggaccccatctagagaggtcagaagtggacagagggacagagcatagaattccaaagacagatgctcctctgaccacaagcaatgacaaacgccgcttctcaaaaggtgggaagacggacttccaatcgagtgactgcctggcacgggaggaagttggccgaatatggaagatggagctgctcaaagaatcggatgggctgggaattcaggttagtggaggccgaggatcaaagcgctcacctcacgctatcgttgtcactcaagtgaaggaaggaggtgccgctcacagggaataccacattgtgaagaagtctacccgctccttaagcacgactcaggtggaatctccttggaggctcattcggccatccgtcatctcgatcattgggttgtacaaagaaaaaggcaagggccttggctttagtattgctggaggtcgagactgcattcgtggacagatggggatttttgtcaagaccatcttcccaaatggatcagctgcagaggacggaagacttaaagaaggggatgaaatcctagatgtaaatggaataccaataaagggcttgacatttcaagaagccattcatacctttaagcaaatccggagtggattatttgttttaacggtacgcacaaagttggtgagccccagcctcacaccctgctcgacacccacacacatgagcagatccgcctccccgaacttcaataccagtgggggagcctcagcgggaggttccgatgaaggcagttcttcatccctgggtcggaagacccctgggcccaaggacaggatcgtcatggaagtaacactcaacaaagagccaagagttggattaggcattggtgcctgctgcttggctctggaaaacagtcctcctggcatctacattcacagccttgctccaggatcagtggccaagatggagagcaacctgagccgcggggatcaaatcctggaagtgaactccgtcaacgtccgccatgctgctttaagcaaagtccacgccatcttgagtaaatgccctgtttccgagcaggaaatggatgaagtcatagcacgcagcacttatcaggagagcaaagaggccaattcctctcctggcttaggtacccccttgaagagtccctctcttgcaaaaaaggactcccttatttctgaatctgaactctcccagtactttgcccacgatgtccctggccccttgtcagacttcatggtggccggttctgaggacgaggatcacccgggaagtggctgcagcacgtcggaggagggcagcctgcctcccagcacctccaaggagcctggaaaacccagagccaacagcctcgtgactcttgggagccatcgggcttctgggctcttccacaagcaggtgacagttgccagacaagccagtctccccggaagcccacaggccctccgaaaccctctcctccgccagaggaaggtaggctgctacgatgccaacgatgccagtgatgaggaagagtttgacagagaaggggactgcatttcactcccaggggccctcccgggtcccatcaggcctctgtcagaggatgacccgaggcgtgtctcaatttcctcttccaagggcatggacgtccacaaccaagaggaacgaccccggaaaacactggtgagcaaggccatctcggcacctcttcttggtagctcagtggacttagaggagagtatcccagagggcatggtggatgctgcgtcctatgcagccaacctcacggactctgcagaggcccccaaggggagccctggaagctggtggaagaaggaactgtcaggatcaagtagcgcacccaaattggaatacacagtccgtacagacacccagagtccgacgaacactgggagccccagttccccccagcagaaaagtgaaggcctgggctccaggcacagaccagtggccagggtaagcccccactgcaagagatccgaggctgaggccaagcccagtggctcacagacagtgaacctgactggcagagccaatgatccatgcgatctggactcgagagtccaggccacttctgtcaaagtgactgtcgctggctttcagccaggtggagctgtggagaagttgtgccaggaatctctgggaaagctgaccactggagatgcttgtgtctctaccagctgtgaactagccagtgctctgtcccatctggatgccagccacctcacagagaacctgcccaaagctgcatcagagctggggcaacaacccatgactgcctcagacctcatctcttccccagggaagaagggggccgctcatcctgaccccagcaagacctctgtagacacagggcaagtcagtcggccagagaatcccagccagcctgcatcgcccagggtcaccaagtgcaaggccaggtctccagtcaggctcccccatgagggcagcccctccccgggggagaaagcagcggctccccctgactacagcaagactcgatcagcatcggaaaccagcacaccccacaataccaggagggtggctgccctcaggggagcgggacctggagcagagggaatgacaccagctggtgctgtcctgccaggagaccccctcacatcccaggagcagagacagggagctccaggtaaccacagtaaggctctggaaatgacaggaatccatgcacctgaaagctcccaggagccttccctgctggagggagcagattctgtgtcctcaagggcaccgcaggccagcctctccatgctgccatccactgacaacaccaaagaagcatgtggccatgtctcggggcactgctgcccaggggggagtagagagagccctgtgacggacattgacagcttcatcaaggagctggatgcttctgcagcaaggtctccgtcttcccagacgggggacagtggctctcaggagggcagtgctcagggccacccaccagccggggctggaggtgggagctcctgccgtgccgaaccagtcccggggggccagacctcctccccgaggagggcctgggctgctggtgcccccgcctacccacaatgggcctcccagccttcggttttagattcaattaatcccgacaaacattttactgtgaacaaaaactttctgagcaactactctagaaattttagcagttttcatgaagacagcacctccctatcaggcctgggtgacagcacggagccgtctctgtcatccatgtatggcgatgctgaggattcttcttctgaccctgagtcactcactgaagccccacgagcttctgccagggacggctggtcccctcctcgttcccgtgtgtctttgcacaaggaagatccttcggagtcagaagaggaacagattgagatttgttccacacgtggctgccccaatccaccctcgagtcctgctcatcttcccacccaggctgccatctgtcctgcctcagccaaagttctgtcattaaaatacagcactccgagagagtcggtggccagtccccgtgagaaggccgcctgcttgccaggctcatacacttcaggcccagactcttcccagccatcatcactcttggagatgagctctcaggagcatgaaactcatgcggacataagcacttcacagaaccacaggccctcgtgtgcagaagaaaccacagaagtcaccagcgctagctcagccatggaaaacagtccgctgtctaaagtagccaggcattttcacagtccgcccatcattctcagctcccccaacatggtaaatggcttggaacatgacctgctagatgacgaaaccctgaatcaatacgaaacaagcattaatgcagctgccagtctgtcctccttcagtgtggatgtccctaagaatggagaatctgttttggaaaacctccacatctctgaaagtcaagacctggatgacttgctacagaaaccaaaaatgatcgctaggaggcccatcatggcctggtttaaagaaataaataaacataaccaaggcacacatttgaggagcaaaaccgagaaggaacaacctctaatgcctgccagaagtcccgactccaagattcagatggtgagttcaagccaaaaaaagggcgttactgtgcctcatagccctcctcagccgaaaacaaacctggaaaataaggacctgtctaagaagagtccggcagaaatgcttctgactaatggtcagaaggcaaagtgtggtccgaagctgaagaggctcagcctcaagggcaaggccaaagtcaactctgaggcccctgctgcgaatgctgtgaaggctggggggacggaccacaggaaacccttgatctcaccccagacctcccacaaaacactttctaaggcagtgtcacagcggctccatgtagccgaccacgaggaccctgacagaaacaccacagctgcccccaggtccccccagtgtgtgctggaaagcaagccacctcttgccacctctgggccactgaaaccctcagtgtctgacacgagcatcaggacatttgtctcgcccctgacctctcccaagcctgttcctgagcaaggcatgtggagcaggttccacatggctgtcctctctgaacccgacagaggttgcccaaccacccctaaatctcctaagtgtagagcagagggcagggcgccccgtgctgactccgggccggtgagtccggcagcgtctaggaacggcatgtccgtggcagggaacagacagagtgagccgcgcctggccagccatgtggcagcagacacagcccaacccaggccgactggcgaaaaaggaggcaacataatggccagcgatcgcctcgaaagaacaaaccagctgaaaatcgtggagatttctgctgaagcagtgtcagagactgtatgtggtaacaagccagctgaaagcgacagacggggagggtgcttggcccagggcaactgtcaggagaagagtgaaatcaggctctatcgccaggtcgcagaatcatccacaagtcatccatcctcactcccatctcatgcctcccaggcagagcaggaaatgtcacgatcattcagcatggcaaaactggcgtcctcctcctcctcccttcaaacagccattagaaaggcagaatactcccagggaaaatcaagcctgatgtcagactcccgaggggtgcccagaaacagcattccagggggcccctcgggggaggaccatctctacttcaccccaaggccagcgaccaggacctactccatgccagcccagttctcaagccattttggacgggagggtcaccccccacacagcctgggtcgctctcgggacagccaggtccctgtgacaagcagtgttgtccccgaggcaaaggcatccagaggtggtcttcccagcctggctaatggacagggcatatatagtgtaaagccgctgctggacacatcgaggaatcttccagccacagatgaaggggatatcatttcagtccaggagacgagctgcctagtcacagacaaaatcaaagtcaccagacgacactactgctatgagcagaactggccccatgaatctacctcatttttctctgtgaagcagcggatcaagtcttttgagaacctggccaatgctgaccggcctgtagccaagtccggggcttccccatttttgtcggtgagctccaagcctcccattgggaggcggtcttccggcagcattgtttccgggagcctgggccacccaggtgacgcagcagcaaggttgttgagacgcagcttgagttcctgcagcgaaaaccaaagcgaagccggcaccctcctgccccagatggccaagtctccctcaatcatgacactgaccatctctcggcagaacccaccagagaccagtagcaagggctctgattcggaactaaagaaatcacttggtcctttgggaattcccaccccaacgatgaccctggcttctcctgttaagaggaacaagtcctcggtacgccacacgcagccctcgcccgtgtcccgctccaagctccaggagctgagagccttgagcatgcctgaccttgacaagctctgcagcgaggattactcagcagggccgagcgccgtgctcttcaaaactgagctggagatcacccccaggaggtcacctggccctcctgctggaggcgtttcgtgtcccgagaagggcgggaacagggcctgtccaggaggaagtggccctaaaaccagtgctgctgagacacccagttcagccagtgatacgggtgaagctgcccaggatctgccttttagaagaagctggtcagttaatttggatcaacttctagtctcagcgggggaccagcaaagattacagtctgttttatcgtcagtgggatcgaaatctaccatcctaactctcattcaggaagcgaaagcacaatcagagaatgaagaagatgtttgcttcatagtcttgaatagaaaagaaggctcaggtctgggattcagtgtggcaggagggacagatgtggagccaaaatcaatcacggtccacagggtgttttctcagggggcggcttctcaggaagggactatgaaccgaggggatttccttctgtcagtcaacggcgcctcactggctggcttagcccacgggaatgtcctgaaggttctgcaccaggcacagctgcacaaagatgccctcgtggtcatcaagaaagggatggatcagcccaggccctctgcccggcaggagcctcccacagccaatgggaagggtttgctgtccagaaagaccatccccctggagcctggcattgggagaagtgtggctgtacacgatgctctgtgtgttgaagtgctgaagacctcggctgggctgggactgagtctggatgggggaaaatcatcggtgacgggagatgggcccttggtcattaaaagagtgtacaaaggtggtgcggctgaacaagctggaataatagaagctggagatgaaattcttgctattaatgggaaacctctggttgggctcatgcactttgatgcctggaatattatgaagtctgtcccagaaggacctgtgcagttattaattagaaagcataggaattcttcatgaattttaacaagaatcattttctcagttctcttctttctttagcaaatcagagtgacttctttaaaccacaggttgttgaaatggccaacactggtacagacacggactataaaaatctccaagcttgtgcttacacatgaagcctgacttaactgtatgtgcaacagcaatgaaattaactccagaagccttccacctgcgtcacccaggccgggagggttccttcgttccagtgcctgtcccctacctttatgttatgtttactgatggggatacaagatgtgacacacccttctttatttgaaacaaacaaacatttagctagacctttgcttccttcttgccagctctcccaacatacccaatcctggtgatcagggaactaaaagtctgagggggacacaaatgtcacacctaagaggacaatcaatcattttgtatgattttgtaagtaaatgacagaatgcttttaggcacattcaatggaaggaggagatgtaggtctgtatatgttaccctgaaaagagaataagacttacttaaaaaaatgaattatgacctgttaggctgagctcaggaattgtccaaaaaggaaaaagcaaaataattaattgagagtattttttagtgagtgtaatgtataatgtacgtatgcaaagttcaactcaataggttattgatcaccatgaagtattgatcattttctatctcaaaagtgtaagccataaggctgttttacagaatagcacttctgataagctgtattaaatagccatgagcttcactgcttagagggagcagaaaggtcaacatctaaaagcaccttacaactagtttttgaacctgtcttgataagtgcttgaattcaagactggtcagtccaagagcagacaaaaatatcacaagtcagtcagtcactgggtttccatttctgaattttatgcactccaaccatgaatttaaactaaatttttagaaatcaagtatctttctaagtgtccttggatttatagacaatgtatgtacaatccaaatagaggagcttaatggaatccttttaggagactggttggtttttttccctctttcccaacatgtttaagaaatgtaacattctaagtattggatctcttttcttgacctagtataatgacaactgcagtgacttaagtttttgctgttttcgttttcccgctttgcaatttcctccttttgccaaaaatgttttcctacagaagactgtcgtgactcacgctacttgggaaactcactctggccactcctcctctggtggcatgagctgcttcccagtagctattccgattggatattccgttcgtcgtcacatagctggcttttctctcctcatgatgtaccttattttcttaggtaaataattccaaactctcatcgggtcataaagaggaggagaaacagggtgagtcaaggtaaaggagcagaaatgtagttacaagccaggtcgtcttcagtggcacaaaccaacccgttgagccctgacaacatgagtggagagtgcatttgccatacctgtgtgcatgacactaagattttatgttggagatacttctttaaataacctacagcttgggtctatggctgtgacccccagattcatggaggggctttagccatcagctttgtacatcatcatttttctgaatgaccaatcccactaaacatctttgaagtcggcctagagaggtccttcagatgagagagaaatagctggcttgtctgagtccagatttctcatcaactggcaatacaaaggaaaatatggtacaggagttagttagaaaggtcttattgattttacttctacttttcactacagttacaggtagaatactgtaggaagtcagtgcaaggtgcatgcttgattgatagatattgattgattgtttttcagtctctggggtcagttttgtggtttctgctttcttgcctaaatcaaagactatttcaagtcaacaacactgaaaactgcttttcgcctccactcttacagctgtgcctaataataattaattaataaacgcacagccctatgtgaacagacaggaatttcttgtgcaatgtggagcaaatggaatggtctccttccgcaagtctttttaatcctcatatctggagtacaagggtagacctctggcttaccacatacactatgctaaagtcatcagccactgctactacatcttgccagaaggtttccctcgccaacaaacagttgaaatttaagggaagaagcaaaagctaaactgtctttgaccctaagatagatagaaagctatttatttgtcttcagtgttcaaggcatgactagtatttctaattagcctaataaattcccacactttctgaagtgaacactaatggtattgtcctactaaaactgtcattgtttctttttttttaactggtcagtcattcacaataagctatgagggtaaataaatatgtgttataacaagtaaaccgtagttgcaagaatataccatgaagattaaagtaggctgggtttcatttccatcttcccacacatctcattgaatttgatggttgacttaattggcaccataactttgtatgatattatacattaacctttatttatgtaaagtaaaatgccttatatattaaagagtaagtgcaataatatgaaatagcctgtacattttaaaaatgttgtcaccaagttatataaatccacatctctgtaaacaaccttttttaagtaattttaaaaaaaataaacactctgcttactacttg

SEQ ID NO: 21776 - DNA, 11704 bp, Homo sapiens
gcgggagcctcggccaagccgcgagcaggtgtgaatgagcccagggaaggacacacggccactgctggagggatcctccattcctgtgtcatttgcatgggtcctgctgtgaaatgaacctggcagggacttgttagacacttccttccttccctcattgagcactccagtgccattgttccacagttgttctaattgggtcctagcttcctcctgccaaggcaaacagcatagtctcgagtaggtgtccctaggctcatctgccagcctgaacatgaacacaggcaaagctgatgatggccagggaccccaggggacgtggggccctgtggggtctggcccccaggagcaagacctctgatgatgctggtgtctgggagtgagcaccatgcccatcacccaggacaatgccgtgctgcacctgcccctcctctaccagtggctgcagaacagcctgcaggaaggtggggatgggccggagcagcggctctgccaggcggccatccagaagctgcaggagtacatccagctgaactttgctgtggatgagagtacggtcccacctgatcacagcccccccgaaatggagatctgtactgtgtacctcaccaaggagctgggggacacagagactgtgggcctgagttttgggaacatccctgttttcggggactatggtgaaaagcgcagggggggcaagaagaggaaaacccaccagggtcctgtgctggatgtgggctgcatctgggtgacagagctgaggaagaacagcccagcagggaagagtgggaaggtccgactgcgggatgagatcctctcactgaatgggcagctgatggttggagttgatgtcagtggggccagttacctggctgagcagtgctggaatggcggctttatctacctgatcatgctgcgtcgctttaagcacaaagcccactccacttataatggcaacagtagcaacagctctgaaccaggagaaacacctaccttggagctgggtgaccgaactgcgaaaaaggggaaacgaaccagaaagtttggggtcatctccaggcctcctgccaacaaggcccctgaagaatccaagggcagcgctggctgtgaggtgtccagtgaccccagcactgagctggagaacggccctgaccctgaacttggaaacggccatgtctttcagctagaaaatggcccagattctctcaaggaggtggctggaccccatctagagaggtcagaagtggacagagggacagagcatagaattccaaagacagatgctcctctgaccacaagcaatgacaaacgccgcttctcaaaaggtgggaagacggacttccaatcgagtgactgcctggcacgggaggaagttggccgaatatggaagatggagctgctcaaagaatcggatgggctgggaattcaggttagtggaggccgaggatcaaagcgctcacctcacgctatcgttgtcactcaagtgaaggaaggaggtgccgctcacagggatggcaggctgtccttaggagatgagctgctggtaatcaatggtcatttactggtcgggctctcccacgaggaagcagtggccattcttcgctccgccacgggaatggtgcagcttgtggtggccagcaaggaaaactccgcagaggacctcctcaggttaacatctaagagcttgccagatctgaccagctcggtagaagatgtgtcctcctggactgataacgaagaccaggaggcagacggggaagaggacgaaggaaccagctcttctgtccagagagcaatgcctgggacagatgaaccccaagatgtgtgcggtgctgaggaatccaaggggaacttggaaagtcccaaacagggcagcaataaaatcaagctcaagagtcgcctttcagggggtgtacaccgccttgagtcagttgaagaatataacgagctgatggtgcggaatggggacccccggatccggatgttggaggtctcccgagatggccggaaacactccctcccgcagctgctggactcttccagtgcctcacaggaataccacattgtgaagaagtctacccgctccttaagcacgactcaggtggaatctccttggaggctcattcggccatccgtcatctcgatcattgggttgtacaaagaaaaaggcaagggccttggctttagtattgctggaggtcgagactgcattcgtggacagatggggatttttgtcaagaccatcttcccaaatggatcagctgcagaggacggaagacttaaagaaggggatgaaatcctagatgtaaatggaataccaataaagggcttgacatttcaagaagccattcatacctttaagcaaatccggagtggattatttgttttaacggtacgcacaaagttggtgagccccagcctcacaccctgctcgacacccacacacatgagcagatccgcctccccgaacttcaataccagtgggggagcctcagcgggaggttccgatgaaggcagttcttcatccctgggtcggaagacccctgggcccaaggacaggatcgtcatggaagtaacactcaacaaagagccaagagttggattaggcattggtgcctgctgcttggctctggaaaacagtcctcctggcatctacattcacagccttgctccaggatcagtggccaagatggagagcaacctgagccgcggggatcaaatcctggaagtgaactccgtcaacgtccgccatgctgctttaagcaaagtccacgccatcttgagtaaatgccctccaggacccgttcgccttgtcatcggccggcaccctaatccaaaggtttccgagcaggaaatggatgaagtcatagcacgcagcacttatcaggagagcaaagaggccaattcctctcctggcttaggtacccccttgaagagtccctctcttgcaaaaaaggactcccttatttctgaatctgaactctcccagtactttgcccacgatgtccctggccccttgtcagacttcatggtggccggttctgaggacgaggatcacccgggaagtggctgcagcacgtcggaggagggcagcctgcctcccagcacctccactcacaaggagcctggaaaacccagagccaacagcctcgtgactcttgggagccatcgggcttctgggctcttccacaagcaggtgacagttgccagacaagccagtctccccggaagcccacaggccctccgaaaccctctcctccgccagaggaaggtaggctgctacgatgccaacgatgccagtgatgaggaagagtttgacagagaaggggactgcatttcactcccaggggccctcccgggtcccatcaggcctctgtcagaggatgacccgaggcgtgtctcaatttcctcttccaagggcatggacgtccacaaccaagaggaacgaccccggaaaacactggtgagcaaggccatctcggcacctcttcttggtagctcagtggacttagaggagagtatcccagagggcatggtggatgctgcgtcctatgcagccaacctcacggactctgcagaggcccccaaggggagccctggaagctggtggaagaaggaactgtcaggatcaagtagcgcacccaaattggaatacacagtccgtacagacacccagagtccgacgaacactgggagccccagttccccccagcagaaaagtgaaggcctgggctccaggcacagaccagtggccagggtaagcccccactgcaagagatccgaggctgaggccaagcccagtggctcacagacagtgaacctgactggcagagccaatgatccatgcgatctggactcgagagtccaggccacttctgtcaaagtgactgtcgctggctttcagccaggtggagctgtggagaaggaatctctgggaaagctgaccactggagatgcttgtgtctctaccagctgtgaactagccagtgctctgtcccatctggatgccagccacctcacagagaacctgcccaaagctgcatcagagctggggcaacaacccatgactgaactggacagctcctcagacctcatctcttccccagggaagaagggggccgctcatcctgaccccagcaagacctctgtagacacagggcaagtcagtcggccagagaatcccagccagcctgcatcgcccagggtcaccaagtgcaaggccaggtctccagtcaggctcccccatgagggcagcccctccccgggggagaaagcagcggctccccctgactacagcaagactcgatcagcatcggaaaccagcacaccccacaataccaggagggtggctgccctcaggggagcgggacctggagcagagggaatgacaccagctggtgctgtcctgccaggagaccccctcacatcccaggagcagagacagggagctccaggtaaccacagtaaggctctggaaatgacaggaatccatgcacctgaaagctcccaggagccttccctgctggagggagcagattctgtgtcctcaagggcaccgcaggccagcctctccatgctgccatccactgacaacaccaaagaagcatgtggccatgtctcggggcactgctgcccaggggggagtagagagagccctgtgacggacattgacagcttcatcaaggagctggatgcttctgcagcaaggtctccgtcttcccagacgggggacagtggctctcaggagggcagtgctcagggccacccaccagccggggctggaggtgggagctcctgccgtgccgaaccagtcccggggggccagacctcctccccgaggagggcctgggctgctggtgcccccgcctacccacaatgggcctcccagccttcggttttagattcaattaatcccgacaaacattttactgtgaacaaaaactttctgagcaactactctagaaattttagcagttttcatgaagacagcacctccctatcaggcctgggtgacagcacggagccgtctctgtcatccatgtatggcgatgctgaggattcttcttctgaccctgagtcactcactgaagccccacgagcttctgccagggacggctggtcccctcctcgttcccgtgtgtctttgcacaaggaagatccttcggagtcagaagaggaacagattgagatttgttccacacgtggctgccccaatccaccctcgagtcctgctcatcttcccacccaggctgccatctgtcctgcctcagccaaagttctgtcattaaaatacagcactccgagagagtcggtggccagtccccgtgagaaggccgcctgcttgccaggctcatacacttcaggcccagactcttcccagccatcatcactcttggagatgagctctcaggagcatgaaactcatgcggacataagcacttcacagaaccacaggccctcgtgtgcagaagaaaccacagaagtcaccagcgctagctcagccatggaaaacagtccgctgtctaaagtagccaggcattttcacagtccgcccatcattctcagctcccccaacatggtaaatggcttggaacatgacctgctagatgacgaaaccctgaatcaatacgaaacaagcattaatgcagctgccagtctgtcctccttcagtgtggatgtccctaagaatggagaatctgttttggaaaacctccacatctctgaaagtcaagacctggatgacttgctacagaaaccaaaaatgatcgctaggaggcccatcatggcctggtttaaagaaataaataaacataaccaaggcacacatttgaggagcaaaaccgagaaggaacaacctctaatgcctgccagaagtcccgactccaagattcagatggtgagttcaagccaaaaaaagggcgttactgtgcctcatagccctcctcagccgaaaacaaacctggaaaataaggacctgtctaagaagagtccggcagaaatgcttctgactaatggtcagaaggcaaagtgtggtccgaagctgaagaggctcagcctcaagggcaaggccaaagtcaactctgaggcccctgctgcgaatgctgtgaaggctggggggacggaccacaggaaacccttgatctcaccccagacctcccacaaaacactttctaaggcagtgtcacagcggctccatgtagccgaccacgaggaccctgacagaaacaccacagctgcccccaggtccccccagtgtgtgctggaaagcaagccacctcttgccacctctgggccactgaaaccctcagtgtctgacacgagcatcaggacatttgtctcgcccctgacctctcccaagcctgttcctgagcaaggcatgtggagcaggttccacatggctgtcctctctgaacccgacagaggttgcccaaccacccctaaatctcctaagtgtagagcagagggcagggcgccccgtgctgactccgggccggtgagtccggcagcgtctaggaacggcatgtccgtggcagggaacagacagagtgagccgcgcctggccagccatgtggcagcagacacagcccaacccaggccgactggcgaaaaaggaggcaacataatggccagcgatcgcctcgaaagaacaaaccagctgaaaatcgtggagatttctgctgaagcagtgtcagagactgtatgtggtaacaagccagctgaaagcgacagacggggagggtgcttggcccagggcaactgtcaggagaagagtgaaatcaggctctatcgccaggtcgcagaatcatccacaagtcatccatcctcactcccatctcatgcctcccaggcagagcaggaaatgtcacgatcattcagcatggcaaaactggcgtcctcctcctcctcccttcaaacagccattagaaaggcagaatactcccagggaaaatcaagcctgatgtcagactcccgaggggtgcccagaaacagcattccagggggcccctcgggggaggaccatctctacttcaccccaaggccagcgaccaggacctactccatgccagcccagttctcaagccattttggacgggagggtcaccccccacacagcctgggtcgctctcgggacagccaggtccctgtgacaagcagtgttgtccccgaggcaaaggcatccagaggtggtcttcccagcctggctaatggacagggcatatatagtgtaaagccgctgctggacacatcgaggaatcttccagccacagatgaaggggatatcatttcagtccaggagacgagctgcctagtcacagacaaaatcaaagtcaccagacgacactactgctatgagcagaactggccccatgaatctacctcatttttctctgtgaagcagcggatcaagtcttttgagaacctggccaatgctgaccggcctgtagccaagtccggggcttccccatttttgtcggtgagctccaagcctcccattgggaggcggtcttccggcagcattgtttccgggagcctgggccacccaggtgacgcagcagcaaggttgttgagacgcagcttgagttcctgcagcgaaaaccaaagcgaagccggcaccctcctgccccagatggccaagtctccctcaatcatgacactgaccatctctcggcagaacccaccagagaccagtagcaagggctctgattcggaactaaagaaatcacttggtcctttgggaattcccaccccaacgatgaccctggcttctcctgttaagaggaacaagtcctcggtacgccacacgcagccctcgcccgtgtcccgctccaagctccaggagctgagagccttgagcatgcctgaccttgacaagctctgcagcgaggattactcagcagggccgagcgccgtgctcttcaaaactgagctggagatcacccccaggaggtcacctggccctcctgctggaggcgtttcgtgtcccgagaagggcgggaacagggcctgtccaggaggaagtggccctaaaaccagtgctgctgagacacccagttcagccagtgatacgggtgaagctgcccaggatctgccttttagaagaagctggtcagttaatttggatcaacttctagtctcagcgggggaccagcaaagattacagtctgttttatcgtcagtgggatcgaaatctaccatcctaactctcattcaggaagcgaaagcacaatcagagaatgaagaagatgtttgcttcatagtcttgaatagaaaagaaggctcaggtctgggattcagtgtggcaggagggacagatgtggagccaaaatcaatcacggtccacagggtgttttctcagggggcggcttctcaggaagggactatgaaccgaggggatttccttctgtcagtcaacggcgcctcactggctggcttagcccacgggaatgtcctgaaggttctgcaccaggcacagctgcacaaagatgccctcgtggtcatcaagaaagggatggatcagcccaggccctctgcccggcaggagcctcccacagccaatgggaagggtttgctgtccagaaagaccatccccctggagcctggcattgggagaagtgtggctgtacacgatgctctgtgtgttgaagtgctgaagacctcggctgggctgggactgagtctggatgggggaaaatcatcggtgacgggagatgggcccttggtcattaaaagagtgtacaaaggtggtgcggctgaacaagctggaataatagaagctggagatgaaattcttgctattaatgggaaacctctggttgggctcatgcactttgatgcctggaatattatgaagtctgtcccagaaggacctgtgcagttattaattagaaagcataggaattcttcatgaattttaacaagaatcattttctcagttctcttctttctttagcaaatcagagtgacttctttaaaccacaggttgttgaaatggccaacactggtacagacacggactataaaaatctccaagcttgtgcttacacatgaagcctgacttaactgtatgtgcaacagcaatgaaattaactccagaagccttccacctgcgtcacccaggccgggagggttccttcgttccagtgcctgtcccctacctttatgttatgtttactgatggggatacaagatgtgacacacccttctttatttgaaacaaacaaacatttagctagacctttgcttccttcttgccagctctcccaacatacccaatcctggtgatcagggaactaaaagtctgagggggacacaaatgtcacacctaagaggacaatcaatcattttgtatgattttgtaagtaaatgacagaatgcttttaggcacattcaatggaaggaggagatgtaggtctgtatatgttaccctgaaaagagaataagacttacttaaaaaaatgaattatgacctgttaggctgagctcaggaattgtccaaaaaggaaaaagcaaaataattaattgagagtattttttagtgagtgtaatgtataatgtacgtatgcaaagttcaactcaataggttattgatcaccatgaagtattgatcattttctatctcaaaagtgtaagccataaggctgttttacagaatagcacttctgataagctgtattaaatagccatgagcttcactgcttagagggagcagaaaggtcaacatctaaaagcaccttacaactagtttttgaacctgtcttgataagtgcttgaattcaagactggtcagtccaagagcagacaaaaatatcacaagtcagtcagtcactgggtttccatttctgaattttatgcactccaaccatgaatttaaactaaatttttagaaatcaagtatctttctaagtgtccttggatttatagacaatgtatgtacaatccaaatagaggagcttaatggaatccttttaggagactggttggtttttttccctctttcccaacatgtttaagaaatgtaacattctaagtattggatctcttttcttgacctagtataatgacaactgcagtgacttaagtttttgctgttttcgttttcccgctttgcaatttcctccttttgccaaaaatgttttcctacagaagactgtcgtgactcacgctacttgggaaactcactctggccactcctcctctggtggcatgagctgcttcccagtagctattccgattggatattccgttcgtcgtcacatagctggcttttctctcctcatgatgtaccttattttcttaggtaaataattccaaactctcatcgggtcataaagaggaggagaaacagggtgagtcaaggtaaaggagcagaaatgtagttacaagccaggtcgtcttcagtggcacaaaccaacccgttgagccctgacaacatgagtggagagtgcatttgccatacctgtgtgcatgacactaagattttatgttggagatacttctttaaataacctacagcttgggtctatggctgtgacccccagattcatggaggggctttagccatcagctttgtacatcatcatttttctgaatgaccaatcccactaaacatctttgaagtcggcctagagaggtccttcagatgagagagaaatagctggcttgtctgagtccagatttctcatcaactggcaatacaaaggaaaatatggtacaggagttagttagaaaggtcttattgattttacttctacttttcactacagttacaggtagaatactgtaggaagtcagtgcaaggtgcatgcttgattgatagatattgattgattgtttttcagtctctggggtcagttttgtggtttctgctttcttgcctaaatcaaagactatttcaagtcaacaacactgaaaactgcttttcgcctccactcttacagctgtgcctaataataattaattaataaacgcacagccctatgtgaacagacaggaatttcttgtgcaatgtggagcaaatggaatggtctccttccgcaagtctttttaatcctcatatctggagtacaagggtagacctctggcttaccacatacactatgctaaagtcatcagccactgctactacatcttgccagaaggtttccctcgccaacaaacagttgaaatttaagggaagaagcaaaagctaaactgtctttgaccctaagatagatagaaagctatttatttgtcttcagtgttcaaggcatgactagtatttctaattagcctaataaattcccacactttctgaagtgaacactaatggtattgtcctactaaaactgtcattgtttctttttttttaactggtcagtcattcacaataagctatgagggtaaataaatatgtgttataacaagtaaaccgtagttgcaagaatataccatgaagattaaagtaggctgggtttcatttccatcttcccacacatctcattgaatttgatggttgacttaattggcaccataactttgtatgatattatacattaacctttatttatgtaaagtaaaatgccttatatattaaagagtaagtgcaataatatgaaatagcctgtacattttaaaaatgttgtcaccaagttatataaatccacatctctgtaaacaaccttttttaagtaattttaaaaaaaataaacactctgcttactacttg

SEQ ID NO: 21777 - DNA, 536 bp, Homo sapiens
agaagtgtggcgtcttggtccaggatgcaggtccctgattcgggttggacgtggtcatcaaacccagaaattgaaggatcttgggcctgccttgatgttcatttctctcatctataaaattgaaggctggaggaggtgtgaatgagcccagggaaggacacacggccactgctggagggatcctccattcctgtgtcatttgcatgggtcctgctgtgaaatgaacctggcagggacttgttagacacttccttccttccctcattgagcactccagtgccattgttccacagttgttctaattgggtcctagcttcctcctgccaaggcaaacagcatagtctcgagtaggtgtccctaggctcatctgccagcctgaacatgaacacaggcaaagctgatgatggccagggaccccaggggacgtggggccctgtggggtctggcccccaggagcaagacctctgatgatgctggtgtctgggagtgagcaccatgcccatcacccaggacaatgccgtgctgcacctgcccct

SEQ ID NO: 21778 - DNA, 2204 bp, Homo sapiens
gatccagctatggagaaagccgcagatctgcaggacacagcctcgttaactctgaagtttaagtttaacccaaagctgggcattgataatcctgtcctctccctggccgaagaccacgacccctatgatccctggagcctggagcggcctcgcttctgtttactgagcaaagaggagggcaagagttttggcttccacctgcagcaggagctgggcagggctgggcatgtggtgtgcagggtggacccaggcacctctgcccagcgccagggtcttcaggaaggagacaggatcctggcggtgaacaatgatgttgtggaacacgaagactatgcggtggtggtacgccgcatccgggccagcagccctcgggtgttgctgacagtattggcacggcatgcacatgacgtggcccgagctcagctgggagaagatgcccacctctgtcccaccctaggcccaggggtccggccccggctgtgccacatagtgaaagatgagggtggttttggcttcagtgtcacccatggcaatcagggtcctttctggttggtgctaagtactggaggagcagctgagcgggcaggggtgccccccggggcccggctgctggaagtgaatgggctttggcagagtggacagcaggtgaccttgctggtggcagggccagaggtggaagaacagtgtcgccagctgggattgcccctggctgcacccctggcagagggctgggcactgcccaccaagccccgctgcctgcacctggagaaagggccccagggttttgggttcctgctccgggaggaaaagggccttgacggtcgccctggacagttcctgtgggaggtggacccgggactgccagccaagaaggctgggatgcaggctggggaccggctggtggctgtggctggggagagcgtggaggggctgggccatgaggagacagtgtccaggatccaggggcagggctcctgtgtctccctcactgtcgtcgaccctgaggcggaccgcttcttcagcatggttcgcctgtccccactcctcttcttggagaacacagaggctcccgcctcgccccggggcagcagctcagcctcactggttgagacagaggacccttcacttgaagacacaagcgtgccttctgtccctcttggctcccgacagtgcttcctgtaccctgggcctggtggcagctatggcttccgactcagttgtgtggccagtgggcctcgtctcttcatctcccaggtgactccaggaggctcagctgcccgggctgggctgcaagtgggagacgtgattctggaagtgaacgggtatcctgttgggggacagaatgacctggagaggcttcagcagctgcctgaggctgagccacccctctgcctgaagctggcagccaggtctctgcggggcttggaagcctggattccccctggggctgcagaggactgggctctggcctcggatctactgtagagcacccctgcttggtacagacatactcaggggctaccgtgtcttcactctccagcctgaggtggtgaaggcaggatgctctctctaagccagaccagagggactcagacaccaccgatcacaggctggcccaggtgctccctcccttcctgcaggcccacctgccagcagagggtgtggttggaggcctcagacaggtccctgaaggagtctgaggctccagaggatgtcatatgggagttttagagagctgtgtcccaaggatgaaggtgtggctgtgggtctggctaggattgaagccatctggaccttttctagatatgactccaggacccttgagtgtaatgcaaaaatttggagaccagctatgcctgccctctgtgggtgccttagcattgcgggagggtggtgcttggtcaccgttgcatttgttatagaaatggccattcgccataaatctgactgcctgtgtttgtgttggtgggggtaaggggcagtggtgtgaagggaccaaaagggcctcaggctcaaggggtgggatgcggctcctgcaggagagaggttgagacctggtcaaatttatttcctatcaatcactgaatctcagggataatgggtcaacccagaactgagatgtctgtatgacagccactcctaaaaataaacaacaacaaaaacaaaaaaagaagaaaactaaataaaaataaaaataaaaataa

SEQ ID NO: 21779 - DNA, 2252 bp, Homo sapiens
gttgctgatccagctatggagaaagccgcagatctgcaggacacagcctcgttaactctgaagtttaagtttaacccaaagctgggcattgataatcctgtcctctccctggccgaagaccacgacccctatgatccctggagcctggagcggcctcgcttctgtttactgagcaaagaggagggcaagagttttggcttccacctgcagcaggagctgggcagggctgggcatgtggtgtgcagggtggacccaggcacctctgcccagcgccagggtcttcaggaaggagacaggatcctggcggtgaacaatgatgttgtggaacacgaagactatgcggtggtggtacgccgcatccgggccagcagccctcgggtgttgctgacagtattggcacggcatgcacatgacgtggcccgagctcagctgggagaagatgcccacctctgtcccaccctaggcccaggggtccggccccggctgtgccacatagtgaaagatgagggtggttttggcttcagtgtcacccatggcaatcagggtcctttctggttggtgctaagtactggaggagcagctgagcgggcaggggtgccccccggggcccggctgctggaagtgaatggggtcagtgtggagaagttcactcacaaccaactcaccaggaagctttggcagagtggacagcaggtgaccttgctggtggcagggccagaggtggaagaacagtgtcgccagctgggattgcccctggctgcacccctggcagagggctgggcactgcccaccaagccccgctgcctgcacctggagaaagggccccagggttttgggttcctgctccgggaggaaaagggccttgacggtcgccctggacagttcctgtgggaggtggacccgggactgccagccaagaaggctgggatgcaggctggggaccggctggtggctgtggctggggagagcgtggaggggctgggccatgaggagacagtgtccaggatccaggggcagggctcctgtgtctccctcactgtcgtcgaccctgaggcggaccgcttcttcagcatggttcgcctgtccccactcctcttcttggagaacacagaggctcccgcctcgccccggggcagcagctcagcctcactggttgagacagaggacccttcacttgaagacacaagcgtgccttctgtccctcttggctcccgacagtgcttcctgtaccctgggcctggtggcagctatggcttccgactcagttgtgtggccagtgggcctcgtctcttcatctcccaggtgactccaggaggctcagctgcccgggctgggctgcaagtgggagacgtgattctggaagtgaacgggtatcctgttgggggacagaatgacctggagaggcttcagcagctgcctgaggctgagccacccctctgcctgaagctggcagccaggtctctgcggggcttggaagcctggattccccctggggctgcagaggactgggctctggcctcggatctactgtagagcacccctgcttggtacagacatactcaggggctaccgtgtcttcactctccagcctgaggtggtgaaggcaggatgctctctctaagccagaccagagggactcagacaccaccgatcacaggctggcccaggtgctccctcccttcctgcaggcccacctgccagcagagggtgtggttggaggcctcagacaggtccctgaaggagtctgaggctccagaggatgtcatatgggagttttagagagctgtgtcccaaggatgaaggtgtggctgtgggtctggctaggattgaagccatctggaccttttctagatatgactccaggacccttgagtgtaatgcaaaaatttggagaccagctatgcctgccctctgtgggtgccttagcattgcgggagggtggtgcttggtcaccgttgcatttgttatagaaatggccattcgccataaatctgactgcctgtgtttgtgttggtgggggtaaggggcagtggtgtgaagggaccaaaagggcctcaggctcaaggggtgggatgcggctcctgcaggagagaggttgagacctggtcaaatttatttcctatcaatcactgaatctcagggataatgggtcaacccagaactgagatgtctgtatgacagccactcctaaaaataaacaacaacaaaaacaaaaaaagaagaaaactaaataaaaataaaaataaaaataa

SEQ ID NO: 21780 - DNA, 2447 bp, Homo sapiens
atggtaactccctcaccccctggcaaccattccctatccctggaggcaccacggctccacacggcctccgatctccttggtaaccactcactcggtctccctctgataacagccttggttgggagtagagataggaggggccgggtgttttctcctgtcccagtccctctgcccacgaaccccaccacccaacacccaaccaggcagaaactgcccagcaccctatcaggacacagggtctgccaggcacacggcgaacctgtacttgggctgtgccctctcctcccccttttctgctgcccacctcaccctccagatccctggagcctggagcggcctcgcttctgtttactgagcaaagaggagggcaagagttttggcttccacctgcagcaggagctgggcagggctgggcatgtggtgtgcagggtggacccaggcacctctgcccagcgccagggtcttcaggaaggagacaggatcctggcggtgaacaatgatgttgtggaacacgaagactatgcggtggtggtacgccgcatccgggccagcagccctcgggtgttgctgacagtattggcacggcatgcacatgacgtggcccgagctcagctgggagaagatgcccacctctgtcccaccctaggcccaggggtccggccccggctgtgccacatagtgaaagatgagggtggttttggcttcagtgtcacccatggcaatcagggtcctttctggttggtgctaagtactggaggagcagctgagcgggcaggggtgccccccggggcccggctgctggaagtgaatggggtcagtgtggagaagttcactcacaaccaactcaccaggaagctttggcagagtggacagcaggtgaccttgctggtggcagggccagaggtggaagaacagtgtcgccagctgggattgcccctggctgcacccctggcagagggctgggcactgcccaccaagccccgctgcctgcacctggagaaagggccccagggttttgggttcctgctccgggaggaaaagggccttgacggtcgccctggacagttcctgtgggaggtggacccgggactgccagccaagaaggctgggatgcaggctggggaccggctggtggctgtggctggggagagcgtggaggggctgggccatgaggagacagtgtccaggatccaggggcagggctcctgtgtctccctcactgtcgtcgaccctgaggcggaccgcttcttcagcatggttcgcctgtccccactcctcttcttggagaacacagaggctcccgcctcgccccggggcagcagctcagcctcactggttgagacagaggacccttcacttgaagacacaagcgtgccttctgtccctcttggctcccgacagtgcttcctgtaccctgggcctggtggcagctatggcttccgactcagttgtgtggccagtgggcctcgtctcttcatctcccaggtgactccaggaggctcagctgcccgggctgggctgcaagtgggagacgtgattctggaagtgaacgggtatcctgttgggggacagaatgacctggagaggcttcagcagctgcctgaggctgagccacccctctgcctgaagctggcagccaggtctctgcggggcttggaagcctggattccccctggggctgcagaggactgggctctggcctcggatctactgtagagcacccctgcttggtacagacatactcaggggctaccgtgtcttcactctccagcctgaggtggtgaaggcaggatgctctctctaagccagaccagagggactcagacaccaccgatcacaggctggcccaggtgctccctcccttcctgcaggcccacctgccagcagagggtgtggttggaggcctcagacaggtccctgaaggagtctgaggctccagaggatgtcatatgggagttttagagagctgtgtcccaaggatgaaggtgtggctgtgggtctggctaggattgaagccatctggaccttttctagatatgactccaggacccttgagtgtaatgcaaaaatttggagaccagctatgcctgccctctgtgggtgccttagcattgcgggagggtggtgcttggtcaccgttgcatttgttatagaaatggccattcgccataaatctgactgcctgtgtttgtgttggtgggggtaaggggcagtggtgtgaagggaccaaaagggcctcaggctcaaggggtgggatgcggctcctgcaggagagaggttgagacctggtcaaatttatttcctatcaatcactgaatctcagggataatgggtcaacccagaactgagatgtctgtatgacagccactcctaaaaataaacaacaacaaaaacaaaaaaagaagaaaactaaataaaaataaaaataaaaataagatccacttctc

SEQ ID NO: 21781 - DNA, 2249 bp, Homo sapiens
atggaagaggcactagatctgcaggacacagcctcgttaactctgaagtttaagtttaacccaaagctgggcattgataatcctgtcctctccctggccgaagaccacgacccctatgatccctggagcctggagcggcctcgcttctgtttactgagcaaagaggagggcaagagttttggcttccacctgcagcaggagctgggcagggctgggcatgtggtgtgcagggtggacccaggcacctctgcccagcgccagggtcttcaggaaggagacaggatcctggcggtgaacaatgatgttgtggaacacgaagactatgcggtggtggtacgccgcatccgggccagcagccctcgggtgttgctgacagtattggcacggcatgcacatgacgtggcccgagctcagctgggagaagatgcccacctctgtcccaccctaggcccaggggtccggccccggctgtgccacatagtgaaagatgagggtggttttggcttcagtgtcacccatggcaatcagggtcctttctggttggtgctaagtactggaggagcagctgagcgggcaggggtgccccccggggcccggctgctggaagtgaatggggtcagtgtggagaagttcactcacaaccaactcaccaggaagctttggcagagtggacagcaggtgaccttgctggtggcagggccagaggtggaagaacagtgtcgccagctgggattgcccctggctgcacccctggcagagggctgggcactgcccaccaagccccgctgcctgcacctggagaaagggccccagggttttgggttcctgctccgggaggaaaagggccttgacggtcgccctggacagttcctgtgggaggtggacccgggactgccagccaagaaggctgggatgcaggctggggaccggctggtggctgtggctggggagagcgtggaggggctgggccatgaggagacagtgtccaggatccaggggcagggctcctgtgtctccctcactgtcgtcgaccctgaggcggaccgcttcttcagcatggttcgcctgtccccactcctcttcttggagaacacagaggctcccgcctcgccccggggcagcagctcagcctcactggttgagacagaggacccttcacttgaagacacaagcgtgccttctgtccctcttggctcccgacagtgcttcctgtaccctgggcctggtggcagctatggcttccgactcagttgtgtggccagtgggcctcgtctcttcatctcccaggtgactccaggaggctcagctgcccgggctgggctgcaagtgggagacgtgattctggaagtgaacgggtatcctgttgggggacagaatgacctggagaggcttcagcagctgcctgaggctgagccacccctctgcctgaagctggcagccaggtctctgcggggcttggaagcctggattccccctggggctgcagaggactgggctctggcctcggatctactgtagagcacccctgcttggtacagacatactcaggggctaccgtgtcttcactctccagcctgaggtggtgaaggcaggatgctctctctaagccagaccagagggactcagacaccaccgatcacaggctggcccaggtgctccctcccttcctgcaggcccacctgccagcagagggtgtggttggaggcctcagacaggtccctgaaggagtctgaggctccagaggatgtcatatgggagttttagagagctgtgtcccaaggatgaaggtgtggctgtgggtctggctaggattgaagccatctggaccttttctagatatgactccaggacccttgagtgtaatgcaaaaatttggagaccagctatgcctgccctctgtgggtgccttagcattgcgggagggtggtgcttggtcaccgttgcatttgttatagaaatggccattcgccataaatctgactgcctgtgtttgtgttggtgggggtaaggggcagtggtgtgaagggaccaaaagggcctcaggctcaaggggtgggatgcggctcctgcaggagagaggttgagacctggtcaaatttatttcctatcaatcactgaatctcagggataatgggtcaacccagaactgagatgtctgtatgacagccactcctaaaaataaacaacaacaaaaacaaaaaaagaagaaaactaaataaaaataaaaataaaaataagatccacttctc

SEQ ID NO: 21782 - DNA, 2996 bp, Homo sapiens
actgggttgctgatccagctatggagaaagccgcaggtaggaggccaggagaaatcctctgcaggggactttgggacaggcagggggccgacttggaggctgaagctttgggaccagggcacacttgattttggggcttggagccctgaggcaggtaaacaagtcaggagaaaagtaatgagttgatatgtctgtcttcctggtccacaccctgtactgatatgctcagatttatgtgccaaggacttggggggagagaaagggaggggaccgcacaatagtcctgtgtgtatggcagtgagaagagaagacccctttggagcagaaaggagggggcatgccctgagtttgggggtttccctgagtccttttagtttatgccaatggaagaggcacatctggggagaagaatgtgactctcctcctctcacccacttctttgcccagtagatctgcaggacacagcctcgttaactctgaagtttaagtttaacccaaagctgggcattgataatcctgtcctctccctggccgaagaccacgacccctatggtaactccctcaccccctggcaaccattccctatccctggaggcaccacggctccacacggcctccgatctccttggtaaccactcactcggtctccctctgataacagccttggttgggagtagagataggaggggccgggtgttttctcctgtcccagtccctctgcccacgaaccccaccacccaacacccaaccaggcagaaactgcccagcaccctatcaggacacagggtctgccaggcacacggcgaacctgtacttgggctgtgccctctcctcccccttttctgctgcccacctcaccctccagatccctggagcctggagcggcctcgcttctgtttactgagcaaagaggagggcaagagttttggcttccacctgcagcaggagctgggcagggctgggcatgtggtgtgcagggtggacccaggcacctctgcccagcgccagggtcttcaggaaggagacaggatcctggcggtgaacaatgatgttgtggaacacgaagactatgcggtggtggtacgccgcatccgggccagcagccctcgggtgttgctgacagtattggcacggcatgcacatgacgtggcccgagctcagctgggagaagatgcccacctctgtcccaccctaggcccaggggtccggccccggctgtgccacatagtgaaagatgagggtggttttggcttcagtgtcacccatggcaatcagggtcctttctggttggtgctaagtactggaggagcagctgagcgggcaggggtgccccccggggcccggctgctggaagtgaatggggtcagtgtggagaagttcactcacaaccaactcaccaggaagctttggcagagtggacagcaggtgaccttgctggtggcagggccagaggtggaagaacagtgtcgccagctgggattgcccctggctgcacccctggcagagggctgggcactgcccaccaagccccgctgcctgcacctggagaaagggccccagggttttgggttcctgctccgggaggaaaagggccttgacggtcgccctggacagttcctgtgggaggtggacccgggactgccagccaagaaggctgggatgcaggctggggaccggctggtggctgtggctggggagagcgtggaggggctgggccatgaggagacagtgtccaggatccaggggcagggctcctgtgtctccctcactgtcgtcgaccctgaggcggaccgcttcttcagcatggttcgcctgtccccactcctcttcttggagaacacagaggctcccgcctcgccccggggcagcagctcagcctcactggttgagacagaggacccttcacttgaagacacaagcgtgccttctgtccctcttggctcccgacagtgcttcctgtaccctgggcctggtggcagctatggcttccgactcagttgtgtggccagtgggcctcgtctcttcatctcccaggtgactccaggaggctcagctgcccgggctgggctgcaagtgggagacgtgattctggaagtgaacgggtatcctgttgggggacagaatgacctggagaggcttcagcagctgcctgaggctgagccacccctctgcctgaagctggcagccaggtctctgcggggcttggaagcctggattccccctggggctgcagaggactgggctctggcctcggatctactgtagagcacccctgcttggtacagacatactcaggggctaccgtgtcttcactctccagcctgaggtggtgaaggcaggatgctctctctaagccagaccagagggactcagacaccaccgatcacaggctggcccaggtgctccctcccttcctgcaggcccacctgccagcagagggtgtggttggaggcctcagacaggtccctgaaggagtctgaggctccagaggatgtcatatgggagttttagagagctgtgtcccaaggatgaaggtgtggctgtgggtctggctaggattgaagccatctggaccttttctagatatgactccaggacccttgagtgtaatgcaaaaatttggagaccagctatgcctgccctctgtgggtgccttagcattgcgggagggtggtgcttggtcaccgttgcatttgttatagaaatggccattcgccataaatctgactgcctgtgtttgtgttggtgggggtaaggggcagtggtgtgaagggaccaaaagggcctcaggctcaaggggtgggatgcggctcctgcaggagagaggttgagacctggtcaaatttatttcctatcaatcactgaatctcagggataatgggtcaacccagaactgagatgtctgtatgacagccactcctaaaaataaacaacaacaaaaacaaaaaaagaagaaaactaaataaaaataaaaataaaaataagatccacttctc

SEQ ID NO: 21783 - DNA, 3689 bp, Homo sapiens
agcgaagagttaacctgaggggcgagccgctgcccccacctcgggggcgtgcccccctcccccgctaggcggcccgccccccgcgccagggtatggcccctggccccggcccgggacccgaggtcccgcgcccgggtcagtgaaaggcgtcttcccgttcccgccctccgcctcctctcgccggccagcaacatgggatgtaatatgtgcgtggtccagaaaccggaggagcagtacaaagtgatgctgcaggtgaacgggaaggagctctccaagctgtctcaggagcaaactctgcaggccctgcgctcctccaaggagcccctggtgatccaggtgctgagacgcagcccccgcctccggggggacagctcctgtcacgacctgcagctggtggacagtggcactcagaccgacatcaccttcgagcatatcatggcgctgggcaagctgcgtccgcccaccccgcccatggtcatcctggagccccccccaatcagccatgagtattatgacccggcggagtttatggagggcggcccgcaggaggcagaccgcttggatgagctggagtatgaggaggtggagctgtataaaagcagccaccgggacaagctgggcctgatggtttgctaccgcacggacgacgaggaggacctgggcatttatgtcggagaggtaaatcccaacagcattgcagccaaagacggccggatccgtgagggagaccgcatcatccagattaacggtgtagacgtccagaaccgggaagaggcggtggccatcctgagccaggaagagaacaccaacatctccctgctggtggcccgacctgagagtcagctggcgaaaaggtggaaggacagcgaccgggatgacttcctggatgactttggctctgagaatgagggggagctgcgtgctcgtaaactgaaatcaccccctgcccagcagcccggaaacgaagaggagaagggggctcccgatgccggcccaggcctgagcaacagccaggagctggacagcggggtgggccggactgacgagagcacccggaacgaagagagctctgagcacgacctgctgggggacgaacccccgagctccaccaacaccccgggaagcctgcgcaagtttggcctgcaaggggacgccctgcagagccgggacttccatttcagcatggactctctgctggccgagggggcggggctgggagggggcgacgtcccgggcctcacggatgaggagtatgagcgctaccgtgagctcctggagatcaagtgccacctggagaacggcaaccagctgggcctcctctttccccgggcctccggaggcaacagcgccctggacgtcaaccgcaacgagagcctgggccacgagatggccatgctggaggaggagctaaggcacctggaattcaagtgccgcaacatactgcgggcgcagaagatgcagcagctgcgtgagcgctgcatgaaggcctggctgctggaggaggagagcctctacgacctggcggccagcgagcccaagaagcacgagctgtccgacatctccgagctgcccgagaagtcggacaaggacagcaccagcgcctacaacactggggagagctgccgcagcaccccgctgcttgtggagcccctgcccgagagccccctgcggcgggccatggccggcaactccaacttgaaccggacccctcccggccccgctgttgccacccccgccaaggcagctcctccaccggggagccccgccaagttccggtccctctcccgggatcctgaggccggccggaggcagcacgcggaggagcgcggccgccgcaaccccaagacggggttgaccctggagcgtgtgggccctgaaagcagcccttacctctcgcggcgccaccgcggccagggccaggagggcgagcactaccacagctgcgtgcagctggccccgacgcgaggcctggaggagctgggccacggccccctgagcttggccggtggccctcgggtgggcggggtggcggccgcggccactgaagcaccgcgcatggagtggaaagtgaaggtgcgcagcgacggaacccgctacgtggccaagcggcccgtgcgagatcggctgctgaaagcccgtgccctgaagatccgggaggagcgcagcggtatgacgaccgacgacgacgcggtgagcgagatgaagatgggccgctactggagcaaggaggagcggaagcagcacctgatccgggcccgtgagcagcggaagcggcgcgagttcatgatgcagagccggctggagtgcctgcgggagcagcagaatggcgacagcaagcccgagctcaacatcattgccctgagccaccgcaaaaccatgaagaagcggaacaagaagatcctggacaactggatcaccatccaggagatgctggcccacggcgcgcgctccgccgatggcaagcgggtctacaaccctcttctctcagtcaccaccgtgtgagctgcccgggcgggtacacggcccaggcccagggaaccccctggggccccggccctcactctcctatagagattgtgtgtgtgtgtgtgtgcgcgcgcgcgtgctcgctgtgcgcacgcacacatctcctcgtctgggtgtgcgcacagggctttgttagcagagagaagcccctgaggagaagggacgcttttcttccttctgcccaagtaaagtgaccatgccagtggccagcactgggggcacacctgtgatgggcaccccttcagctgtgcgtgtgcattccccatcccccatgctcttgcgtgtgcttgcacgtgcacgcacacacacacccagtgctctctccacccgacccgtgtacttgcagacagggaagctgagctgaaaggagcacaagagagtgtccggcttcgctgctgagcgcggcctctccccgccgctgcgcactgcagttatttgtagacaaaggcacccctgatttttgtggtttttctccctttctgtgcttgccaatagttgttttgttttgtggacctgccctgggggctggcagctccttcaggcagcctggcagaagtggaactcccctctccactgatggctgggaagggagttggggaggaagagtgggagggagggctggggatggatgggagggaaggggagggaaaggtgggaggaatgggaagcagctgttctggtggcttccactctgaggtgtgggaacggggagcctctggggggcacctgtttccccagtgactcagagagagcaagactgcaggaacggaggggtcctgcagggtgtccaccaagaagtcacagagcccgttctgcgccccacaccatctggagcaggggcttctcttctgagtgaactgaggaaggtgcttagatggtgagggctctagaaaccaagccccatgagcagcagtggaagacctcgggccatgcggcctggggaggacttggtggcgatccgcaacctggaccccagtgagaggcggtgggctgactgggaaggagaggcccccaacctcctcaggatttgcacgtgtgaactaggctgcctgtggggtgccccttaggcttggagagccccagattggaggcagacagactgcaccaccccttccccccctgcatctcaagaataaagcaagctgcctttgtacttggttgaa

SEQ ID NO: 21784 - DNA, 3617 bp, Homo sapiens
gtgcggggggcgccgaatctagatcccggcgggcctggagcgtgggagtgcgtgggcgtccccgggcgcggtccaagtccgtccgggggctgggtgcccaccccgacacccactcccgcctggccctgcccgaacgatgggctcccgggccttaggcgtctcgggtgaacgggaaggagctctccaagctgtctcaggagcaaactctgcaggccctgcgctcctccaaggagcccctggtgatccaggtgctgagacgcagcccccgcctccggggggacagctcctgtcacgacctgcagctggtggacagtggcactcagaccgacatcaccttcgagcatatcatggcgctgggcaagctgcgtccgcccaccccgcccatggtcatcctggagccgtacgtcctctctgagctccccccaatcagccatgagtattatgacccggcggagtttatggagggcggcccgcaggaggcagaccgcttggatgagctggagtatgaggaggtggagctgtataaaagcagccaccgggacaagctgggcctgatggtttgctaccgcacggacgacgaggaggacctgggcatttatgtcggagaggtaaatcccaacagcattgcagccaaagacggccggatccgtgagggagaccgcatcatccagattaacggtgtagacgtccagaaccgggaagaggcggtggccatcctgagccaggaagagaacaccaacatctccctgctggtggcccgacctgagagtcagctggcgaaaaggtggaaggacagcgaccgggatgacttcctggatgactttggctctgagaatgagggggagctgcgtgctcgtaaactgaaatcaccccctgcccagcagcccggaaacgaagaggagaagggggctcccgatgccggcccaggcctgagcaacagccaggagctggacagcggggtgggccggactgacgagagcacccggaacgaagagagctctgagcacgacctgctgggggacgaacccccgagctccaccaacaccccgggaagcctgcgcaagtttggcctgcaaggggacgccctgcagagccgggacttccatttcagcatggactctctgctggccgagggggcggggctgggagggggcgacgtcccgggcctcacggatgaggagtatgagcgctaccgtgagctcctggagatcaagtgccacctggagaacggcaaccagctgggcctcctctttccccgggcctccggaggcaacagcgccctggacgtcaaccgcaacgagagcctgggccacgagatggccatgctggaggaggagctaaggcacctggaattcaagtgccgcaacatactgcgggcgcagaagatgcagcagctgcgtgagcgctgcatgaaggcctggctgctggaggaggagagcctctacgacctggcggccagcgagcccaagaagcacgagctgtccgacatctccgagctgcccgagaagtcggacaaggacagcaccagcgcctacaacactggggagagctgccgcagcaccccgctgcttgtggagcccctgcccgagagccccctgcggcgggccatggccggcaactccaacttgaaccggacccctcccggccccgctgttgccacccccgccaaggcagctcctccaccggggagccccgccaagttccggtccctctcccgggatcctgaggccggccggaggcagcacgcggaggagcgcggccgccgcaaccccaagacggggttgaccctggagcgtgtgggccctgaaagcagcccttacctctcgcggcgccaccgcggccagggccaggagggcgagcactaccacagctgcgtgcagctggccccgacgcgaggcctggaggagctgggccacggccccctgagcttggccggtggccctcgggtgggcggggtggcggccgcggccactgaagcaccgcgcatggagtggaaagtgaaggtgcgcagcgacggaacccgctacgtggccaagcggcccgtgcgagatcggctgctgaaagcccgtgccctgaagatccgggaggagcgcagcggtatgacgaccgacgacgacgcggtgagcgagatgaagatgggccgctactggagcaaggaggagcggaagcagcacctgatccgggcccgtgagcagcggaagcggcgcgagttcatgatgcagagccggctggagtgcctgcgggagcagcagaatggcgacagcaagcccgagctcaacatcattgccctgagccaccgcaaaaccatgaagaagcggaacaagaagatcctggacaactggatcaccatccaggagatgctggcccacggcgcgcgctccgccgatggcaagcgggtctacaaccctcttctctcagtcaccaccgtgtgagctgcccgggcgggtacacggcccaggcccagggaaccccctggggccccggccctcactctcctatagagattgtgtgtgtgtgtgtgtgcgcgcgcgcgtgctcgctgtgcgcacgcacacatctcctcgtctgggtgtgcgcacagggctttgttagcagagagaagcccctgaggagaagggacgcttttcttccttctgcccaagtaaagtgaccatgccagtggccagcactgggggcacacctgtgatgggcaccccttcagctgtgcgtgtgcattccccatcccccatgctcttgcgtgtgcttgcacgtgcacgcacacacacacccagtgctctctccacccgacccgtgtacttgcagacagggaagctgagctgaaaggagcacaagagagtgtccggcttcgctgctgagcgcggcctctccccgccgctgcgcactgcagttatttgtagacaaaggcacccctgatttttgtggtttttctccctttctgtgcttgccaatagttgttttgttttgtggacctgccctgggggctggcagctccttcaggcagcctggcagaagtggaactcccctctccactgatggctgggaagggagttggggaggaagagtgggagggagggctggggatggatgggagggaaggggagggaaaggtgggaggaatgggaagcagctgttctggtggcttccactctgaggtgtgggaacggggagcctctggggggcacctgtttccccagtgactcagagagagcaagactgcaggaacggaggggtcctgcagggtgtccaccaagaagtcacagagcccgttctgcgccccacaccatctggagcaggggcttctcttctgagtgaactgaggaaggtgcttagatggtgagggctctagaaaccaagccccatgagcagcagtggaagacctcgggccatgcggcctggggaggacttggtggcgatccgcaacctggaccccagtgagaggcggtgggctgactgggaaggagaggcccccaacctcctcaggatttgcacgtgtgaactaggctgcctgtggggtgccccttaggcttggagagccccagattggaggcagacagactgcaccaccccttccccccctgcatctcaagaataaagcaagctgcctttgtacttggttg

SEQ ID NO: 21785 - DNA, 2853 bp, Homo sapiens
catatcatggcgctgggcaagctgcgtccgcccaccccgcccatggtcatcctggagccgtacgtcctctctgagctggccgagggaggaccctcctgtccgggacgtcgctgccggaagtgccagggttgagggcctcagctcctcctcctccatcctctctcctctgccgcctcacaagcatcactccttgaatcttcttgcatcccttgtctgtctcattcctctacctgctctgaatttcctccatctcttcagcttctttctttggcccgaccggaagaagggcctttcatccaggcctggtggctcatgaccgcccccccaatcagccatgagtattatgacccggcggagtttatggagggcggcccgcaggaggcagaccgcttggatgagctggagtatgaggaggtggagctgtataaaagcagccaccgggacaagctgggcctgatggtttgctaccgcacggacgacgaggaggacctgggcatttatgtcggagaggtaaatcccaacagcattgcagccaaagacggccggatccgtgagggagaccgcatcatccagattaacggtgtagacgtccagaaccgggaagaggcggtggccatcctgagccaggaagagaacaccaacatctccctgctggtggcccgacctgagagtcagctggcgaaaaggtggaaggacagcgaccgggatgacttcctggatgactttggctctgagaatgagggggagctgcgtgctcgtaaactgaaatcaccccctgcccagcagcccggaaacgaagaggagaagggggctcccgatgccggcccaggcctgagcaacagccaggagctggacagcggggtgggccggactgacgagagcacccggaacgaagagagctctgagcacgacctgctgggggacgaacccccgagctccaccaacaccccgggaagcctgcgcaagtttggcctgcaaggggacgccctgcagagccgggacttccatttcagcatggactctctgctggccgagggggcggggctgggagggggcgacgtcccgggcctcacggatgaggagtatgagcgctaccgtgagctcctggagatcaagtgccacctggagaacggcaaccagctgggcctcctctttccccgggcctccggaggcaacagcgccctggacgtcaaccgcaacgagagcctgggccacgagatggccatgctggaggaggagctaaggcacctggaattcaagtgccgcaacatactgcgggcgcagaagatgcagcagctgcgtgagcgctgcatgaaggcctggctgctggaggaggagagcctctacgacctggcggccagcgagcccaagaagcacgagctgtccgacatctccgagctgcccgagaagtcggacaaggacagcaccagcgcctacaacactggggagagctgccgcagcaccccgctgcttgtggagcccctgcccgagagccccctgcggcgggccatggccggcaactccaacttgaaccggacccctcccggccccgctgttgccacccccgccaaggcagctcctccaccggggagccccgccaagttccggtccctctcccgggatcctgaggccggccggaggcagcacgcggaggagcgcggccgccgcaaccccaagacggggttgaccctggagcgtgtgggccctgaaagcagcccttacctctcgcggcgccaccgcggccagggccaggagggcgagcactaccacagctgcgtgcagctggccccgacgcgaggcctggaggagctgggccacggccccctgagcttggccggtggccctcgggtgggcggggtggcggccgcggccactgaagcaccgcgcatggagtggaaagtgaaggtgcgcagcgacggaacccgctacgtggccaagcggcccgtgcgagatcggctgctgaaagcccgtgccctgaagatccgggaggagcgcagcggtatgacgaccgacgacgacgcggtgagcgagatgaagatgggccgctactggagcaaggaggagcggaagcagcacctgatccgggcccgtgagcagcggaagcggcgcgagttcatgatgcagagccggctggagtgcctgcgggagcagcagaatggcgacagcaagcccgagctcaacatcattgccctgagccaccgcaaaaccatgaagaagcggaacaagaagatcctggacaactggatcaccatccaggagatgctggcccacggcgcgcgctccgccgatggcaagcgggtctacaaccctcttctctcagtcaccaccgtgtgagctgcccgggcgggtacacggcccaggcccagggaaccccctggggccccggccctcactctcctatagagattgtgtgtgtgtgtgtgtgcgcgcgcgcgtgctcgctgtgcgcacgcacacatctcctcgtctgggtgtgcgcacagggctttgttagcagagagaagcccctgaggagaagggacgcttttcttccttctgcccaagtaaagtgaccatgccagtggccagcactgggggcacacctgtgatgggcaccccttcagctgtgcgtgtgcattccccatcccccatgctcttgcgtgtgcttgcacgtgcacgcacacacacacccagtgctctctccacccgacccgtgtacttgcagacagggaagctgagctgaaaggagcacaagagagtgtccggcttcgctgctgagcgcggcctctccccgccgctgcgcactgcagttatttgtagacaaaggcacccctgcatctcaagaataaagcaagctgcctttgtacttggttg

SEQ ID NO: 21786 - DNA, 2109 bp, Homo sapiens
cgggtcagtgaaaggcgtcttcccgttcccgccctccgcctcctctcgccggccagcaacatgggatgtaatatgtgcgtggtccagaaaccggaggagcagtacaaagtgatgctgcaggaggtggagctgtataaaagcagccaccgggacaagctgggcctgatggtttgctaccgcacggacgacgaggaggacctgggcatttatgtcggagaggtaaatcccaacagcattgcagccaaagacggccggatccgtgagggagaccgcatcatccagattaacggtgtagacgtccagaaccgggaagaggcggtggccatcctgagccaggaagagaacaccaacatctccctgctggtggcccgacctgagagtcagctggcgaaaaggtggaaggacagcgaccgggatgacttcctggatgactttggctctgagaatgagggggagctgcgtgctcgtaaactgaaatcaccccctgcccagcagcccggaaacgaagaggagaagggggctcccgatgccggcccaggcctgagcaacagccaggagctggacagcggggtgggccggactgacgagagcacccggaacgaagagagctctgagcacgacctgctgggggacgaacccccgagctccaccaacaccccgggaagcctgcgcaagtttggcctgcaaggggacgccctgcagagccgggacttccatttcagcatggactctctgctggccgagggggcggggctgggagggggcgacgtcccgggcctcacggatgaggagtatgagcgctaccgtgagctcctggagatcaagtgccacctggagaacggcaaccagctgggcctcctctttccccgggcctccggaggcaacagcgccctggacgtcaaccgcaacgagagcctgggccacgagatggccatgctggaggaggagctaaggcacctggaattcaagtgccgcaacatactgcgggcgcagaagatgcagcagctgcgtgagcgctgcatgaaggcctggctgctggaggaggagagcctctacgacctggcggccagcgagcccaagaagcacgagctgtccgacatctccgagctgcccgagaagtcggacaaggacagcaccagcgcctacaacactggggagagctgccgcagcaccccgctgcttgtggagcccctgcccgagagccccctgcggcgggccatggccggcaactccaacttgaaccggacccctcccggccccgctgttgccacccccgccaaggcagctcctccaccggggagccccgccaagttccggtccctctcccgggatcctgaggccggccggaggcagcacgcggaggagcgcggccgccgcaaccccaagacggggttgaccctggagcgtgtgggccctgaaagcagcccttacctctcgcggcgccaccgcggccagggccaggagggcgagcactaccacagctgcgtgcagctggccccgacgcgaggcctggaggagctgggccacggccccctgagcttggccggtggccctcgggtgggcggggtggcggccgcggccactgaagcaccgcgcatggagtggaaagtgaaggtgcgcagcgacggaacccgctacgtggccaagcggcccgtgcgagatcggctgctgaaagcccgtgccctgaagatccgggaggagcgcagcggtatgacgaccgacgacgacgcggtgagcgagatgaagatgggccgctactggagcaaggaggagcggaagcagcacctgatccgggcccgtgagcagcggaagcggcgcgagttcatgatgcagagccggctggagtgcctgcgggagcagcagaatggcgacagcaagcccgagctcaacatcattgccctgagccaccgcaaaaccatgaagaagcggaacaagaagatcctggacaactggatcaccatccaggagatgctggcccacggcgcgcgctccgccgatggcaagcgggtctacaaccctcttctctcagtcaccaccgtgtgagctgcccgggcgggtacacggcccaggcccagggaaccccctggggccccggccctcactctccta

SEQ ID NO: 21787 - DNA, 2032 bp, Homo sapiens
cggcagtagctctcgcctgcgggtggtttgacaaggctggcggcgccacaccagcgaccaggcctggagctcacacttctgagaggcatcgcaagcgagggccttcacgttactgagaccccagccccgcacagaggctcatggagctcgaagcacgcagggctggcctctccagagctagcagattccttctggacctgtagggtgccgccctagcccagccgccatggcgcagggtttcgcagtgggcttcgacccactgggcctaggagacctgagctccggctctctgagctccctctcctcccgaggccacctaggcagcgactcaggctccaccgcaacgcgatacctgctaaggaagcaacaacggctgctgaacgggcccccccgcggaatccgagcctcatcgcccatgggacgcgtcatcctcatcaactcccccatcgaagccaacagtgatgaaagtgacatcatccattcagtccgggtggagaagagtccagcagggaggctgggcttcagcgtgcgcgggggctcagagcatggcctgggcatcttcgtcagcaaagtggaggaaggcagcagtgcagagcgggctggcctgtgcgtgggggacaagatcacggaggtgaatgggctgagcctggagagcaccaccatgggtagcgccgtaaaggtgctgaccagcagcagccgcctgcacatgatggttcggcgcatgggccgtgtgccgggcatcaagttctccaaggagaagaccacgtgggtggatgtggtgaatcggcgcctggtagtggagaagtgcggttcaacaccctccgacaccagctcagaagatggtgtccggcgcatcgtccacctatacacaacctccgacgacttctgcctgggcttcaacatccgtgggggcaaggagtttggcctgggcatctatgtgtccaaagtggaccatggtgggctggccgaggagaatggcatcaaggtgggggaccaggtcctggcagccaacggtgtcaggtttgacgacatcagccacagccaggccgtggaggtgctgaagggccaaacgcacatcatgctgaccatcaaggagaccggccggtatcctgcctacaaggagatggtttctgagtactgctggctggaccgactgagcaacggggtgctgcagcagctgtccccggcctctgagagcagctccagcgtctcttcgtgcgcctccagcgccccctacagctcgggctccctgccgtcggaccgcatggacatctgcctcgggcaggaggagcccggcagccgcggcccaggctgggggcgggcggacacagccatgcagacggagcccgatgcgggaggccgggtggagacctggtgcagcgtgcggcccacagtcatcctcagggacaccgccatccgctcggacggcccccatcccggccgccgccttgactctgcgctctctgagtctcccaagacggctttgctgctggccctcagccgaccccggccccccatcacgcgctcccagagctatctgaccttgtgggaggagaagcagcagcggaagaaggagaagtcggggtcccctggggagaagggtgccctgcagcgctccaagacgctgatgaacctcttcttcaagggagggcggcaggggaggctagcgcgggacgggcgcagagaggcctggacactggacagcgggagcctggccaaaacttaccctcgcctggacatagagaaagagatgggggtttcaccctgttgcccaggctagtctcaaattcctggactgaagctatctacccgccttagtctcccaaagtgctaggattacagcgtgatctaccacacctggccaatcccaactactctggaagctgaagcagcaagatcacttgagcccaggagtttaagaccagcctgggcaacatagcaagaccctgtctctaaagaaaaaaaaaaagtaaaagaaaaataaagcacgtcttggctcagctgctgatttaagctgggtctaaacatctga

SEQ ID NO: 21788 - DNA, 4013 bp, Homo sapiens
tcgcctgcgggtggtttgacaaggctggcggcgccacaccagcgaccaggcctggagctcacacttctgagaggcatcgcaagcgagggccttcacgttactgagaccccagccccgcacagaggctcatggcgcagggtttcgcagtgggcttcgacccactgggcctaggagacctgagctccggctctctgagctccctctcctcccgaggccacctaggcagcgactcaggctccaccgcaacgcgatacctgctaaggaagcaacaacggctgctgaacgggcccccccgcggaatccgagcctcatcgcccatgggacgcgtcatcctcatcaactcccccatcgaagccaacagtgatgaaagtgacatcatccattcagtccgggtggagaagagtccagcagggaggctgggcttcagcgtgcgcgggggctcagagcatggcctgggcatcttcgtcagcaaagtggaggaaggcagcagtgcagagcgggctggcctgtgcgtgggggacaagatcacggaggtgaatgggctgagcctggagagcaccaccatgggtagcgccgtaaaggtgctgaccagcagcagccgcctgcacatgatggttcggcgcatgggccgtgtgccgggcatcaagttctccaaggagaagaccacgtgggtggatgtggtgaatcggcgcctggtagtggagaagtgcggttcaacaccctccgacaccagctcagaagatggtgtccggcgcatcgtccacctatacacaacctccgacgacttctgcctgggcttcaacatccgtgggggcaaggagtttggcctgggcatctatgtgtccaaagtggaccatggtgggctggccgaggagaatggcatcaaggtgggggaccaggtcctggcagccaacggtgtcaggtttgacgacatcagccacagccaggccgtggaggtgctgaagggccaaacgcacatcatgctgaccatcaaggagaccggccggtatcctgcctacaaggagatggtttctgagtactgctggctggaccgactgagcaacggggtgctgcagcagctgtccccggcctctgagagcagctccagcgtctcttcgtgcgcctccagcgccccctacagctcgggctccctgccgtcggaccgcatggacatctgcctcgggcaggaggagcccggcagccgcggcccaggctgggggcgggcggacacagccatgcagacggagcccgatgcgggaggccgggtggagacctggtgcagcgtgcggcccacagtcatcctcagggacaccgccatccgctcggacggcccccatcccggccgccgccttgactctgcgctctctgagtctcccaagacggctttgctgctggccctcagccgaccccggccccccatcacgcgctcccagagctatctgaccttgtgggaggagaagcagcagcggaagaaggagaagtcggggtcccctggggagaagggtgccctgcagcgctccaagacgctgatgaacctcttcttcaagggagggcggcaggggaggctagcgcgggacgggcgcagagaggcctggacactggacagcgggagcctggccaaaacttaccctcgcctggacatagagaaagcagggggcgtgggcccggtacagaagtttgtcacctggagactgagacgtgaccaggagaggggccgggccctgctgtctgccaggtctgggagtccctccagccagctgcctaatgtggatgagcaggttcaggcctgggagagccggcggcccctcattcaggacctggcccagaggctgctgactgatgacgaggtgctggctgtcacccgccactgctcccggtatgtgcacgagggaggcatagaggacctggtgaggcccctgctggccatcctcgacaggccggagaagctgctactgctgcaggacatcaggagtgtggtggcccccacagacctgggccgcttcgacagcatggtgatgcttgtggagctggaggcttttgaggccctcaagagcagggcagtccggcctcctgctttgagaccagcccggcaggacacgccacccaagcgtcaccttatcacccccgtgcctgacagccgcggaggcttctacctgctgccggtgaacggcttcccggaagaggaagataatggggagctgagggagcggctgggggccctcaaggtctccccaagtgcctctgcccctcgccacccccataaagggatcccccctctacaagacgtgccagtagatgccttcacccccctccgaattgcctgcacaccccctccccagctaccccccgtggctccccggcccctgcggcctaactggctgctgacagaacccctgagccgagagcaccctccgcagagccagatccggggccgggctcagagccgtagccgcagccgtagccgcagccgcagccgcagcagccggggtcaaggcaagtctccaggtagacgctccccatccccggtgcctacccctgcccccagcatgaccaatgggcgctaccacaagcctcggaaggccagaccccctctgccacgacctctggatggggaggcagccaaggtgggggccaagcaagggccctcggagagtggaactgaggggacggccaaggaggcagccatgaagaaccccagtggcgagctgaagacagtgacactgtccaagatgaagcagtccttaggtatcagcatttctgggggcattgagtccaaggtgcagcccatggtgaagatagagaagatcttccctgggggggccgctttcctcagtggggccctgcaggctggcttcgagcttgtggcagtggacggagagaatctagagcaggtgacccaccagcgtgcagtagacaccatccgtcgggcttatcgaaacaaggcccgggagcccatggagcttgtggtcagggtccccgggcccagcccacggccctcaccctctgactcatcagcccttactgatgggggccttcctgctgaccacttgcctgcccaccaaccccttgatgctgctccagttcctgcccactggctcccagaacctcccaccaatccccagactcctcccactgatgccaggctcctccagccaactcccagcccagccccctccccagccctccagactcctgattctaagcccgcaccctccccacgcatcccatgaccctccccctaacctcagattcacccactgactccagcatcccgttatccccaggacctctcctaccaacttcttcaggactctccagctcctgcccaccctgcctcctcccagtgccacactggtggctcacatctttccactttcttccctcctcagctgtcattaaggctctgccttagtgtccaaggacaaggtgctagtgggcagcctgtgtcacctgcactcactgctccccaacctcccaagccaggatagggggtgagaaagccaaggtctggagcttgggattggtgggcactttctcacatgctgtcccttatgagtcgcccaagcctccagggacacagactctcagacagggccctgaaggggtcaatgcatccattcctcaaccccaagcagcattctgtgcaaggaaacggatgaaaggcttttctagtccctgaaatcctgagagatcatttcacgttggggtccactaagacctcagacattctactggatttgtccttcctccatcaccttttctccccaagagagctctatgagggggaggagaatagccagcaaatggtgggggggggggggtcaaacaagttcctgtactctttatccagcacattcacattatttttaaacaaaaaaattttttttaattttttctttgggtttgtacaagaaatttacagtgtgaaaaatatacaagtgaaaacgaggccataaacctgggtgaagggagaggctgcttggtcacaaacacaaataaacaagacatttctg

SEQ ID NO: 21789 - DNA, 624 bp, Homo sapiens
gaccccggccccccatcacgcgctcccagagctatctgaccttgtgggaggagaagcagcagcggaagaaggagaagtcggggtcccctggggagaagggtgccctgcagcgctccaagacgctgatgaacctcttcttcaagggagggcggcaggggaggctagcgcgggacgggcgcagagaggcctggacactggacagcgggagcctggccaaaacttaccctcgcctggacatagagaaagcagggggcgtgggcccggtacagaagtttgtcacctggagactgagacgtgaccaggagaggggccgggccctgctgtctgccaggtctgggagtccctccagccagctgcctaatgtggatgagcaggttcaggcctgggagagccggcggcccctcattcaggacctggcccagaggctgctgactgatgacgaggtgctggctgtcacccgccactgctcccggtatgtgcacgagggaggcatagaggacctggtgaggcccctgctggccatcctcgacaggccggagaagctgctactgctgcaggacatcaggagtgtggtggcccccacagacctgggccgcttcgacagcatggtgatgcttgtggagc

SEQ ID NO: 21790 - DNA, 6484 bp, Homo sapiens
ggtcccggccccgctgccgccgccgccacaccggcccttcgggagcgtctgaggaggcgcgggccgctgcgggctcgggcgccgcagcgcgccggcccgagcccctggacgaggcccacggagccgctcgccccgacccagccgcccgatgtcctcaaaatggaggcagcgggggcggcggcgtgaagaaagcggcgctgtgggcgcgggagtaggggcccgggcggaggcggtggcgggatggggctgctgctcatgatcctggcgtcggccgtgctgggttccttcctcacgctcctcgcccagttcttcctgctgtaccgcagacagcccgagccgccggcggacgaggccgcccgcgcgggcgagggcttccgctacatcaagccagtgccgggcctgctcctaagggagtacctttatggcggcggccgggatgaggagccctccggagcggcccctgagggcggcgcgacccccaccgcggcccccgagacccccgccccgccgacgcgggagacttgctacttcctcaacgccaccatcctattcctgttccgggagttgcgggacaccgcgctgacccgccgctgggtcaccaagaagatcaaggtggagttcgaggagctgctgcagaccaagacggccgggcgcctgctggaggggctgagcctgcgggacgtgttcctgggcgagacggtgcccttcatcaagaccatccggctcgtgcggccagtcgtgccctcggccaccggggagcccgatggccctgaaggggaggcgctgcccgccgcctgccccgaggagctggccttcgaggcggaggtggagtacaacgggggcttccacctggccatcgacgtggacctggtcttcggcaagtccgcctacttgtttgtcaagctgtcccgcgtggtgggaaggctgcgcttggtctttacgcgcgtgcccttcacccactggttcttctccttcgtggaagacccgctgatcgacttcgaggtgcgctcccagtttgaagggcggcccatgccccagctcacctccatcatcgtcaaccagctcaagaagatcatcaagcgcaagcacaccctaccgaattacaagatcaggtttaagccgttttttccataccagaccttgcaaggatttgaagaagatgaagagcatatccatatacaacaatgggcacttactgaaggccgtcttaaagttacgttgttagaatgtagcaggttactcatttttggatcctatgacagagaggcaaatgttcattgcacacttgagttaagcagtagtgtttgggaagaaaaacagaggagttctattaagacggttgaattaataaaaggaaatttacaaagtgttggacttacacttcgtcttgtccagtcaactgatgggtatgctgggcacgtcatcattgaaactgtggctccaaactcgcctgctgcaattgcagatcttcagcggggagatcgacttatcgccattggaggtgtgaaaatcacatcaacactgcaagtgttgaagcttatcaagcaggctggtgaccgagtcctggtgtactatgaaaggcctgttggccagagtaatcaaggtgcagtgctgcaagataactttggccagttggaagaaaactttttgtcaagctcatgccaatcgggttatgaagaggaagctgccgggttgacagtagatactgaaagtagagagctggattctgaatttgaagacttggcaagtgatgtcagagcacaaaatgagttcaaagatgaggcacaatcattaagtcatagtcccaaacgtgttccaacaacactttctattaaaccccttggagctatatcaccagttttaaaccgtaaattagctgtaggaagtcacccactaccaccgaaaattcagtccaaagatggaaataaacctccacccctaaaaacttctgagataacagacccagcacaagtgtcaaaaccaacccaaggatctgctttcaaaccacctgtgccaccacgaccacaagcgaaagttcctttgccttccgccgatgctccaaatcaggcagaaccagatgttctcgttgaaaagccagagaaggtggtgccacctcctcttgtagataaatctgctgaaaagcaagcaaaaaatgtggatgccatagacgatgcagctgcacctaagcaatttttagcaaagcaagaagtggccaaagatgtcacttcagaaacttcctgccctactaaggacagttcggacgaccgtcaaacatgggaatcatcagaaattctttatcgtaataagctaggaaaatggacaagaaccagagcatcctgtttgtttgacatagaagcctgtcacaggtacttaaacattgcattgtggtgcagggatcctttcaagttgggaggtctcatctgtttggggcatgttagtttaaaacttgaagatgtggctttaggatgcctagctacatcaaacacggaatacctttccaaattgagactggaagccccctcacctaaggctatagtcactagaaccgcactacgcaatctgagtatgcaaaagggattcaatgacaaattttgctatggtgacattactattcacttcaaatatttgaaagaaggagaatcagaccaccatgtagttactaacgtagaaaaagaaaaagaaccccatttggttgaagaagtttctgttctccctaaagaggagcaatttgttggacagatgggtttaacagaaaacaaacacagttttcaggatactcagttccagaacccaacatggtgtgactactgtaagaaaaaagtttggactaaagcagcttcccagtgtatgttttgtgcttatgtttgccataaaaaatgtcaagaaaagtgtctagctgagacttctgtttgtggagcaactgataggcgaatagacaggacactgaaaaaccttaggctggaaggacaggaaaccctcttaggcctgcctcctcgtgttgatgctgaagctagcaagtcagtcaataaaacaacaggtttgacaaggcatattatcaatactagttctcgtttattaaatttgcgtcaagtctctaaaactcgcctttctgaaccaggaaccgatctcgtagaaccttcaccaaaacacacacccaacacgtcagacaacgaaggcagtgacacggaggtctgtggtccaaacagtccttctaaacggggaaacagcacaggaataaagttagtgagaaaagagggtggtctggatgacagtgttttcattgcagttaaagaaattggtcgtgatctgtacaggggcttgcctacagaggaaaggatccagaaactagagttcatgttggataagctacagaatgaaattgatcaggagttggaacacaataattcccttgttagagaagaaaaagagacaactgatacaaggaaaaaatcacttctttctgctgccttagctaaatcaggtgaaaggctacaagctctaacacttcttatgattcactacagagcaggcattgaagatatagaaactttagaaagtctgtctttagaccagcactccaaaaaaataagcaagtacacagatgatacagaagaagaccttgataatgaaataagccaactaatagactctcagccattcagcagcatatcagatgacttatttggcccatccgagtctgtgtagcagacaggtctatttaagctttcaaatgaacagggtaaagttgcatctaaagtaccacagatacaaccatgtttaaatcctcgtatgcactctggcctgcttctccagttacttgcttgtgtaagaacaaaaatgagaaaggttgttttccagtaaaaacatgaccagcttactaattggttgttttggattgcatttatagctatgcttttttgggtttatactgggaatttatttttactaaattatttaacttttctaattatgtaattatgtaagctagcttttcatgtttatgtatgtatggtgtccccttgtgttatttttcttcctcttggtttttgaattagtgttaaatagaatactgtctagattcttaaaatattttcatttccatcatggttataacaaatttgctgcatgcccaaactgacaacagcaatcactgagggaacaggttttgaatctttcttttgtgttatgaagtttatcgtctctacttgcttgagatttttgttattttgggggtttgggggtgctttttgttttgtttttgccaaatgtaacatgaaagcagatgctgcagctttagtctgttatgctgatttagtaaaaaaaaattttttacatatattgcttgctttcgatgcttctgtgaaatttttttctaaagcttttgtgcagctgtatggtaaaaatatggtgattaatttgaagagcttacattgaaagacaatgtaataggaaataaatgtagattgcagttggtcaagaattttgtagagaggataacaagacttaattactgaaaaacagtaacatagcattttgaaatataatcttttaaaatattgatgctttccttttaaatggaaatttaaattttataattaaaagtttaaacatttatgataattttcctcatcagttctcccataggaaataaagcatgtgaaagggtatttaaagttttggaggactctttttaaaatgactgtgttgataactagtttgggctggttttgttttagaaaaaacattttcatgtaggagtattctgtgaaggaaaggaatcatgcaaaatatactttttgctttggcgtcttacagttgtaaaggaatggtgatcattctgaatacttctgtagtgagtattcattaagaaaagaatgacaaaaatagtattcatacataggaattgggaccagttctctgaaaatgaagatatactcacactgggtccattttacgggtcccagtaacatttgactgagggaaaacaagtaagctcgactgttgttggggtaccttaatggtttcggtctgttatatacctataaaatagacaagtatatgtttgtccctttgtaggtaactgctatgatgattgctatatagtgaaactgacatgagtttaaaactagatggagcagcttttattgctggcaggaaaaagcatggtgtaatattaaggactggggcccaggtctagactccaggactccataaaagagtttaagttcaagcccttccattaatgaactgtgtaagcataggcagttacaaaaggacccatctctaaaatgggaataataatactttacctccctcacagtattgttgtgagggaaacaatagcataactgcaaaagtgctttgaacagtaaaaagatatacaagtaaaaggcattatttatatgagtaagaaagacatttttgaggggagaaaagttattccactttaaaaatcaatagccaagtctcatgccttttgttactttagtaagcgaaaatttcaggtactaaatacctttcttagccaagtttataacaaaaacatctcagtatacttcattacttatttaagcgtgatgtcttttttttttttttttttttttttttttttttttttttttgagacagagtctcgctgtctcccaggctggagtgcagtggcatgatctcggctcactgcaagctccgcctcccaggttcacgccattctcctgcctcagcctccggagtagctgggagtacaggcgcggctaattttttgtatttttagtagagacggggtttcaccatgttagccaggatggtctcgatctcctgacctcgtgatccacctgcctcggcctcccaaagtgctgggattacaggcgtgagccaccacgcccggccacgtgatcttattttaaaagaacactgctatagaagaatttacacaccaaattccctgaaagctaaagtattgttccataacttacacttgaggcaatctgctcagtgtgtaaccactttataaaaaataacttaccattgataacctggaaggtggactacttgtaagtagctggtgtttattgattaaaccatggaagttttcatgatacccaagcatgttgctgaaactgatgcatttgaaagagctgttgaaataatgcaaaactttggttttataagaatctactcatgttttaaaagtatttaactctgtagaccacaattatagaaagctcagtaatgctgctaatgacatttgtaaactatatctgtaatgtagtgcaatatttttatatttcactgggagaggcagtagagacatcatagttgtactttagtgcaagtgggggaacactccaaatagcctagagtatagtaaggtacaaagcttcaatgaaaaaagctgtattatattacattactgatgtaatcttgctgccatgctatgtatcaatagctaaaaaataataataaagactaccacagaaaacaagaa

SEQ ID NO: 21791 - DNA, 4248 bp, Homo sapiens
gtccggggagagccagcgagcgcgcgggcggcgtagccggcctgtctgggccgcctcgtggggagggagggggcgcccggccgcccggcggcgaccccggggcctggccgccaccatgggcttcgagctggaccgcttcgacggcgacgtggacccggacctgaagtgcgcgctgtgccacaaggtcctggaggacccgctgaccacgccgtgcggccacgtcttctgcgccggctgcgtgctgccctgggtggtgcaggagggcagctgcccggcgcgctgccgcggtcgcctgtcggccaaagagctcaaccacgtcctgccgctcaagcgccttatcctcaagctggacatcaagtgcgcgtacgcgacgcgcggctgcggccgggtggtcaagctgcagcagctgccggagcacctcgagcgctgcgacttcgcgcccgcgcgctgtcgccacgcgggttgcggccaggtgctgctgcggcgcgacgtggaggcgcacatgcgcgacgcctgcgacgcgcggccagtgggccgctgccaggagggctgcgggctacccttgacgcacggcgagcagcgcgcgggcggccactgctgcgcgcgagcgctgcgggcgcacaacggcgcgctccaggcccgcctgggcgcgctgcacaaggcgctcaagaaggaggcgctgcgcgctgggaagcgcgagaagtcgctggtggcccagctggccgcggcgcagcttgagctgcagatgaccgcgctgcgctaccagaagaaattcaccgaatacagcgcgcgcctcgactcgctcagccgctgcgtggccgcgccgcccggcggcaagggcgaagaaaccaaaagtctgactcttgtcctgcatcgggactccggctccctgggattcaatattattggtggccggccgagtgtggataaccacgatggatcatccagtgaaggaatctttgtatccaagatagttgacagtgggcctgcagccaaggaaggaggcctgcaaattcatgacaggattattgaggtcaacggcagagacttatccagagcaactcatgaccaggctgtggaagctttcaagacagccaaggagcccatagtggtgcaggtgttgagaagaacaccaaggaccaaaatgttcacgcctccatcagagtctcagctggtggacacgggaacccaaaccgacatcacctttgaacatatcatggccctcactaagatgtcctctcccagcccacccgtgctggatccctatctcttgccagaggagcatccctcagcccatgaatactacgatccaaatgactacattggagacatccatcaggagatggacagggaggagctggagctggaggaagtggacctctacagaatgaacagccaggacaagctgggcctcactgtgtgctaccggacggacgatgaagacgacattgggatttatatcagtgagattgaccctaacagcattgcagccaaggatgggcgcatccgagaaggagaccgcattatccagattaatgggatagaggtgcagaaccgtgaagaggctgtggctcttctaaccagtgaagaaaataaaaacttttcattgctgattgcaaggcctgaactccagctggatgagggctggatggatgatgacaggaacgactttctggatgacctgcacatggacatgctggaggagcagcaccaccaggccatgcaattcacagctagcgtgctgcagcagaagaagcacgacgaagacggtgggaccacagatacagccaccatcttgtccaaccagcacgagaaggacagcggtgtggggcggaccgacgagagcacccgtaatgacgagagctcggagcaagagaacaatggcgacgacgccaccgcatcctccaacccgctggcggggcagaggaagctcacctgcagccaggacaccttgggcagcggcgacctgcccttcagcaacgagtctttcatttcggccgactgcacggacgccgactacctggggatcccggtggacgagtgcgagcgcttccgcgagctcctggagctcaagtgccaggtgaagagcgccaccccttacggcctgtactaccctagcggccccctggacgccggcaagagtgaccctgagagcgtggacaaggagctggagctgctgaacgaagagctgcgcagcatcgagctggagtgcctgagcatcgtgcgcgcccacaagatgcagcagctcaaggagcagtaccgcgagtcctggatgctgcacaacagcggcttccgcaactacaacaccagcatcgacgtgcgcagacacgagctctcagatatcaccgagctcccggagaaatccgacaaggacagctcgagcgcctacaacacaggcgagagctgccgcagcaccccgctcaccctggagatctcccccgacaactccttgaggagagcggcggagggcatcagctgcccgagcagcgaaggggctgtggggaccacggaagcctacgggccagcctccaagaatctgctctccatcacggaagatcccgaagtgggcacccctacctatagcccgtccctgaaggagctggaccccaaccagcccctggaaagcaaagagcggagagccagcgacgggagccggagccccacgcccagccagaagctgggcagcgcctacctgccctcctatcaccactccccatacaagcacgcgcacatcccggcgcacgcccagcactaccagagctacatgcagctgatccagcagaagtcggccgtggagtacgcgcaaagccagatgagcctggtgagcatgtgcaaggacctgagctctcccaccccgtcggagccgcgcatggagtggaaggtgaagatccgcagcgacgggacgcgctacatcaccaagaggcccgtgcgggaccgcctgctgcgggagcgcgccctgaagatccgggaagagcgcagcggcatgaccaccgacgacgacgcggtgagcgagatgaagatggggcgctactggagcaaggaggagaggaagcagcacctggtgaaggccaaggagcagcggcggcggcgcgagttcatgatgcagagcaggttggattgtctcaaggagcagcaagcagccgatgacaggaaggagatgaacattctcgaactgagccacaaaaagatgatgaagaagaggaataagaaaatcttcgataactggatgacgatccaagaactcttaacccacggcacaaaatccccggacggcactagagtatacaattccttcctatcggtgactactgtataattttcacttctgcattatgtacataaaggagaccactaccactggggtagaaattcctgcctcgttcaatgcggcaagtttttgtatataagataagtacggtcttcatgtttatagtccaaatttgcaaaccctacaactctgggtgtcataggtctattttaagggaagagagagaaaaacacccttactatcttggaaggcaatattaacaaacagagcttttttcaaatagcaattgtacttttctacctgtacccttttacataaagtgtttaaatttcagaaagatcttttattaagcatactttcacagaataacttgtttaaactatattcatataaaaaagttaaacacgctttttttcctgcctaaaacacaaatacaactgccagtatgtatttttaatggaaccctattttataatggtacgttactgaatgtgtttcatatgcgtgaccgttaagatattatcatttaggtgaaggtttcaactcaaaaccacccaacccggtggttaacgatttaatacatataaccaaaccggcagcgtttagagttgggatatacatttaaacattttcctggttaaggttcccaagagagtgtaaaggttttagcagaaagcaaaatatcttgcatctttatggaagtttaaagcatgtttgcaaatattgcagcccattgaaagaatttgcatgtacaggaaagttgtggatggagacggtttgtggaattttaagtgctcattgtagtaaacttttgctttgtagatttgaaggtacagacttatacaggcaagttcacaaaatcatgattagttacaaacagtaaaatgaagttaaaataaattattattttctatttgatatgttttgatgtgattcctcattttgcagtggtgcctataaaataaaagccttttgcagtg

SEQ ID NO: 21792 - DNA, 2288 bp, Homo sapiens
gagcgcgcgggcggcgtagccggcctgtctgggccgcctcgtggggagggagggggcgcccggccgcccggcggcgaccccggggcctggccgccaccatgggcttcgagctggaccgcttcgacggcgacgtggacccggacctgaagtgcgcgctgtgccacaaggtcctggaggacccgctgaccacgccgtgcggccacgtcttctgcgccggctgcgtgctgccctgggtggtgcaggagggcagctgcccggcgcgctgccgcggtcgcctgtcggccaaagagctcaaccacgtcctgccgctcaagcgccttatcctcaagctggacatcaagtgcgcgtacgcgacgcgcggctgcggccgggtggtcaagctgcagcagctgccggagcacctcgagcgctgcgacttcgcgcccgcgcgctgtcgccacgcgggttgcggccaggtgctgctgcggcgcgacgtggaggcgcacatgcgcgacgcctgcgacgcgcggccagtgggccgctgccaggagggctgcgggctacccttgacgcacggcgagcagcgcgcgggcggccactgctgcgcgcgagcgctgcgggcgcacaacggcgcgctccaggcccgcctgggcgcgctgcacaaggcgctcaagaaggaggcgctgcgcgctgggaagcgcgagaagtcgctggtggcccagctggccgcggcgcagcttgagctgcagatgaccgcgctgcgctaccagaagaaattcaccgaatacagcgcgcgcctcgactcgctcagccgctgcgtggccgcgccgcccggcggcaagggcgaagaaaccaaaagtctgactcttgtcctgcatcgggactccggctccctgggattcaatattattggtggccggccgagtgtggataaccacgatggatcatccagtgaaggaatctttgtatccaagatagttgacagtgggcctgcagccaaggaaggaggcctgcaaattcatgacaggattattgaggtcaacggcagagacttatccagagcaactcatgaccaggctgtggaagctttcaagacagccaaggagcccatagtggtgcaggtgttgagaagaacaccaaggaccaaaatgttcacgcctccatcagagtctcagctggtggacacgggaacccaaaccgacatcacctttgaacatatcatggccctcactaagatgtcctctcccagcccacccgtgctggatccctatctcttgccagaggagcatccctcagcccatgaatactacgatccaaatgactacattggagacatccatcaggagatggacagggaggagctggagctggaggaagtggacctctacagaatgaacagccaggacaagctgggcctcactgtgtgctaccggacggacgatgaagacgacattgggatttatatcagtgagattgaccctaacagcattgcagccaaggatgggcgcatccgagaaggagaccgcattatccagattaatgggatagaggtgcagaaccgtgaagaggctgtggctcttctaaccagtgaagaaaataaaaacttttcattgctgattgcaaggcctgaactccagctggatgagggctggatggatgatgacaggaacgactttctggatgacctgcacatggacatgctggaggagcagcaccaccaggccatgcaattcacagctagcgtgctgcagcagaagaagcacgacgaagacggtgggaccacagatacagccaccatcttgtccaaccagcacgagaaggacagcggtgtggggcggaccgacgagagcacccgtaatgacgagagctcggagcaagagaacaatggcgacgacgccaccgcatcctccaacccgctggcggggcagaggaagctcacctgcagccaggacaccttgggcagcggcgacctgcccttcagcaacgagtctttcatttcggccgactgcacggacgccgactacctggggatcccggtggaaggtgaagatccgcagcgacgggacgcgctacatcaccaagaggcccgtgcgggaccgcctgctgcgggagcgcgccctgaagatccgggaagagcgcagcggcatgaccaccgacgacgacgcggtgagcgagatgaagatggggcgctactggagcaaggaggagaggaagcagcacctggtgaaggccaaggagcagcggcggcggcgcgagttcatgatgcagagcaggttggattgtctcaaggagcagcaagcagccgatga

SEQ ID NO: 21793 - DNA, 2778 bp, Homo sapiens
gcgaggggaggaagggaagcgtggaaggggggagagagttgttgtctagcctctgagagcagcgccaatgtgaagcgttgcagtcgcttgactcacctgaggctctccaaggataccttcaatgcctgcactgtaagggagctgcttttcccgggtgctggcgagaacggaagccttcctttgacgtttttctaaacatgggatgcagtctgtgcagcctgcagaagcaagaggagcagtacaaattactctatgaagtttgtcaggtcaacggcagagacttatccagagcaactcatgaccaggctgtggaagctttcaagacagccaaggagcccatagtggtgcaggtgttgagaagaacaccaaggaccaaaatgttcacgcctccatcagagtctcagctggtggacacgggaacccaaaccgacatcacctttgaacatatcatggccctcactaagatgtcctctcccagcccacccgtgctggatccctatctcttgccagaggagcatccctcagcccatgaatactacgatccaaatgactacattggagacatccatcaggagatggacagggaggagctggagctggaggaagtggacctctacagaatgaacagccaggacaagctgggcctcactgtgtgctaccggacggacgatgaagacgacattgggatttatatcagtgagattgaccctaacagcattgcagccaaggatgggcgcatccgagaaggagaccgcattatccagattaatgggatagaggtgcagaaccgtgaagaggctgtggctcttctaaccagtgaagaaaataaaaacttttcattgctgattgcaaggcctgaactccagctggatgagggctggatggatgatgacaggaacgactttctggatgacctgcacatggacatgctggaggagcagcaccaccaggccatgcaattcacagctagcgtgctgcagcagaagaagcacgacgaagacggtgggaccacagatacagccaccatcttgtccaaccagcacgagaaggacagcggtgtggggcggaccgacgagagcacccgtaatgacgagagctcggagcaagagaacaatggcgacgacgccaccgcatcctccaacccgctggcggggcagaggaagctcacctgcagccaggacaccttgggcagcggcgacctgcccttcagcaacgagtctttcatttcggccgactgcacggacgccgactacctggggatcccggtggacgagtgcgagcgcttccgcgagctcctggagctcaagtgccaggtgaagagcgccaccccttacggcctgtactaccctagcggccccctggacgccggcaagagtgaccctgagagcgtggacaaggagctggagctgctgaacgaagagctgcgcagcatcgagctggagtgcctgagcatcgtgcgcgcccacaagatgcagcagctcaaggagcagtaccgcgagtcctggatgctgcacaacagcggcttccgcaactacaacaccagcatcgacgtgcgcagacacgagctctcagatatcaccgagctcccggagaaatccgacaaggacagctcgagcgcctacaacacaggcgagagctgccgcagcaccccgctcaccctggagatctcccccgacaactccttgaggagagcggcggagggcatcagctgcccgagcagcgaaggggctgtggggaccacggaagcctacgggccagcctccaagaatctgctctccatcacggaagatcccgaagtgggcacccctacctatagcccgtccctgaaggagctggaccccaaccagcccctggaaagcaaagagcggagagccagcgacgggagccggagccccacgcccagccagaagctgggcagcgcctacctgccctcctatcaccactccccatacaagcacgcgcacatcccggcgcacgcccagcactaccagagctacatgcagctgatccagcagaagtcggccgtggagtacgcgcaaagccagatgagcctggtgagcatgtgcaaggacctgagctctcccaccccgtcggagccgcgcatggagtggaaggtgaagatccgcagcgacgggacgcgctacatcaccaagaggcccgtgcgggaccgcctgctgcgggagcgcgccctgaagatccgggaagagcgcagcggcatgaccaccgacgacgacgcggtgagcgagatgaagatggggcgctactggagcaaggaggagaggaagcagcacctggtgaaggccaaggagcagcggcggcggcgcgagttcatgatgcagagcaggttggattgtctcaaggagcagcaagcagccgatgacaggaaggagatgaacattctcgaactgagccacaaaaagatgatgaagaagaggaataagaaaatcttcgataactggatgacgatccaagaactcttaacccacggcacaaaatccccggacggcactagagtatacaattccttcctatcggtgactactgtataattttcacttctgcattatgtacataaaggagaccactaccactggggtagaaattcctgcctcgttcaatgcggcaagtttttgtatataagataagtacggtcttcatgtttatagtccaaatttgcaaaccctacaactctgggtgtcataggtctattttaagggaagagagagaaaaacacccttactatcttggaaggcaatattaacaaacagagcttttttc

SEQ ID NO: 21794 - DNA, 2927 bp, Homo sapiens
agcatttgctcagtactctcaacataaaccaagcttagatcgcaatgaaactgcggacctgcaggctgccttgcttcactgagtcaatttttaaatgaagatggaacacaagaggatgatcttattgttcagtaaatttactctaatacataaaccccatggtggaagatggtatttggtcaacggcagagacttatccagagcaactcatgaccaggctgtggaagctttcaagacagccaaggagcccatagtggtgcaggtgttgagaagaacaccaaggaccaaaatgttcacgcctccatcagagtctcagctggtggacacgggaacccaaaccgacatcacctttgaacatatcatggccctcactaagatgtcctctcccagcccacccgtgctggatccctatctcttgccagaggagcatccctcagcccatgaatactacgatccaaatgactacattggagacatccatcaggagatggacagggaggagctggagctggaggaagtggacctctacagaatgaacagccaggacaagctgggcctcactgtgtgctaccggacggacgatgaagacgacattgggatttatatcagtgagattgaccctaacagcattgcagccaaggatgggcgcatccgagaaggagaccgcattatccagattaatgggatagaggtgcagaaccgtgaagaggctgtggctcttctaaccagtgaagaaaataaaaacttttcattgctgattgcaaggcctgaactccagctggatgagggctggatggatgatgacaggaacgactttctggatgacctgcacatggacatgctggaggagcagcaccaccaggccatgcaattcacagctagcgtgctgcagcagaagaagcacgacgaagacggtgggaccacagatacagccaccatcttgtccaaccagcacgagaaggacagcggtgtggggcggaccgacgagagcacccgtaatgacgagagctcggagcaagagaacaatggcgacgacgccaccgcatcctccaacccgctggcggggcagaggaagctcacctgcagccaggacaccttgggcagcggcgacctgcccttcagcaacgagtctttcatttcggccgactgcacggacgccgactacctggggatcccggtggacgagtgcgagcgcttccgcgagctcctggagctcaagtgccaggtgaagagcgccaccccttacggcctgtactaccctagcggccccctggacgccggcaagagtgaccctgagagcgtggacaaggagctggagctgctgaacgaagagctgcgcagcatcgagctggagtgcctgagcatcgtgcgcgcccacaagatgcagcagctcaaggagcagtaccgcgagtcctggatgctgcacaacagcggcttccgcaactacaacaccagcatcgacgtgcgcagacacgagctctcagatatcaccgagctcccggagaaatccgacaaggacagctcgagcgcctacaacacaggcgagagctgccgcagcaccccgctcaccctggagatctcccccgacaactccttgaggagagcggcggagggcatcagctgcccgagcagcgaaggggctgtggggaccacggaagcctacgggccagcctccaagaatctgctctccatcacggaagatcccgaagtgggcacccctacctatagcccgtccctgaaggagctggaccccaaccagcccctggaaagcaaagagcggagagccagcgacgggagccggagccccacgcccagccagaagctgggcagcgcctacctgccctcctatcaccactccccatacaagcacgcgcacatcccggcgcacgcccagcactaccagagctacatgcagctgatccagcagaagtcggccgtggagtacgcgcaaagccagatgagcctggtgagcatgtgcaaggacctgagctctcccaccccgtcggagccgcgcatggagtggaaggtgaagatccgcagcgacgggacgcgctacatcaccaagaggcccgtgcgggaccgcctgctgcgggagcgcgccctgaagatccgggaagagcgcagcggcatgaccaccgacgacgacgcggtgagcgagatgaagatggggcgctactggagcaaggaggagaggaagcagcacctggtgaaggccaaggagcagcggcggcggcgcgagttcatgatgcagagcaggttggattgtctcaaggagcagcaagcagccgatgacaggaaggagatgaacattctcgaactgagccacaaaaagatgatgaagaagaggaataagaaaatcttcgataactggatgacgatccaagaactcttaacccacggcacaaaatccccggacggcactagagtatacaattccttcctatcggtgactactgtataattttcacttctgcattatgtacataaaggagaccactaccactggggtagaaattcctgcctcgttcaatgcggcaagtttttgtatataagataagtacggtcttcatgtttatagtccaaatttgcaaaccctacaactctgggtgtcataggtctattttaagggaagagagagaaaaacacccttactatcttggaaggcaatattaacaaacagagcttttttcaaatagcaattgtacttttctacctgtacccttttacataaagtgtttaaatttcagaaagatcttttattaagcatactttcacagaataacttgtttaaactatattcatataaaaaagttaaacacgctttttttcctgcctaaaacacaaatacaactgccagtatgtatttttaatggaaccctattttataatggtacgttactgaatgtgtttcatatgcgtgaccgtta

SEQ ID NO: 21795 - DNA, 3411 bp, Homo sapiens
aagatacttagggaaagcgaagaagagcatgctgctacacaccactctggcttacgcttccagctaacagcggtttgtctgtgtttctggactgaagtgactgatgaaaaacagtagtcaagtctggagggtgattccctttcagttcacttgcctttcagttctggggaaattagaagatttgctctctctctctgcttcttagaatgggctgcaatttgtgcacttttcagaaaagagaggaacactacaaactgctgtatgaagtttcccaggagctgtgacttgaacaatgctattctgcatgaaattgagaaattgccagtgttcccaacctgatggagagtatgtgtgggatcttagttctgcttcattaagctccttgtgaatgagtggtaagagacaatttttccttaaacctttggcattgttgacatgttggccatccactgtcaatgggaaggatctttcaaaggccactcatgaagaggcagtggaagcttttcgcaatgccaaggagcccattgtggtgcaggtgttaaggcgaacacctcttagtagaccagcctatgggatggcttcagaagtgcagcttatgaatgccagcactcagacggacatcaccttcgaacacatcatggctctggccaagcttcgtccacctacccctccagtgccagacatctgtccattcctgctctcagacagctgccattctctacatccaatggagcatgaattttatgaggacaatgagtatatttccagcttgcctgctgatgcagacagaacagaagactttgaatatgaggaggtcgagttgtgtcgtgttagcagtcaagagaagctgggcctgacagtctgttaccgaacagatgatgaagaagacaccggcatttatgtcagcgaggttgacccaaatagcattgctgccaaagacggccggattcgagaaggggatcggattttgcaaataaatggggaagatgtccagaatcgagaagaagcagtggccttgctgtctaacgatgagtgtaagagaatcgtgctgcttgttgcaaggccagagattcagctggatgaaggctggctggaagatgaaaggaatgaattcttagaggagttaaacttggagatgttggaagaagagcataatgaagcaatgcagcccactgccaatgaggtggagcagccaaaaaagcaagaagaagaagaaggcacaacagacactgcaacatcctcatccaacaaccatgagaaggacagtggagtaggacgtacagatgaaagcttgcgaaatgatgagagctcagagcaggagaatgcagccgaggaccccaatagcacatctttgaagagcaagagagacctggggcagagccaagacactctgggaagtgttgaacttcagtacaatgagagcctcgtatctggtgaatacattgactcagactgcattggcaacccagatgaggactgtgaaagattcaggcagctcttggagctcaaatgcaagattcgaaatcatggagagtatgacctgtattactcaagcagcacaattgaatgcaatcaaggggagcaagagggagtggagcatgagctacagttgcttaatgaagaactgagaaacattgagcttgagtgtcagaatatcatgcaggctcacaggctccagaaagtgacagaccagtatggagacatctggacattgcatgatggaggattccggaattataacaccagcatagatatgcaaaggggaaagctagatgacatcatggagcatccagaaaagtctgacaaggacagttctagtgcttacaacacagctgagagctgcagaagtactccgctcactgtagaccgttcccctgacagttcccttccaagggtgatcaacctcaccaataagaaaaacctgagaagcacaatggcagccacccagtcctcttccggacagagcagtaaagagtcgacctccaccaaagccaaaaccactgagcaaggttgtagcgctgaaagcaaggagaaggttttagaaggcagcaagcttcctgatcaagagaaggcagtcagcgaacacatcccttacctctctccttaccacagctcctcatatagatatgcaaacatcccagcacacgcccggcattatcaaagctacatgcagttaattcaacagaaatctgcagtcgagtatgctcagagtcagctcagcttggtgagcatgtgcaaggagtctcagaagtgttcagagcccaagatggaatggaaggtgaaaattaggagcgacgggacacggtacatcacaaagagacccgtgcgagaccgaatcctgaaggaacgtgccttaaagatcaaggaagagcggagtggcatgaccacagacgatgacaccatgagcgagatgaaaatggggcgctactggagcaaagaggagagaaagcagcacctggttagggccaaagagcagcgccgtcgccgtgagttcatgatgcgaagcaggttagagtgtctcaaggagagccctcagagcggcagtgagggcaagaaggagatcaatatcattgaactgagtcacaaaaagatgatgaaaaagagaaacaagaaaattttggacaactggatgacaatccaagaactgatgacccatggggccaagtctccagatggcacgagagtccataatgccttcttgtcggtgaccactgtatgaccgaatgaatggaatgcatgcgactgattttaggaggatgctaccagtttcggtagagtatgattgcctcgttcaatgtggcgtttttatatatattttgtgactctttatagtttaaattttttgtaagcaaaaaatacctggtaatttttcatttgtttttcatatactggtaccttctttttggctgagatctttcttttacttgtgatatattcatattactcgtttataaaaaatcaaaaacaaaaggaaagaaaacaaaaaaaacttgcacaaaaatactgaggagccaattaatttcctacttcaatgtatctaatgtaagtgaaaatctggatttatttctctagtttacttattttctactttaataataactcaatgccaaaatatttctatgcttgtttcttggcataatacattttaaatcaaacctgttcgtaataaatcatgtgccacatcttgtcttacacataaaagccactgcttttaacatcccattgtacatttaacacataaatggtgttaacatcccattgtacatttaacacataaatggccattgtctttgtctcagtaaagtgtaggtggacaatcttcctgtgatatgtagtgacattggtcatgtagctagataattatggtaattgtgacaattaaagagaaataaattattgattatccttcag

SEQ ID NO: 21796 - DNA, 3347 bp, Homo sapiens
tccctaacatgggctttgccctggagcgcttcgcagaagccgtggacccggctctggagtgcaaactgtgcggccaggtgcttgaagagcccctgtgcacgccgtgcgggcacgtcttctgcgccagctgcctgttgccctgggcggtgcggaggcgccggtgcccgctgcagtgccagcccttggcgcccggcgagctgtaccgggtgctgccgctgcgcagcctcatccagaagctgcgagtccagtgcgactaccgcgcccgcggctgcggccactcggtcaggctgcacgagctggaggcgcacgtcgagcactgcgacttcggccctgcccgccggctccgcagccgcgggggctgcgcttcggggctgggcggtggtgaggtgcccgcgcgggggggctgcggtccgacacccagggctggccggggcgggggcgcgcgcggggggccgccgggcggccgctggggccgcgggcggggacccgggcctcgggtcctcgcctggaggcggcgcgagaaggcgctgctggcgcagctctgggcgctgcagggcgaggtgcagctcacggcgcgcaggtaccaggagaagttcacccaatacatggctcacgtccgcaacttcgtcggcgacctcggtggcggccaccgcagggatggagagcataagccattcactattgtgttagaaagagaaaatgacactttgggattcaatattataggaggtcgaccaaatcagaataatcaggaaggaacatcgactgaaggaatttacgtttcaaaaattttagaaaatggacctgctgacagagcagatggcctggagattcatgacaaaatcatggaggtcaatgggaaggatctttcaaaggccactcatgaagaggcagtggaagcttttcgcaatgccaaggagcccattgtggtgcaggtgttaaggcgaacacctcttagtagaccagcctatgggatggcttcagaagtgcagcttatgaatgccagcactcagacggacatcaccttcgaacacatcatggctctggccaagcttcgtccacctacccctccagtgccagacatctgtccattcctgctctcagacagctgccattctctacatccaatggagcatgaattttatgaggacaatgagtatatttccagcttgcctgctgatgcagacagaacagaagactttgaatatgaggaggtcgagttgtgtcgtgttagcagtcaagagaagctgggcctgacagtctgttaccgaacagatgatgaagaagacaccggcatttatgtcagcgaggttgacccaaatagcattgctgccaaagacggccggattcgagaaggggatcggattttgcaaataaatggggaagatgtccagaatcgagaagaagcagtggccttgctgtctaacgatgagtgtaagagaatcgtgctgcttgttgcaaggccagagattcagctggatgaaggctggctggaagatgaaaggaatgaattcttagaggagttaaacttggagatgttggaagaagagcataatgaagcaatgcagcccactgccaatgaggtggagcagccaaaaaagcaagaagaagaagaaggcacaacagacactgcaacatcctcatccaacaaccatgagaaggacagtggagtaggacgtacagatgaaagcttgcgaaatgatgagagctcagagcaggagaatgcagccgaggaccccaatagcacatctttgaagagcaagagagacctggggcagagccaagacactctgggaagtgttgaacttcagtacaatgagagcctcgtatctggtgaatacattgactcagactgcattggcaacccagatgaggactgtgaaagattcaggcagctcttggagctcaaatgcaagattcgaaatcatggagagtatgacctgtattactcaagcagcacaattgaatgcaatcaaggggagcaagagggagtggagcatgagctacagttgcttaatgaagaactgagaaacattgagcttgagtgtcagaatatcatgcaggctcacaggctccagaaagtgacagaccagtatggagacatctggacattgcatgatggaggattccggaattataacaccagcatagatatgcaaaggggaaagctagatgacatcatggagcatccagaaaagtctgacaaggacagttctagtgcttacaacacagctgagagctgcagaagtactccgctcactgtagaccgttcccctgacagttcccttccaagggtgatcaacctcaccaataagaaaaacctgagaagcacaatggcagccacccagtcctcttccggacagagcagtaaagagtcgacctccaccaaagccaaaaccactgagcaaggttgtagcgctgaaagcaaggagaaggttttagaaggcagcaagcttcctgatcaagagaaggcagtcagcgaacacatcccttacctctctccttaccacagctcctcatatagatatgcaaacatcccagcacacgcccggcattatcaaagctacatgcagttaattcaacagaaatctgcagtcgagtatgctcagagtcagctcagcttggtgagcatgtgcaaggagtctcagaagtgttcagagcccaagatggaatggaaggtgaaaattaggagcgacgggacacggtacatcacaaagagacccgtgcgagaccgaatcctgaaggaacgtgccttaaagatcaaggaagagcggagtggcatgaccacagacgatgacaccatgagcgagatgaaaatggggcgctactggagcaaagaggagagaaagcagcacctggttagggccaaagagcagcgccgtcgccgtgagttcatgatgcgaagcaggttagagtgtctcaaggagagccctcagagcggcagtgagggcaagaaggagatcaatatcattgaactgagtcacaaaaagatgatgaaaaagagaaacaagaaaattttggacaactggatgacaatccaagaactgatgacccatggggccaagtctccagatggcacgagagtccataatgccttcttgtcggtgaccactgtatgaccgaatgaatggaatgcatgcgactgattttaggaggatgctaccagtttcggtagagtatgattgcctcgttcaatgtggcgtttttatatatattttgtgactctttatagtttaaattttttgtaagcaaaaaatacctggtaatttttcatttgtttttcatatactggtaccttctttttggctgagatctttcttttacttgtgatatattcatattactcg

SEQ ID NO: 21797 - DNA, 3041 bp, Homo sapiens
acgggggagtgttgccatgaactgactggaaactctgtgtgtgtatccgtgagtgcaagatacttagggaaagcgaagaagagcatgctgctacacaccactctggcttacgcttccagctaacagcggtttgtctgtgtttctggactgaagtgactgatgaaaaacagtagtcaagtctggagggtgattccctttcagttcacttgcctttcagttctggggaaattagaagatttgctctctctctctgcttcttagaatgggctgcaatttgtgcacttttcagaaaagagaggaacactacaaactgctgtatgaagtttcccaggtcaatgggaaggatctttcaaaggccactcatgaagaggcagtggaagcttttcgcaatgccaaggagcccattgtggtgcaggtgttaaggcgaacacctcttagtagaccagcctatgggatggcttcagaagtgcagcttatgaatgccagcactcagacggacatcaccttcgaacacatcatggctctggccaagcttcgtccacctacccctccagtgccagacatctgtccattcctgctctcagacagctgccattctctacatccaatggagcatgaattttatgaggacaatgagtatatttccagcttgcctgctgatgcagacagaacagaagactttgaatatgaggaggtcgagttgtgtcgtgttagcagtcaagagaagctgggcctgacagtctgttaccgaacagatgatgaagaagacaccggcatttatgtcagcgaggttgacccaaatagcattgctgccaaagacggccggattcgagaaggggatcggattttgcaaataaatggggaagatgtccagaatcgagaagaagcagtggccttgctgtctaacgatgagtgtaagagaatcgtgctgcttgttgcaaggccagagattcagctggatgaaggctggctggaagatgaaaggaatgaattcttagaggagttaaacttggagatgttggaagaagagcataatgaagcaatgcagcccactgccaatgaggtggagcagccaaaaaagcaagaagaagaagaaggcacaacagacactgcaacatcctcatccaacaaccatgagaaggacagtggagtaggacgtacagatgaaagcttgcgaaatgatgagagctcagagcaggagaatgcagccgaggaccccaatagcacatctttgaagagcaagagagacctggggcagagccaagacactctgggaagtgttgaacttcagtacaatgagagcctcgtatctggtgaatacattgactcagactgcattggcaacccagatgaggactgtgaaagattcaggcagctcttggagctcaaatgcaagattcgaaatcatggagagtatgacctgtattactcaagcagcacaattgaatgcaatcaaggggagcaagagggagtggagcatgagctacagttgcttaatgaagaactgagaaacattgagcttgagtgtcagaatatcatgcaggctcacaggctccagaaagtgacagaccagtatggagacatctggacattgcatgatggaggattccggaattataacaccagcatagatatgcaaaggggaaagctagatgacatcatggagcatccagaaaagtctgacaaggacagttctagtgcttacaacacagctgagagctgcagaagtactccgctcactgtagaccgttcccctgacagttcccttccaagggtgatcaacctcaccaataagaaaaacctgagaagcacaatggcagccacccagtcctcttccggacagagcagtaaagagtcgacctccaccaaagccaaaaccactgagcaaggttgtagcgctgaaagcaaggagaaggttttagaaggcagcaagcttcctgatcaagagaaggcagtcagcgaacacatcccttacctctctccttaccacagctcctcatatagatatgcaaacatcccagcacacgcccggcattatcaaagctacatgcagttaattcaacagaaatctgcagtcgagtatgctcagagtcagctcagcttggtgagcatgtgcaaggagtctcagaagtgttcagagcccaagatggaatggaaggtgaaaattaggagcgacgggacacggtacatcacaaagagacccgtgcgagaccgaatcctgaaggaacgtgccttaaagatcaaggaagagcggagtggcatgaccacagacgatgacaccatgagcgagatgaaaatggggcgctactggagcaaagaggagagaaagcagcacctggttagggccaaagagcagcgccgtcgccgtgagttcatgatgcgaagcaggttagagtgtctcaaggagagccctcagagcggcagtgagggcaagaaggagatcaatatcattgaactgagtcacaaaaagatgatgaaaaagagaaacaagaaaattttggacaactggatgacaatccaagaactgatgacccatggggccaagtctccagatggcacgagagtccataatgccttcttgtcggtgaccactgtatgaccgaatgaatggaatgcatgcgactgattttaggaggatgctaccagtttcggtagagtatgattgcctcgttcaatgtggcgtttttatatatattttgtgactctttatagtttaaattttttgtaagcaaaaaatacctggtaatttttcatttgtttttcatatactggtaccttctttttggctgagatctttcttttacttgtgatatattcatattactcgtttataaaaaatcaaaaacaaaaggaaagaaaacaaaaaaaacttgcacaaaaatactgaggagccaattaatttcctacttcaatgtatctaatgtaagtgaaaatctggatttatttctctagtttacttattttctactttaataataactcaatgccaaaatatttctatgcttgtttcttggcataatacattttaaatcaaacctgtt

SEQ ID NO: 21798 - DNA, 4349 bp, Homo sapiens
gatttggcccggagaacgagatcaccctctcaatgaaaggcagatgtccctttaaggtttgcttctacagcccgtggactttagcctaaacacggacccgcgaagctggctttatttgtccatgtctcggacagagcctgggaagctgccagtgagatttcagagaccaagagcgcgaaggggcgggcgatgtggcaatccgtctgggatgtgaaaagcgtggagcgcatttagaggaattcgacgaaaacacaggaaatcactcctctcccgctcctgggcgccgctgccactggggcagaggactgggaaccgcggcagcgggataagtggcccagccagagagcgcagctcccgcgcccggtcctgccctgcgaaccagcgcggccccctggcgctgaggctgctccggccatggcccctcggccccgcgcccgcccaggggtcgctgtcgcctgctgctggctcctcactgacagggatggaagagaaaacttaggaagttgaagtttggcattaaaataaaggactcgccaccactctgtgcaccttcttgagggagttcattcgtccggagcgcctcacagcttagtgcgcctgcgcacgcgcgaactgcggccccgcctctcctttggggacgggagacgtgcgtcgggtcgcgggacgggggctgcgcatgcgccttcatttcgtcagcccgctgttgcgtgctgccagcgggaactgtgtaggggtagattttcgctgcagtgttccccgagcctgttagacgcagcgcgccgggagactgagagaggaaaggatagaggaagtgctgccctaggctgcatgagtcgaagcaagcgtgtttccttcccgccaggcaagtgcccttagaaaccgggccccgcccccttcctggcctgcattcccatcccctctcccggggcggaggtgaggacctccttggttcctttggttctgtcagtgagccccttccttggccatgaagctcgtgaggaagaacatcgagaaggacaatgcgggccaggtgaccctggtccccgaggagcctgaggacatgtggcacacttacaacctcgtgcaggtgggcgacagcctgcgcgcctccaccatccgcaaggtacagacagagtcctccacgggcagcgtgggcagcaaccgggtccgcactaccctcactctctgcgtggaggccatcgacttcgactctcaagcctgccagctgcgggttaaggggaccaacatccaagagaatgagtatgtcaagatgggggcttaccacaccatcgagctggagcccaaccgccagttcaccctggccaagaagcagtgggatagtgtggtactggagcgcatcgagcaggcctgtgacccagcctggagcgctgatgtggcggctgtggtcatgcaggaaggcctcgcccatatctgcttagtcactcccagcatgaccctcactcgggccaaggtggaggtgaacatccctaggaaaaggaaaggcaattgctctcagcatgaccgggccttggagcggttctatgaacaggtggtccaggctatccagcgccacatacactttgatgttgtaaagtgcatcctggtggccagcccaggatttgtgagggagcagttctgcgactacctgtttcaacaagcagtgaagaccgacaacaaactgctcctggaaaaccggtccaaatttcttcaggtacatgcctcctccggacacaagtactccctgaaagaggccctttgtgaccctactgtggctagccgcctttcagacactaaagctgctggggaagtcaaagccttggatgacttctataaaatgttacagcatgaaccggatcgagctttctatggactcaagcaggtggagaaggccaatgaagccatggcaattgacacattgctcatcagcgatgagctcttcaggcatcaggatgtagccacacggagccggtatgtgaggctggtggacagtgtgaaagagaatgcaggcaccgttaggatattctctagtcttcacgtttctggggaacagctcagccagttgactggggtagctgccattctccgcttccctgttcccgaactttctgaccaagagggtgattccagttctgaagaggattaatgattgaaacttaaaattgagacaatcttgtgtttcctaaactgttacagtacatttctcagcatccttgtgacagaaagctgcaagaatggcactttttgattcatacagggatttcttatgtctttggctacactagatattttgtgattggcaagacatgtatttaaacaataaactaaaaggaaataatctccacgtactaccatcttgattaaattgtgtaattttttataggaattatgagttatctgtagtacttggaaacagaaaatgtgtgtatttaaagacgatgcctatgcagtatattgtttgggatagattgcaaaatttcacactgcatgctttgaaacagttttccttagaaaaagcttttgctatcttatcctgtttacattatttctttattttaattctgcttggtgttcttgcattgcatttaatgatcccttttctccccacctccacacactacattttttttagatttaaatagttttactattttaaatgattgccgtacaattagtagacttgaagacaagttttaaatatttttcttcaaaggcttgttaaaccaatcatgttaaaaggaaattcttggttttggtttgttgttgttagcattagtcatatttgatttagagggtaacttaaatcagttatttttagctttttagaactttgatctgctagggattgtcaaaataatctccttgaggcatctttatttttaaaatgagattaaagtatgtgatttgcttgttatgtggctaattagtggcaaagctggaagtcattcccagtctggactttagttctttgcgccaaaacatgctatattatttatttatttttttgcttgtcaaagttatacttaattctgttttatatttgtatgtggcattaatttgggtttgcacatttttattggactattttagttgtgaagaagcctgttctaaagtttaagtcacatgactagtatgtggcagttgacttaaactccaatactctttactatcattgacttaaactctgatactctttactataattatggaattgtgcaaatacctctgagtttaaaatattatttttattatttttggtgcacattcctaaaagttaaggaaggagcctcagtaatggaattgcttcttgaccttttgcaaacctcaatttagcaaaataattaggaacgatctaatagtgatgatacagtttttaactgctggatcagcgacgcctatttcaagtagtgatactaactaaactttcgccggtctttcctgtgtctgtgggccttcctcctggtgtgacagacttggggatttcttgtaaacttcctaactagtctgaacctttttatttcttattgggaactgacacttccctatactttaaaactcacatatgtatatttttgtacatctatctcctaattcaaaagtaattgagattgtcatttcattataattccgtgagtatctttaaattactatcaaatatgttactaaataatttaataagaatatagaaatgaagccactgagatccttaaagttgaaacctgattgttattatattttcagtaaggatttggagatttttggacatttttactctcataatctatgcagtactgaaatgaggtctaataaatataaccaatacatgttaggccataggttcttaaatttagctacctgttcacctcaacttgagagctcttaaaaccctcagtgtccaggttgcagctcagactagttaaataacgttttatccctagaaatgttttttttaaagctacccagatgattccaataggcgtcaaggctaatagccactgattcaggccttgctattcaaaagtatggtccgtaaaccagcagcatccctgagagcttgttggaaactagaattcagggatcttttgtagacctactgagacaggcgctacctgtaccaacatctctagatgattcctgtgcataataaaatctgataaacaaaggcaataggttattcttcctgtgctggtaaatctctggcaggggtccccagtcaggaaaaagatttgagtattaaggtctttcaaaaaagttaactggccatactcaactgtctataaaacctctataaatttctgtttttatgtctatgaattattaaataaaatttaactcatttttaagaaattaca

SEQ ID NO: 21799 - DNA, 1629 bp, Homo sapiens
ctgagtgtgacgtcagaatcaccatggccagctatccttaccggcagggctgcccaggagctgcaggacaagcaccaggagcccctccgggtagctactaccctggaccccccaatagtggagggcagtatggtagtgggctaccccctggtggtggttatgggggtcctgcccctggagggccttatggaccaccagctggtggagggccctatggacaccccaatcctgggatgttcccctctggaactccaggaggaccatatggcggtgcagctcccgggggcccctatggtcagccacctccaagttcctacggtgcccagcagcctgggctttatggacagggtggcgcccctcccaatgtggatcctgaggcctactcctggttccagtcggtggactcagatcacagtggctatatctccatgaaggagctaaagcaggccctggtcaactgcaattggtcttcattcaatgatgagacctgcctcatgatgataaacatgtttgacaagaccaagtcaggccgcatcgatgtctacggcttctcagccctgtggaaattcatccagcagtggaagaacctcttccagcagtatgaccgggaccgctcgggctccattagctacacagagctgcagcaagctctgtcccaaatgggctacaacctgagcccccagttcacccagcttctggtctcccgctactgcccacgctctgccaatcctgccatgcagcttgaccgcttcatccaggtgtgcacccagctgcaggtgctgacagaggccttccgggagaaggacacagctgtacaaggcaacattcggctcagcttcgaggacttcgtcaccatgacagcttctcggatgctatgacccaaccatctgtggagagtggagtgcaccagggacctttcctggcttcttagagtgagagaagtatgtggacatctcttcttttcctgtccctctagaagaacattctcccttgcttgatgcaacactgttccaaaagagggtggagagtcctgcatcatagccaccaaatagtgaggaccggggctgaggccacacagataggggcctgatggaggagaggatagaagttgaatgtcctgatggccatgagcagttgagtggcacagcctggcaccaggagcaggtccttgtaatggagttagtgtccagtcagctgagctccaccctgatgccagtggtgagtgttcatcggcctgttaccgttagtacctgtgttccctcaccaggccatcctgtcaaacgagcccattttctccaaagtggaatctgaccaagcatgagagagatctgtctatgggaccagtggcttggattctgccacacccataaatccttgtgtgttaacttctagctgcctggggctggccctgctcagacaaatctgctccctgggcatctttggccaggcttctgccctctgcagctgggacccctcacttgcctgccatgctctgctcggcttcagtctccaggagacagtggtcacctctccctgccaatactttttttaatttgcattttttttcatttggggccaaaagtccagtgaaattgtaagcttcaataaaaggatgaaactctggagttc

SEQ ID NO: 21800 - DNA, 992 bp, Homo sapiens
agaatcaccatggccagctatccttaccggcagggctgcccaggagctgcaggacaagcaccaggagcccctccgggtagctactaccctggaccccccaatagtggagggcagtatggtagtgggctaccccctggtggtggttatgggggtcctgcccctggagggccttatggaccaccagctggtggagggccctatggacaccccaatcctgggatgttcccctctggaactccaggaggaccatatggcggtgcagctcccgggggcccctatggtcagccacctccaagttcctacggtgcccagcagcctgggctttatggacaggggatacatgctgaaggagcagctcctgtttgggatatgttatctttgtggcagagagaaggagcaggagagctagcaagaatgcacaatgcctcttaaagcttctctgaagtactgtatgtcttgcccacttgcattcttttggccagagcaccccctgatcaagactgacatcagtaggatgggaaaggatgcccctctgcaagccaccaggcagtgggagaggatgtacaatgctcttatagggaaggggagattagcaagtaatctaataatagattattgaactggccttttaaaccattgtaccatattagtacaatgtctgtgggtgtgcagactgtgtctcctggctagagattattagccaggagacgataatgtagcctaccatggggagaaactcagtttaaatatccgtttctctgtgaaaatatctcagaagacacacattccaggctctttgctgaggattttattttgctgttatctcatttaatcatcacaacaattctggggaaatgggttcattttagaaatgtgaaaatcattactcagaaaattgtacattttgcctaaagtcacacaagctagtaaggatcagatccagggtttgaatccaggtctgctttgattccaaagcctgagcccttctatac

SEQ ID NO: 21801 - DNA, 1940 bp, Homo sapiens
tcattcatccccattcaggctttcctcagcatttattaaggactctctgctccagcctctcactctcactctcctccgctcaaactcagctcacttgagagtctcctcccgccagctgtggaaagaactttgcgtctctccagcaatgcatctccttgcgattctgttttgtgctctctggtctgcagtgttggccgagaactcggatgattatgatctcatgtatgtgaatttggacaacgaaatagacaatggactccatcccactgaggaccccacgccgtgcgcctgcggtcaggagcactcggaatgggacaagctcttcatcatgctggagaactcgcagatgagagagcgcatgctgctgcaagccacggacgacgtcctgcggggcgagctgcagaggctgcgggaggagctgggccggctcgcggaaagcctggcgaggccgtgcgcgccgggggctcccgcagaggccaggctgaccagtgctctggacgagctgctgcaggcgacccgcgacgcgggccgcaggctggcgcgtatggagggcgcggaggcgcagcgcccagaggaggcggggcgcgccctggccgcggtgctagaggagctgcggcagacgcgagccgacctgcacgcggtgcagggctgggctgcccggagctggctgccggcaggttgtgaaacagctattttattcccaatgcgttccaagaagatttttggaagcgtgcatccagtgagaccaatgaggcttgagtcttttagtgcctgcatttgggtcaaagccacagatgtattaaacaaaaccatcctgttttcctatggcacaaagaggaatccatatgaaatccagctgtatctcagctaccaatccatagtgtttgtggtgggtggagaggagaacaaactggttgctgaagccatggtttccctgggaaggtggacccacctgtgcggcacctggaattcagaggaagggctcacatccttgtgggtaaatggtgaactggcggctaccactgttgagatggccacaggtcacattgttcctgagggaggaatcctgcagattggccaagaaaagaatggctgctgtgtgggtggtggctttgatgaaacattagccttctctgggagactcacaggcttcaatatctgggatagtgttcttagcaatgaagagataagagagaccggaggagcagagtcttgtcacatccgggggaatattgttgggtggggagtcacagagatccagccacatggaggagctcagtatgtttcataaatgttgtgaaactccacttgaagccaaagaaagaaactcacacttaaaacacatgccagttgggaaggtctgaaaactcagtgcataataggaacacttgagactaatgaaagagagagttgagaccaatctttatttgtactggccaaatactgaataaacagttgaaggaaagacattggaaaaagcttttgaggataatgttactagactttatgccatggtgctttcagtttaatgctgtgtctctgtcagataaactctcaaataattaaaaaggactgtattgttgaacagagggacaattgttttacttttctttggttaattttgttttggccagagatgaattttacattggaagaataacaaaataagatttgttgtccattgttcattgttattggtatgtaccttattacaaaaaaaagatgaaaacatatttatactacaaggtgacttaacaactataaatgtagtttatgtgttataatcgaatgtcacgtttttgagaagatagtcatataagttatattgcaaaagggatttgtattaatttaagactatttttgtaaagctctactgtaaataaaatattttataaaactagctcacgtcatttaattataaatttaagagatgttttgga

SEQ ID NO: 21802 - DNA, 1422 bp, Homo sapiens
atggggagtggaaactgggaggtcacaggtccaccttgtggcagtcggtgtgaacggcctcccggactcccacgcggggtccacggacagttccggagtgctgtgggcctgtcgggcctgcgctggttccggagattccaggaggtgacctggacacacctgcagaacatcgccagcaactacaacgtgtcctacaacgttgacgtccggttccggagcctggcggaagagagccaggctgtggctcaggcagtcaaccggtcacaggcctcggtgcagggggagctggcgcagctcaaggcctgggtgaggaagctgcagcgccgaggccggaaagtagacacgcggctgcgggccttggacctcaccctgggcgagaggagccagcagcgggcccgggaaaggaaggcacacaaggcccagagggacgccctgcaggactcactggcacgcctggagggcctcgtccacagccagggcgccaggctggctgctctggaggggcggctgcccgtggcccaccctggcactgcagccctcgggccggccctggtcccaaccccaacccagcctgaggagctgggcccgacctccctgaagcttcagagggacaggcaggagctccgagctgcctctgagcacaggggccccccacaggactcctcggcccctctccaagggaggcgggagcctccagcctcaggcagccatcgggtactcagtgggactgccccaaaagaccctcggcagcaggcatggtccccccaggtgccaggagagatttgcggcgtgggccccaccctcgttttcccaaacgcctccaccaggaacgtggtcttcctcagccctggtttcgtcactgccctgcgagccctgtccttctgcagctgggtccgcacggcctccggccgcctgggcaccctcctgtcctacgccaccgaggacaatgacaacaagctggtgctgcacggccgagactccctgctgcccggatccatccacttcgtgatcggggacccggccttcagggagctgcccttgcagctgctgctggacggccagtggcaccacatctgtgtcatctggacgtccacccagggcaggtactggctccacgtggatcgcaggctggtggccaccggctcccgcttcagggagggctatgagatcccccccggagggtccctcgtgctgggccaggaacaagacagcgtggggggcggattcgacagctccgaggccttcgtggggagcatgtctggcttggctatctgggatcgggcgctggttcccggggaagttgcaaaccttgccatcgggaaagagttcccgacaggtgccatcctgacgctggccaatgctgcactagcaggcggatttgtgcagggggccaactgcacctgcctggaacgctgtccctga

SEQ ID NO: 21803 - DNA, 1437 bp, Homo sapiens
atgggttgctcgtggaggaagaccttgtctttcttccttgtttttgtgcctatatatctacatggggcttcatcgcaggaagccgccccagtggggcccaggaaaccgtttttcgagaggctccgtaggctggaggaacagttccggagattccaggaggtgacctggacacacctgcagaacatcgccagcaactacaacgtgtcctacaacgttgacgtccggttccggagcctggcggaagagagccaggctgtggctcaggcagtcaaccggtcacaggcctcggtgcagggggagctggcgcagctcaaggcctgggtgaggaagctgcagcgccgaggccggaaagtagacacgcggctgcgggccttggacctcaccctgggcgagaggagccagcagcgggcccgggaaaggaaggcacacaaggcccagagggacgccctgcaggactcactggcacgcctggagggcctcgtccacagccagggcgccaggctggctgctctggaggggcggctgcccgtggcccaccctggcactgcagccctcgggccggccctggtcccaaccccaacccagcctgaggagctgggcccgacctccctgaagcttcagagggacaggcaggagctccgagctgcctctgagcacaggggccccccacaggactcctcggcccctctccaagggaggcgggagcctccagcctcaggcagccatcgggtactcagtgggactgccccaaaagaccctcggcagcaggcatggtccccccaggtgccaggagagatttgcggcgtgggccccaccctcgttttcccaaacgcctccaccaggaacgtggtcttcctcagccctggtttcgtcactgccctgcgagccctgtccttctgcagctgggtccgcacggcctccggccgcctgggcaccctcctgtcctacgccaccgaggacaatgacaacaagctggtgctgcacggccgagactccctgctgcccggatccatccacttcgtgatcggggacccggccttcagggagctgcccttgcagctgctgctggacggccagtggcaccacatctgtgtcatctggacgtccacccagggcaggtactggctccacgtggatcgcaggctggtggccaccggctcccgcttcagggagggctatgagatcccccccggagggtccctcgtgctgggccaggaacaagacagcgtggggggcggattcgacagctccgaggccttcgtggggagcatgtctggcttggctatctgggatcgggcgctggttcccggggaagttgcaaaccttgccatcgggaaagagttcccgacaggtgccatcctgacgctggccaatgctgcactagcaggcggatttgtgcagggggccaactgcacctgcctggaacgctgtccctga

SEQ ID NO: 21804 - DNA, 1748 bp, Homo sapiens
tcagaatgtggcttagggcagccacaatcttatcaggagcttctctgtttgggatcaggggaaccggtgactttcagaggccgataaggcgggacccaacttgtatataaggggcagctcatgctgctgctctgcaccttcctcccgtcttgccttctccctcgagttgggacccgggaagaaccatgaagtggctgctgctgctgggtctggtggcactctctgagtgcatcatgtacaaggtccccctcatcagaaagaagtccttgaggcgcaccctgtccgagcgtggcctgctgaaggacttcctgaagaagcacaacctcaacccagccagaaagtacttcccccagtggaaggctcccaccctggtagatgaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaaacaggttttgtggagctgcttctctttgctggtctttttccttcacattactggggttagaacaccagggcagggatgaaaatgaccacatccatttggatggcacccaacatagtgaccccagcagctgacacttcatgatggagccaagaagacagagaggcttcgggggttgtgctggaagcatcataaaaagacctgggggtcaaaatactgggctaattgtcttctcat

SEQ ID NO: 21805 - DNA, 1269 bp, Homo sapiens
tctgcaccttcctcccgtcttgccttctccctcgagttgggacccgggaagaaccatgaagtggctgctgctgctgggtctggtggcactctctgagtgcatcatgtacaaggtccccctcatcagaaagaagtccttgaggcgcaccctgtccgagcgtggcctgctgaaggacttcctgaagaagcacaacctcaacccagccagaaagtacttcccccagtggaaggctcccaccctggtagatgaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccagactgtagccatctggagatcagctgccatgggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaaacaggttttgtgga

SEQ ID NO: 21806 - DNA, 1228 bp, Homo sapiens
tctgcaccttcctcccgtcttgccttctccctcgagttgggacccgggaagaaccatgaagtggctgctgctgctgggtctggtggcactctctgagtgcatcatgtacaaggtccccctcatcagaaagaagtccttgaggcgcaccctgtccgagcgtggcctgctgaaggacttcctgaagaagcacaacctcaacccagccagaaagtacttcccccagtggaaggctcccaccctggtagatgaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagctccccagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaa

SEQ ID NO: 21807 - DNA, 1748 bp, Homo sapiens
tcagaatgtggctcagggcagccacaatcttatcaggagcttctctgtttgggatcaggggaaccggtgactttcagaggccgataaggcgggacccaacttgtatataaggggcagctcatgctgctgctctgcaccttcctcccatcttgccttctccctcgagttgggacccgggaagaaccatgaagtggctgctgctgctgggtctggtggcgctctctgagtgcatcatgtacaaggtccccctcatcagaaagaagtccttgaggcgcaccctgtccgagcgtggcctgctgaaggacttcctgaagaagcacaacctcaacccagccagaaagtacttcccccagtgggaggctcccaccctggtagatgaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaaacaggttttgtggagctgcttctctttgctggtctttttccttcacattactggggttagaacgccagggcagggatgaaaatgaccacatccatttggatggcacccaacatagtgaccccagcagctgacacttcatgatggagccaagaagacagagaggcttcgggggttgtgctggaagcatcataaaaagacctgggggtcaaaatactgggctaattgtcttctcat

SEQ ID NO: 21808 - DNA, 1398 bp, Homo sapiens
tctgcaccttcctcccatcttgccttctccctcgagttgggacccgggaagaaccatgaagtggctgctgctgctgggtctggtggcgctctctgagtgcatcatgtacaaggtccccctcatcagaaagaagtccttgaggcgcaccctgtccgagcgtggcctgctgaaggacttcctgaagaagcacaacctcaacccagccagaaagtacttcccccagtgggaggctcccaccctggtagatgaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgacaagagtggcagcgtggtgatctttggtggcattgactcttcttactacactggaagtctgaactgggtgcctgttaccgtcgagggttactggcagatcaccgtggacagcatcaccatgaacggagagaccatcgcctgtgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacgtccccaccgaatctggagagctttggatcctgggtgatgtcttcatccgccagtactttaccgtcttcgacagggcaaacaaccaggtcggcctggcccctgtggcttaagcctaagtctcttcagccacctcccaggaagatctggcctccgtcctatgcccactttagatgtatctaattctcctgactgttcttcccaggggagtgtgaaggtcttggccctgttccctgtcctaccaataacgtagaataaaaacataacccactgaaacaggttttgtgga

SEQ ID NO: 21809 - DNA, 1269 bp, Homo sapiens
tctgcaccttcctcccatcttgccttctccctcgagttgggacccgggaagaaccatgaagtggctgctgctgctgggtctggtggcgctctctgagtgcatcatgtacaaggtccccctcatcagaaagaagtccttgaggcgcaccctgtccgagcgtggcctgctgaaggacttcctgaagaagcacaacctcaacccagccagaaagtacttcccccagtgggaggctcccaccctggtagatgaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccagactgtagccatctggagatcagctgccatgggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaaacaggttttgtgga

SEQ ID NO: 21810 - DNA, 1228 bp, Homo sapiens
tctgcaccttcctcccatcttgccttctccctcgagttgggacccgggaagaaccatgaagtggctgctgctgctgggtctggtggcgctctctgagtgcatcatgtacaaggtccccctcatcagaaagaagtccttgaggcgcaccctgtccgagcgtggcctgctgaaggacttcctgaagaagcacaacctcaacccagccagaaagtacttcccccagtgggaggctcccaccctggtagatgaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagctccccagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaa

SEQ ID NO: 21811 - DNA, 1519 bp, Homo sapiens
tcagaatgtggctcagggcagccacaatcttatcaggagcttctctgtttgggatcaggggaaccggtgactttcagaggccgataaggcgggacccaacttgtatataaggggcagctcatgctgctgctctgcaccttcctcccatcttgccttctccctcgagttgggacccgggaagaaccatgaagtggctgctgctgctgggtctggtggcgctctctgagtgcatcatgtacaaggtccccctcatcagaaagaagtccttgaggcgcaccctgtccgagcgtggcctgctgaaggacttcctgaagaagcacaacctcaacccagccagaaagtacttcccccagtgggaggctcccaccctggtagatgaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgacaagagtggcagcgtggtgatctttggtggcattgactcttcttactacactggaagtctgaactgggtgcctgttaccgtcgagggttactggcagatcaccgtggacagcatcaccatgaacggagagaccatcgcctgtgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacgtccccaccgaatctggagagctttggatcctgggtgatgtcttcatccgccagtactttaccgtcttcgacagggcaaacaaccaggtcggcctggcccctgtggcttaagcctaagtctcttcagccacctcccaggaagatctggcctccgtcctatgcccactttagatgtatctaattctcctgactgttcttcccaggggagtgtgaaggtcttggccctgttccctgtcctaccaataacgtagaataaaaacataacccactgaaacagg

SEQ ID NO: 21812 - DNA, 1269 bp, Homo sapiens
tctgcaccttcctcccatcttgccttctccctcgagttgggacccgggaagaaccatgaagtggctgctgctgctgggtctggtggcgctctctgagtgcatcatgtacaaggtccccctcatcagaaagaagtccttgaggcgcaccctgtccgagcgtggcctgctgaaggacttcctgaagaagcacaacctcaacccagccagaaagtacttcccccagtgggaggctcccaccctggtagatgaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccagactgtagccatctggagatcagctgccatgggcctggtttctcaggacctcttctctgtctacctcagcgccgatgacaagagtggcagcgtggtgatctttggtggcattgactcttcttactacactggaagtctgaactgggtgcctgttaccgtcgagggttactggcagatcaccgtggacagcatcaccatgaacggagagaccatcgcctgtgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacgtccccaccgaatctggagagctttggatcctgggtgatgtcttcatccgccagtactttaccgtcttcgacagggcaaacaaccaggtcggcctggcccctgtggcttaagcctaagtctcttcagccacctcccaggaagatctggcctccgtcctatgcccactttagatgtatctaattctcctgactgttcttcccaggggagtgtgaaggtcttggccctgttccctgtcctaccaataacgtagaataaaaacataacccactgaaacaggttttgtgga

SEQ ID NO: 21813 - DNA, 1228 bp, Homo sapiens
tctgcaccttcctcccatcttgccttctccctcgagttgggacccgggaagaaccatgaagtggctgctgctgctgggtctggtggcgctctctgagtgcatcatgtacaaggtccccctcatcagaaagaagtccttgaggcgcaccctgtccgagcgtggcctgctgaaggacttcctgaagaagcacaacctcaacccagccagaaagtacttcccccagtgggaggctcccaccctggtagatgaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgacaagagtggcagcgtggtgatctttggtggcattgactcttcttactacactggaagtctgaactgggtgcctgttaccgtcgagggttactggcagatcaccgtggacagcatcaccatgaacggagagaccatcgcctgtgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagctccccagcgaggggagctgcatcagtggcttccagggcatgaacgtccccaccgaatctggagagctttggatcctgggtgatgtcttcatccgccagtactttaccgtcttcgacagggcaaacaaccaggtcggcctggcccctgtggcttaa

SEQ ID NO: 21814 - DNA, 2084 bp, Homo sapiens
agacgcaagatggcggctgtggtgctggcggcgacgcggttgctgcggggctcgggttcttggggctgttcgcggctgaggtttggacctcctgcgtacagacggtttagtagtggtggtgcctatcccaacatccccctctcttctcccttacctggagtacccaagcctgtttttgctacagttgatggacaggaaaagtttgaaaccaaagtaaccacattggataatgggcttcgcgtggcatctcagaataagtttggacagttttgtacagtaggaattcttatcaattcaggatcgagatatgaagcgaaataccttagtggaattgctcactttttggaaaaattggcattttcgtctactgctcgatttgacagcaaagatgaaattctgcttacgttggaaaagcatgggggtatctgtgactgccagacatcaagagacaccaccatgtatgctgtgtctgctgatagcaaaggcttggacacggtggttgccttactggctgatgtggttctgcagccccggctaacagatgaagaagtcgagatgacgcggatggcggtccagtttgagctggaggacctgaacctgcggcctgacccagagccacttctcaccgagatgattcatgaagcggcttacagggagaacacagttggcctccaccgtttctgccccacagaaaacgtagcaaagatcaaccgagaggtgctgcattcctacctgaggaactactacactcccgaccgcatggtgctggccggcgtgggcgtggagcacgagcatctggtggactgtgcccggaagtacctcctgggggtccagccggcctgggggagcgcagaggccgtggatattgacagatctgtggcccagtacactggggggattgccaagctagaaagagacatgtccaatgtcagcctgggcccgacccccatccccgagctcacgcacatcatggttggactggagagctgctccttcctggaggaggacttcatcccctttgcagtgttgaacatgatgatgggcggaggtggctccttctcggctggtgggcccggcaagggcatgttctccaggctctacctcaacgtgctcaacaggcaccactggatgtataacgcgacctcctaccaccacagctacgaggacactggcctcctttgcatccatgccagcgccgacccaagacaggttcgagaaatggtagaaatcatcacaaaggagtttattttaatgggcggaaccgtggacacggtggagctggaacgagccaagacgcagctgacatcaatgctcatgatgaacctggaatccaggcctgtgatcttcgaggatgtggggaggcaggtgctggccactcgctccagaaagctgccgcacgagctgtgcacgctcatccgcaacgtgaagccggaagatgtgaagagagtcgcttctaagatgctccgagggaagccggcagtggccgccctgggtgacctgactgacctgcccacgtatgagcacatccagaccgccctgtcgagtaaggacgggcgcctgcccaggacgtaccggctcttccggtagaaccgctccccggcctgacagacccagggagctgcagctggagcccgttcccgtgcgtgttagtttggacacgaatttagtctaaaaagctgtctggttgtataaacggtgcaaacaatgtcgccacagcacccacgcggtttgcattcttttggaactcaatgtgccgatcagtggagtcagtatcgagcctgaccaccgcaagccaggaagcaggtgaagtgcccagcgctggagtgcagcgtgccacgaggagggcggtcggtgcttccctcctcgggctgtgggcacatggggccccgcaggttccttggaggagccctgagctgggaggcagcaaaggctgacctatcaaagcctcccggaggccaccgtgctgggtaccaggactcacctctgacaagcaggagaaggtaagggcccggtcagctccaaggagcgcgctccacgcgcgtgcacacagcttccctggtaataaagagctggcatctttctta

SEQ ID NO: 21815 - DNA, 713 bp, Homo sapiens
ggagacgcaagatggcggctgtggtgctggcggcgacgcggttgctgcggggctcgggttcttggggctgttcgcggctgaggtttggacctcctgcgtacagacggtttagtagtggtggtgcctatcccaacatccccctctcttctcccttacctggagtacccaagcctgtttttgctacagttgatggacaggaaaagtttgaaaccaaagtaaccacattggataatgggcttcgcgtggcatctcagaataagtttggacagttttgtacagtaggaattcttatcaattcaggatcgagatatgaagcgaaataccttagtggaattgctcactttttggaaaaattggcattttcgtctactgctcgatttgacagcaaagatgaaattctgcttacgttggaaaagcatgggggtatctgtgactgccagacatcaagatgaagaagtcgagatgacgcggatggcggtccagtttgagctggaggacctgaacctgcggcctgacccagagccacttctcaccgagatgattcatgaagtaaaatgtcaaactcgagaatgcccccgcatctcgaacagtggtcctcgggacaccaggggtggtggggagggtgcctccgtgatgttgtccttgcaggttatggatatatacagaacatttttttgttttttgagatgaggtttctccacattgcctacgct

SEQ ID NO: 21816 - DNA, 1987 bp, Homo sapiens
gacgcaagatggcggctgtggtgctggcggcgacgcggttgctgcggggctcgggttcttggggctgttcgcggctgaggtttggacctcctgcgtacagacggtttagtagtggtggtgcctatcccaacatccccctctcttctcccttacctggagtacccaagcctgtttttgctacagttgatggacaggaaaagtttgaaaccaaagtaaccacattggataatgggcttcgcgtggcatctcagaataagtttggacagttttgtacagtaggaattcttatcaattcaggatcgagatatgaagcgaaataccttagtggaattgctcactttttggaaaaattggcattttcgtctactgctcgatttgacagcaaagatgaaattctgcttacgttggaaaagcatgggggtatctgtgactgccagacatcaagatgaagaagtcgagatgacgcggatggcggtccagtttgagctggaggacctgaacctgcggcctgacccagagccacttctcaccgagatgattcatgaagcggcttacagggagaacacagttggcctccaccgtttctgccccacagaaaacgtagcaaagatcaaccgagaggtgctgcattcctacctgaggaactactacactcccgaccgcatggtgctggccggcgtgggcgtggagcacgagcatctggtggactgtgcccggaagtacctcctgggggtccagccggcctgggggagcgcagaggccgtggatattgacagatctgtggcccagtacactggggggattgccaagctagaaagagacatgtccaatgtcagcctgggcccgacccccatccccgagctcacgcacatcatggttggactggagagctgctccttcctggaggaggacttcatcccctttgcagtgttgaacatgatgatgggcggaggtggctccttctcggctggtgggcccggcaagggcatgttctccaggctctacctcaacgtgctcaacaggcaccactggatgtataacgcgacctcctaccaccacagctacgaggacactggcctcctttgcatccatgccagcgccgacccaagacaggttcgagaaatggtagaaatcatcacaaaggagtttattttaatgggcggaaccgtggacacggtggagctggaacgagccaagacgcagctgacatcaatgctcatgatgaacctggaatccaggcctgtgatcttcgaggatgtggggaggcaggtgctggccactcgctccagaaagctgccgcacgagctgtgcacgctcatccgcaacgtgaagccggaagatgtgaagagagtcgcttctaagatgctccgagggaagccggcagtggccgccctgggtgacctgactgacctgcccacgtatgagcacatccagaccgccctgtcgagtaaggacgggcgcctgcccaggacgtaccggctcttccggtagaaccgctccccggcctgacagacccagggagctgcagctggagcccgttcccgtgcgtgttagtttggacacgaatttagtctaaaaagctgtctggttgtataaacggtgcaaacaatgtcgccacagcacccacgcggtttgcattcttttggaactcaatgtgccgatcagtggagtcagtatcgagcctgaccaccgcaagccaggaagcaggtgaagtgcccagcgctggagtgcagcgtgccacgaggagggcggtcggtgcttccctcctcgggctgtgggcacatggggccccgcaggttccttggaggagccctgagctgggaggcagcaaaggctgacctatcaaagcctcccggaggccaccgtgctgggtaccaggactcacctctgacaagcaggagaaggtaagggcccggtcagctccaaggagcgcgctccacgcgcgtgcacacagcttccctggtaataaagagctggcatctttctt

SEQ ID NO: 21817 - DNA, 1029 bp, Homo sapiens
tacactggggggattgccaagctagaaagagacatgtccaatgtcagcctgggcccgacccccatccccgagctcacgcacatcatggttggactggagagctgctccttcctggaggaggacttcatcccctttgcagtgttgaacatgatgatgggcggaggtggctccttctcggctggtgggcccggcaagggcatgttctccaggctctacctcaacgtgctcaacaggcaccactggatgtataacgcgacctcctaccaccacagctacgaggacactggcctcctttgcatccatgccagcgccgacccaagacaggttcgagaaatggtagaaatcatcacaaaggagtttattttaatgggcggaaccgtggacacggtggagctggaacgagccaagacgcagctgacatcaatgctcatgatgaacctggaatccaggcctgtgatcttcgaggatgtggggaggcaggtgctggccactcgctccagaaagctgccgcacgagctgtgcacgctcatccgtgagtaccgcaggggtagtgaggggctgccgcaggcctcggccaggctcagaggaggccgtctcgccctcccgcaggccgtggtgggcctgtggtatgtccatcacacccagaatctggggccttcaccagttgtcctcagcaggggcggccaagggcagggtcgtggggtcgcagacctggtctcacttcccggccccaccatgcacctgctgcctccttggcaggtgaccccaccctctgcacccctgggaggggctgtcactactgcccagagttgttaaagagcactcaagttagtaggcgagaagggctcagtagaggactgctacattgtacgtggagtagcagtggctcggaatgccgctgtaccgttgctggctctcgggcaggagtctcagccccaggtttccggggcccccatgagtgaccttaggaggtctgaatttcctgaaactgccaagttgtatgtgcatcggactcttctgggggacagg

SEQ ID NO: 21818 - DNA, 2010 bp, Homo sapiens
atttggctctggaggaggtgggtcaaggactccatgccccgccccctgccccgcccttaccccgccccatgcattggcacccggaggggctcagctgacgccgcacttcacgtgacgccggtgccgggcgaacatggcggcggccaccggaccctcgttttggctggggaatgaaaccctgaaggtgccgctggcgctctttgccttgaaccggcagcgcctgtgtgagcggctgcggaagaaccctgctgtgcaggccggctccatcgtggtcctgcagggcggggaggagactcagcgctactgcaccgacaccggggtcctcttccgccaggagtccttctttcactgggcgttcggtgtcactgagccaggctgctatggtgtcatcgatgttgacactgggaagtcgaccctgtttgtgcccaggcttcctgccagccatgccacctggatgggaaagatccattccaaggagcacttcaaggagaagtatgccgtggacgacgtccagtacgtagatgagattgccagcgtcctgacgtcacagaagccctctgtcctcctcactttgcgtggcgtcaacacggacagcggcagtgtctgcagggaggcctcctttgacggcatcagcaagttcgaagtcaacaataccattcttcacccagagatcgttgagtgccgagtgtttaagacggatatggagctggaggttctgcgctataccaataaaatctccagcgaggcccaccgtgaggtaatgaaggctgtaaaagtgggaatgaaagaatatgagttggaaagcctcttcgagcactactgctactcccggggcggcatgcgccacagctcctacacctgcatctgcggcagtggtgagaactcagccgtgctacactacggacacgccggagctcccaacgaccgaacgatccagaatggggatatgtgcctgttcgacatgggcggtgagtattactgcttcgcttccgacatcacctgctcctttcccgccaacggcaagttcactgcagaccagaaggccgtctatgaggcagtgctgcggagctcccgtgccgtcatgggtgccatgaagccaggtgtctggtggcctgacatgcaccgcctggctgaccgcatccacctggaggagctggcccacatgggcatcctgagcggcagcgtggacgccatggtccaggctcacctgggggccgtgtttatgcctcacgggcttggccacttcctgggcattgacgtgcacgacgtgggaggctacccagagggcgtggagcgcatcgacgagcccggcctgcggagcctgcgcactgcacggcacctgcagccaggcatggtgctcaccgtggagccgggcatctacttcatcgaccacctcctggatgaggccctggcggacccggcccgcgcctccttccttaaccgcgaggtcctgcagcgctttcgcggttttggcggggtccgcatcgaggaggacgtcgtggtgactgacagcggcatagagctgctgacctgcgtgccccgcactgtggaagagattgaagcatgcatggcaggctgtgacaaggcctttacccccttctctggccccaagtagagccagccagaaatcccagcgcacctgggggcctggccttgcaacctcttttcgtgatgggcagcctgctggtcagcactccagtagcgagagacggcacccagaatcagatcccagcttcggcatttgatcagaccaaacagtgctgtttcccggggaggaaacacttttttaattacccttttgcaggctcccacctttaatctgttttataccttgcttattaaatgagcgacttaaaatgattgaaaataatgctgttctttagtagcaactaaaatgtgtcttgctgtcatttatattccttttcccaggaaagaagcatttctgatactttctgtcaaaaatcaatatgcagaatggcatttgcaataaaaggtttcctaaaatggtcc

SEQ ID NO: 21819 - DNA, 1887 bp, Homo sapiens
atttggctctggaggaggtgggtcaaggactccatgccccgccccctgccccgcccttaccccgccccatgcattggcacccggaggggctcagctgacgccgcacttcacgtgacgccggtgccgggcgaacatggcggcggccaccggaccctcgttttggctggggaatgaaaccctgaaggtgccgctggcgctctttgccttgaaccggcagcgcctgtgtgagcggctgcggaagaaccctgctgtgcaggccggctccatcgtggtcctgcagggcggggaggagactcagcgctactgcaccgacaccggggtcctcttccgccaggagtccttctttcactgggcgttcggtgtcactgagccaggctgctatggtgtcatcgatgttgacactgggaagtcgaccctgtttgtgcccaggcttcctgccagccatgccacctggatgggaaagatccattccaaggagcacttcaaggagaagtatgccgtggacgacgtccagtacgtagatgagattgccagcgtcctgacgtcacagaagccctctgtcctcctcactttgcgtggcgtcaacacggacagcggcagtgtctgcagggaggcctcctttgacggcatcagcaagttcgaagtcaacaataccattcttcacccagagatcgttgagtgcctcttcgagcactactgctactcccggggcggcatgcgccacagctcctacacctgcatctgcggcagtggtgagaactcagccgtgctacactacggacacgccggagctcccaacgaccgaacgatccagaatggggatatgtgcctgttcgacatgggcggtgagtattactgcttcgcttccgacatcacctgctcctttcccgccaacggcaagttcactgcagaccagaaggccgtctatgaggcagtgctgcggagctcccgtgccgtcatgggtgccatgaagccaggtgtctggtggcctgacatgcaccgcctggctgaccgcatccacctggaggagctggcccacatgggcatcctgagcggcagcgtggacgccatggtccaggctcacctgggggccgtgtttatgcctcacgggcttggccacttcctgggcattgacgtgcacgacgtgggaggctacccagagggcgtggagcgcatcgacgagcccggcctgcggagcctgcgcactgcacggcacctgcagccaggcatggtgctcaccgtggagccgggcatctacttcatcgaccacctcctggatgaggccctggcggacccggcccgcgcctccttccttaaccgcgaggtcctgcagcgctttcgcggttttggcggggtccgcatcgaggaggacgtcgtggtgactgacagcggcatagagctgctgacctgcgtgccccgcactgtggaagagattgaagcatgcatggcaggctgtgacaaggcctttacccccttctctggccccaagtagagccagccagaaatcccagcgcacctgggggcctggccttgcaacctcttttcgtgatgggcagcctgctggtcagcactccagtagcgagagacggcacccagaatcagatcccagcttcggcatttgatcagaccaaacagtgctgtttcccggggaggaaacacttttttaattacccttttgcaggctcccacctttaatctgttttataccttgcttattaaatgagcgacttaaaatgattgaaaataatgctgttctttagtagcaactaaaatgtgtcttgctgtcatttatattccttttcccaggaaagaagcatttctgatactttctgtcaaaaatcaatatgcagaatggcatttgcaataaaaggtttcctaaaatggtcc

SEQ ID NO: 21820 - DNA, 1818 bp, Homo sapiens
atttggctctggaggaggtgggtcaaggactccatgccccgccccctgccccgcccttaccccgccccatgcattggcacccggaggggctcagctgacgccgcacttcacgtgacgccggtgccgggcgaacatggcggcggccaccggaccctcgttttggctggggaatgaaaccctgaaggtgccgctggcgctctttgccttgaaccggcagcgcctgtgtgagcggctgcggaagaaccctgctgtgcaggccggctccatcgtggtcctgcagggcggggaggagactcagcgctactgcaccgacaccggggtcctcttccgccagattgccagcgtcctgacgtcacagaagccctctgtcctcctcactttgcgtggcgtcaacacggacagcggcagtgtctgcagggaggcctcctttgacggcatcagcaagttcgaagtcaacaataccattcttcacccagagatcgttgagtgccgagtgtttaagacggatatggagctggaggttctgcgctataccaataaaatctccagcgaggcccaccgtgaggtaatgaaggctgtaaaagtgggaatgaaagaatatgagttggaaagcctcttcgagcactactgctactcccggggcggcatgcgccacagctcctacacctgcatctgcggcagtggtgagaactcagccgtgctacactacggacacgccggagctcccaacgaccgaacgatccagaatggggatatgtgcctgttcgacatgggcggtgagtattactgcttcgcttccgacatcacctgctcctttcccgccaacggcaagttcactgcagaccagaaggccgtctatgaggcagtgctgcggagctcccgtgccgtcatgggtgccatgaagccaggtgtctggtggcctgacatgcaccgcctggctgaccgcatccacctggaggagctggcccacatgggcatcctgagcggcagcgtggacgccatggtccaggctcacctgggggccgtgtttatgcctcacgggcttggccacttcctgggcattgacgtgcacgacgtgggaggctacccagagggcgtggagcgcatcgacgagcccggcctgcggagcctgcgcactgcacggcacctgcagccaggcatggtgctcaccgtggagccgggcatctacttcatcgaccacctcctggatgaggccctggcggacccggcccgcgcctccttccttaaccgcgaggtcctgcagcgctttcgcggttttggcggggtccgcatcgaggaggacgtcgtggtgactgacagcggcatagagctgctgacctgcgtgccccgcactgtggaagagattgaagcatgcatggcaggctgtgacaaggcctttacccccttctctggccccaagtagagccagccagaaatcccagcgcacctgggggcctggccttgcaacctcttttcgtgatgggcagcctgctggtcagcactccagtagcgagagacggcacccagaatcagatcccagcttcggcatttgatcagaccaaacagtgctgtttcccggggaggaaacacttttttaattacccttttgcaggctcccacctttaatctgttttataccttgcttattaaatgagcgacttaaaatgattgaaaataatgctgttctttagtagcaactaaaatgtgtcttgctgtcatttatattccttttcccaggaaagaagcatttctgatactttctgtcaaaaatcaatatgcagaatggcatttgcaataaaaggtttcctaaaatggtcc

SEQ ID NO: 21821 - DNA, 577 bp, Homo sapiens
aaagattggtatggccttagctcttagccaaacaccttcctgacaccatgagggccagcagcttcttgatcgtggtggtgttcctcatcgctgggacgctggttctagaggcagctgtcacgggagttcctgttaaaggtcaagacactgtcaaaggccgtgttccattcaatggacaagatcccgttaaaggacaagtttcagttaaaggtcaagataaagtcaaagcgcaagagccagtcaaaggtccagtctccactaagcctggctcctgccccattatcttgatccggtgcgccatgttgaatccccctaaccgctgcttgaaagatactgactgcccaggaatcaagaagtgctgtgaaggctcttgcgggatggcctgtttcgttccccagtgagagggagccggtccttgctgcacctgtgccgtccccagagctacaggccccatctggtcctaagtccctgctgcccttccccttcccacactgtccattcttcctcccattcaggatgcccacggctggagctgcctctctcatccactttccaataaagagttccttctgctcca

SEQ ID NO: 21822 - DNA, 1158 bp, Homo sapiens
ccgggtcactgttaagggggccgccatggcccggctgtggggcgcgctgagtctttggccactgtgggcggccgtgccgtggggcggggcggcagccgtcggtgtccgggcttgcagctccacggccgccccggacggcgtcgagggcccggcgctgcggcgctcctattggcgccacctgaggcgtctggtgctgggtcctcccgaaccgccgttctcgcacgtgtgccaagtcggggacccggtgctgcgcggcgtggcggccccggtggagcgggcgcagctaggcgggcccgagctgcagcggctgacgcaacggctggtccaggtgatgcggcggcggcgctgcgtgggcctaagcgcgccgcagctgggggtgccgcggcaggtgctggcgctggagctccccgaggcgctgtgtcgggagtgcccgccccgccagcgcgcgctccgccaaatggagcccttccccctgcgcgtgttcgtgaaccccagcctgcgagtgcttgacagccgcctggtcacctttcccgagggctgcgagagcgtcgccggcttcctggcctgcgtgccccgcttccaggcggtgcagatctcagggctggaccccaatggagaacaggtggtgtggcaggcgagcgggtgggcagcccgcatcatccagcacgagatggaccacctgcagggctgcctgtttattgacaaaatggacagcaggacgttcacaaacgtctattggatgaaggtgaatgactaaagctttgctactggggctgaggattccggataccaagacgcaaacactttcactttgagctgggcaaatcttacttggcatcaacttggatggctcgcatatgacaggaaactggattgccaaggcatggcagactgagctggaggaagatgtcagaaatgtttgccctgaaatcagttacggacaaaatgttggctacaacttgaggagaaaaatcacccccaaaggagtggacatttcctaacaattctgtatggaggaaggtggggtaattgcattcgtctgcagtagacacgagttcctcggacctgtataatctcccaaagccaaggtttggtaataatgtagtccccaaatacctgaaagctgtctttaaaaatgcaggtaagcatgtgactggc

SEQ ID NO: 21823 - DNA, 1048 bp, Homo sapiens
gcccctggaggaactgaacccactatcggtcatggggccgagactaaatgtggcgggttgtctttaatctgctgccaagaggaaactcattcaggcaagttcagccctttatgaggaattcccctgtggtcacattccaattcctggacctgctgccaccctcagaactgcatgctccttcttcagactttctaagaatgactcaggtcattggtggagtgaagtcaagatttccaactcagtcacctgaagagatggagataccattcatggagctggaggtccctggagatttgggaattcagataacaagctaagataaggagtttgcctacctctgtcctagagcgaagcctgagccttgggcgcgcagcacaccacaagtatctgttactgtgttttgcagaagcttcaggcggggatataagccccacaaggaaagcgctgagcagaggaggcctcagcttgacctgcggcagtgcagcccttgggacttccctcgccttccacctcctgctcgtctgcttcacaagctatcgctatggtgttcgtgcgcaggccgtggcccgccttgaccacagtgcttctggccctgctcgtctgcctaggggcgctggtcgacgcctaccccatcaaacccgaggctccccgcgaagacgcctcgccggaggagctgaaccgctactacgcctccctgcgccactacctcaacctggtcacccggcagcggtatgggaaaagagacggcccggacacgcttctttccaaaacgttcttccccgacggcgaggaccgccccgtcaggtcgcggtcggagggcccagacctgtggtgaggacccctgaggcctcctgggagatctgccaaccacgcccacgtcatttgcatacgcactcccgaccccagaaacccggattctgcctcccgacggcggcgtctgggcagggttcgggtgcggccctccgcccgcgtctcggtgcccccgccccctgggctggagggctgtgtgtggtccttccctggtcccaaaataaagagcaaattccac

SEQ ID NO: 21824 - DNA, 3846 bp, Homo sapiens
tcagaactcacacttcttcctggcaaagaagtgcccaggacgggagctggggagccagggctgatctaggaggctgggagccaggtgacaggatggccccaaagagagttgtgcagctgtccctgaagatgcctacccatgccgtgtgtgtggtgggagtcgaggcacatgtggacattcacagtgatgtgcccaagggtgccaacagcttcagggtctctggaagctccggggtggaggtcttcatggtctacaaccgcacacgtgtgaaagagcccataggcaaggcccgttggccgctagacactgatgcagacatggtcgtatctgtgggcacagccagtaaggaattaaaggacttcaaggtgagggtctcctactttggggagcaggaagaccaagctctgggccgcagcgtgctttacctcactggcgtcgatatttcccttgaggttgacacaggccgcacaggcaaggtgaagaggagccaaggggacaagaaaacctggcgctggggccctgagggctatggggctatcttgctggtgaactgtgaccgggacaatcacaggtccgcagagcctgacctcacccacagctggctgatgtcgctggctgacctgcaggacatgtccccaatgctgctgagctgcaatggccccgacaagctcttcgacagccacaagcttgtcttgaacgtgcccttttctgattccaaaagagtgagggtcttctgtgccaggggtgggaattctctctcggactacaaacaggtgctggggccccagtgtctgtcctatgaagttgagcgacagccaggggagcaggagatcaagttctatgtggaggggctgaccttccccgatgccgatttcctagggctggtttccctcagtgtcagcctggtggacccggggaccctgcccgaggtgaccctcttcacagacactgtgggcttccgcatggccccctggatcatgacgcccaacactcagcctcctgaggagctgtatgtgtgcagagtgatggacactcatggctccaatgagaaattcctggaggacatgtcttatctgacattgaaagccaactgcaagctgaccatctgccctcaagttgaaaatcgaaatgaccgctggatccaggacgagatggagtttggctacatcgaggcccctcacaaatccttccccgtggtctttgactcccccaggaacaggggcctgaaagatttcccctataagaggatcctgggtcctgactttggatatgttacccgggagatcccgctccctggtccctccagccttgactccttcggcaacctggacgtcagcccgcccgtcacggtgggcggcacggaataccccctgggccggatcctcatcgggagcagcttccccaagtccggtgggcggcagatggccagggcagtgcggaacttcctgaaggcacagcaggtgcaggcacccgtggagctctactcggactggctctctgtgggccatgtggacgagtttctgacctttgtgcctacctctgaccaaaagggcttccggctgctcctggctagccccagcgcttgcctcaaactcttccaagagaagaaagaagagggttatggggaggcagcccagtttgatgggttaaaacaccaggcaaaaagaagcattaatgagatgctggcagacagacacctccagagagacaatcttcatgcacagaaatgcattgactggaaccgtaatgtgctgaagcgggagctgggcctggcagagagtgacatcgtggacattccccagctcttcttcctgaaaaacttctacgcggaagccttcttcccagacatggttaacatggtggtcttaggcaagtacctgggcatccccaagccctacgggcccatcatcaatggccgctgctgcctggaggagaaggtgcagtccctgctggagcctctgggcctgcactgcatcttcattgatgactacttgtcctaccacgagctgcagggggagatccactgtggcaccaacgtgcgcaggaagccctttcccttcaaatggtggaacatggtgccctgagcctgcccccacccgccatcctctctgccctcttgctagggaaccctgccagggtgaaggcaaggaacaaccacctggcctccattctcttgggggagtcttggcactttgcaaacatcctggccaccatgggcaccaggacacagggatggataccacctaccctcgcctctggaatggcctacccaacccgagaagaatgcacctcattcttccctggcctctttcccacccacagcccccagaggctctagatcaacaatgttagcatgttccagaatggctgtgggaggcctagggagatgggccccacttagaattgctcccccttcattctgatgcctccctggggaacaaggataatgactttgcatctgcacctggaacggggcctgggggacctggggtctggtgtgccaggcaccaggctgcctctgctcttggaaaactaggaaaggggatcagaaacatcctctccccgctctaggtttcttctcccaaaggggacccaaggctgtgacacttacctccacccccatccagcacccttcagctgtgtgtggacaaacaaggacagaaaaacccagtgtccaagggccaatttaaatagaaaaaaagacaacaaaattttaatagctgactccgacctcagaagagtgattgctacctttctggaaagactttaattaccagagctggcttctcccagctcagaaatgctgagaagccaacgtgaggcctgaggacacacaaaggatgacggggcaggaggggatgaggtcagggtagcagagtgtgtgacgacggatttgggggcctagaggtgtccgtggttcctgggctgggattttggactctggatttgaagggagctggagcttccagatgtagcaggggtagggggccagatgttagaagagggtgtgtgtgttgggaggaaattaggttatctctgaaggtggagtttaatttcctttaatagtctttaattattccccttcattctgcaggcagtgggaggggaaggcttgcccggtctctctcagcaacccagggaccctgcacatagcttaggtttcatccctgaataaaccgctgtgcaggcccatgtcccctcccacagtagggaagacagctgccacgggaggttaatagcccggagtgaggtcactgagacatgcacaggcaggctggttcagctgggctgcagggcacgggcaggaggaagccagcctaccctcttcccccactgccagtgaggccattgtagggcagttggccctagggcttcggtccatctaggttttcagtggcccctgctgagacctcacactgagccaactactgtcactgttttaaccaacaaaagctagcctggaactgctatggttaaagtgggtgagcgggaacctgaaaatccccttctggaaggttctacagaactctatttgcaagctcctgctttaacctgagcgtcctctgctcaggatcataccccagcctgcactgagtcaagaaggagaaggaggctctgaaggggccgggggtgtgagctggggttgggactcccctgagaaagagctgtgggtaggaagggagtgagcattgcagagatagggctgggggtcggggccacactgagtgtgggaagctctggagttgctgctgggccatcgaggggccctggtgttggctctgagaatgttctgggtgaccagtcacctactttctgatcaataaaaatgtcgacatgcatttctta

SEQ ID NO: 21825 - DNA, 1476 bp, Homo sapiens
aaattggagaagctggggaggtgagatacagtctggcacagagacagaggaatagactcattgacttctcccattaggaagtcagaatagcttctgtcctaaccatggcttaaaagggtcctgaggtcatgaagttcccagggcaggtggctgcaggtccggtgggcggcagatggccagggcagtgcggaacttcctgaaggcacagcaggtgcaggcacccgtggagctctactcggactggctctctgtgggccatgtggacgagtttctgacctttgtgcctacctctgaccaaaagggcttccggctgctcctggctagccccagcgcttgcctcaaactcttccaagagaagaaagaagagggttatggggaggcagcccagtttgatgggttaaaacaccaggcaaaaagaagcattaatgagatgctggcagacagacacctccagagagacaatcttcatgcacaggttaacatggtggtcttaggcaagtacctgggcatccccaagccctacgggcccatcatcaatggccgctgctgcctggaggagaaggtgcagtccctgctggagcctctgggcctgcactgcatcttcattgatgactacttgtcctaccacgagctgcagggggagatccactgtggcaccaacgtgcgcaggaagccctttcccttcaaatggtggaacatggtgccctgagcctgcccccacccgccatcctctctgccctcttgctagggaaccctgccagggtgaaggcaaggaacaaccacctggcctccattctcttgggggagtcttggcactttgcaaacatcctggccaccatgggcaccaggacacagggatggataccacctaccctcgcctctggaatggcctacccaacccgagaagaatgcacctcattcttccctggcctctttcccacccacagcccccagaggctctagatcaacaatgttagcatgttccagaatggctgtgggaggcctagggagatgggccccacttagaattgctcccccttcattctgatgcctccctggggaacaaggataatgactttgcatctgcacctggaacggggcctgggggacctggggtctggtgtgccaggcaccaggctgcctctgctcttggaaaactaggaaaggggatcagaaacatcctctccccgctctaggtttcttctcccaaaggggacccaaggctgtgacacttacctccacccccatccagcacccttcagctgtgtgtggacaaacaaggacagaaaaacccagtgtccaagggccaatttaaatagaaaaaaagacaacaaaattttaatagctgactccgacctcagaagagtgattgctacctttctggaaagactttaattaccagagctggcttctcccagctcagaaatgctgagaagccaacgtgaggcctgaggacacacaaaggatgacggggca

SEQ ID NO: 21826 - DNA, 1483 bp, Homo sapiens
attaggaagtcagaatagcttctgtcctaaccatggcttaaaagggtcctgaggtcatgaagttcccagggcaggtggctgcagggcttccggctgctcctggctagccccagcgcttgcctcaaactcttccaagagaagaaagaagagggttatggggaggcagcccagtttgatgggttaaaacaccaggcaaaaagaagcattaatgagatgctggcagacagacacctccagagagacaatcttcatgcacagaaatgcattgactggaaccgtaatgtgctgaagcgggagctgggcctggcagagagtgacatcgtggacattccccagctcttcttcctgaaaaacttctacgcggaagccttcttcccagacatggttaacatggtggtcttaggcaagtacctgggcatccccaagccctacgggcccatcatcaatggccgctgctgcctggaggagaaggtgcagtccctgctggagcctctgggcctgcactgcatcttcattgatgactacttgtcctaccacgagctgcagggggagatccactgtggcaccaacgtgcgcaggaagccctttcccttcaaatggtggaacatggtgccctgagcctgcccccacccgccatcctctctgccctcttgctagggaaccctgccagggtgaaggcaaggaacaaccacctggcctccattctcttgggggagtcttggcactttgcaaacatcctggccaccatgggcaccaggacacagggatggataccacctaccctcgcctctggaatggcctacccaacccgagaagaatgcacctcattcttccctggcctctttcccacccacagcccccagaggctctagatcaacaatgttagcatgttccagaatggctgtgggaggcctagggagatgggccccacttagaattgctcccccttcattctgatgcctccctggggaacaaggataatgactttgcatctgcacctggaacggggcctgggggacctggggtctggtgtgccaggcaccaggctgcctctgctcttggaaaactaggaaaggggatcagaaacatcctctccccgctctaggtttcttctcccaaaggggacccaaggctgtgacacttacctccacccccatccagcacccttcagctgtgtgtggacaaacaaggacagaaaaacccagtgtccaagggccaatttaaatagaaaaaaagacaacaaaattttaatagctgactccgacctcagaagagtgattgctacctttctggaaagactttaattaccagagctggcttctcccagctcagaaatgctgagaagccaacgtgaggcctgaggacacacaaaggatgacggggcaggaggggatgaggtcagggtagcagagtgtgtgacgacggatttgggggcctagaggtgtccgtggttcctgggctgggattttggactctggatttg

SEQ ID NO: 21827 - DNA, 939 bp, Homo sapiens
aaaaattggagaagctggggaggtgagatacagtctggcacagagacagaggaatagactcattgacttctcccattaggaagtcagaatagcttctgtcctaaccatggcttaaaagggtcctgaggtcatgaagttcccagggcaggtggctgcaggtccggtgggcggcagatggccagggcagtgcggaacttcctgaaggcacagcaggtgcaggcacccgtggagctctactcggactggctctctgtgggccatgtggacgagtttctgacctttgtgcctacctctgaccaaaagggcttccggctgctcctggctagccccagcgcttgcctcaaactcttccaagagaagaaagaagagggttatggggaggcagcccagtttgatgggttaaaacaccaggcaaaaagaagcattaatgagatgctggcagacagacacctccagagagacaatcttcatgcacagaaatgcattgactggaaccgtaatgtgctgaagcgggagctgggcctggcagagagtgacatcgtggacattccccagctcttcttcctgaaaaacttctacgcggaagccttcttcccagacatggttaacatggtggtcttaggcaagtacctgggcatccccaagccctacgggcccatcatcaatggccgctgctgcctggaggagaaggtgcagtccctgctggagcctctgggcctgcactgcatcttcattgatgactacttgtcctaccacgagctgcagggggagatccactgtggcaccaacgtgcgcaggaagccctttcccttcaaatggtggaacatggtgccctgagcctgcccccacccgccatcctctctgccctcttgctagggaaccctgccagggtgaaggcaaggaacaaccacctggcctccattctcttgggggagtctt

SEQ ID NO: 21828 - DNA, 1607 bp, Homo sapiens
cgcacctgctgcaggtgctcccggccgccccggaccagcgagcgcgggcactgcggcggggaggatgctgcgcgagcggaccgtgcggctgcagtacgggagccgcgtggaggcggtgtacgtgctgggcacctacctctggaccgatgtctacagcgcggccccagccggggcccaaaccttcagcctgaagcactcggaacacgtgtgggtggaggtggtgcgtgatggggaggctgaggaggtggccaccaatggcaagcagcgctggcttctctcgcccagcaccaccctgcgggtcaccatgagccaggcgagcaccgaggccagcagtgacaaggtcaccgtcaactactatgacgaggaagggagcattcccatcgaccaggcggggctcttcctcacagccattgagatctccctggatgtggacgcagaccgggatggtgtggtggagaagaacaacccaaagaaggcatcctggacctggggccccgagggccagggggccatcctgctggtgaactgtgaccgagagacaccctggttgcccaaggaggactgccgtgatgagaaggtctacagcaaggaagatctcaaggacatgtcccagatgatcctgcggaccaaaggccccgaccgcctccccgccggatacgagatagttctgtacatttccatgtcagactcagacaaagtgggcgtgttctacgtggagaacccgttcttcggccaacgctatatccacatcctgggccggcggaagctctaccatgtggtcaagtacacgggtggctccgcggagctgctgttcttcgtggaaggcctctgtttccccgacgagggcttctcaggcctggtctccatccatgtcagcctgctggagtacatggcccaggacattcccctgactcccatcttcacggacaccgtgatattccggattgctccgtggatcatgacccccaacatcctgcctcccgtgtcggtgtttgtgtgctgcatgaaggataattacctgttcctgaaagaggtgaagaaccttgtggagaaaaccaactgtgagctgaaggtctgcttccagtacctaaaccgaggcgatcgctggatccaggatgaaattgagtttggctacatcgaggccccccataaaggcttccccgtggtgctggactctccccgagatggaaacctaaaggacttccctgtgaaggagctcctgggcccagattttggctacgtgacccgggagcccctctttgagtctgtcaccagccttgactcatttggaaacctggaggtcagtcccccagtgaccgtgaacggcaagacatacccgcttggccgcatcctcatcgggagcagctttcctctgtaagagaagccaggctggggctaggggctgtgggagtggggaagtcactgtttctcttttggggtggcctgggttgctcacacatggagcaagtggctgggggaattattccctcccacgacttcctgttaagaggccgacactcttggaaagaaaatcaagctagcctttatatctttgtgtgatttaggatctaatatataactaaataaacaactcttttccccaagtg

SEQ ID NO: 21829 - DNA, 4345 bp, Homo sapiens
cgcacctgctgcaggtgctcccggccgccccggaccagcgagcgcgggcactgcggcggggaggatgctgcgcgagcggaccgtgcggctgcagtacgggagccgcgtggaggcggtgtacgtgctgggcacctacctctggaccgatgtctacagcgcggccccagccggggcccaaaccttcagcctgaagcactcggaacacgtgtgggtggaggtggtgcgtgatggggaggctgaggaggtggccaccaatggcaagcagcgctggcttctctcgcccagcaccaccctgcgggtcaccatgagccaggcgagcaccgaggccagcagtgacaaggtcaccgtcaactactatgacgaggaagggagcattcccatcgaccaggcggggctcttcctcacagccattgagatctccctggatgtggacgcagaccgggatggtgtggtggagaagaacaacccaaagaaggcatcctggacctggggccccgagggccagggggccatcctgctggtgaactgtgaccgagagacaccctggttgcccaaggaggactgccgtgatgagaaggtctacagcaaggaagatctcaaggacatgtcccagatgatcctgcggaccaaaggccccgaccgcctccccgccggatacgagatagttctgtacatttccatgtcagactcagacaaagtgggcgtgttctacgtggagaacccgttcttcggccaacgctatatccacatcctgggccggcggaagctctaccatgtggtcaagtacacgggtggctccgcggagctgctgttcttcgtggaaggcctctgtttccccgacgagggcttctcaggcctggtctccatccatgtcagcctgctggagtacatggcccaggacattcccctgactcccatcttcacggacaccgtgatattccggattgctccgtggatcatgacccccaacatcctgcctcccgtgtcggtgtttgtgtgctgcatgaaggataattacctgttcctgaaagaggtgaagaaccttgtggagaaaaccaactgtgagctgaaggtctgcttccagtacctaaaccgaggcgatcgctggatccaggatgaaattgagtttggctacatcgaggccccccataaaggcttccccgtggtgctggactctccccgagatggaaacctaaaggacttccctgtgaaggagctcctgggcccagattttggctacgtgacccgggagcccctctttgagtctgtcaccagccttgactcatttggaaacctggaggtcagtcccccagtgaccgtgaacggcaagacatacccgcttggccgcatcctcatcgggagcagctttcctctgtctggtggtcggaggatgaccaaggtggtgcgtgacttcctgaaggcccagcaggtgcaggcgcccgtggagctctactcagactggctgactgtgggccacgtggatgagttcatgtcctttgtccccatccccggcacaaagaaattcctgctactcatggccagcacctcggcctgctacaagctcttccgagagaagcagaaggacggccatggagaggccatcatgttcaaaggcttgggtgggatgagcagcaagcgaatcaccatcaacaagattctgtccaacgagagccttgtgcaggagaacctgtacttccagcgctgcctagactggaaccgtgacatcctcaagaaggagctgggactgacagagcaggacatcattgacctgcccgctctgttcaagatggacgaggaccaccgtgccagagccttcttcccaaacatggtgaacatgatcgtgctggacaaggacctgggcatccccaagccattcgggccacaggttgaggaggaatgctgcctggagatgcacgtgcgtggcctcctggagcccctgggcctcgaatgcaccttcatcgacgacatttctgcctaccacaaatttctgggggaagtccactgtggcaccaacgtccgcaggaagcccttcaccttcaagtggtggcacatggtgccctgacctgccaggggccctggcgtttgcctccttcgcttagttctccagaccctccctcacacgcccagagccttctgctgacatggactggacagccccgctgggagacctttgggacgtggggtggaatttggggtatctgtgccttgccctccctgagaggggcctcagtgtcctctgaagccatccccagtgagcctcgactctgtccctgctgaaaatagctgggccagtgtctctgtagccctgacataaggaacagaacacaacaaaacacagcaaaccatgtgcccaaactgctccccaaagaattttgagtctctaatctgacactgaatgaggggagaagggaaggagattctgggattgccagttcttccagcagccatgctctgaaaatcaaggtagaatccatggaaagggaccccaggaccccgggaccctagacgtatcttgaactgccatcgtcatttcaaatacatctccctcagggtttccaggtggccacccccaattattcattccttaccaacctctcaaatcctcttggctttctctctgcagtgtggacactgttggctagtcctccccactccctgagggtccagtaagttagcttagaaccttcctggaaacatttcatctgagcaggtttccccacgtgtgggatgctccttttgcctcatctgtctcagggatgcaggctcccccgcatgcatggggatttctccccagaccagcatacttgtgacctgagagttcaatgcgtaaagatgcccctggtcagccatatccatcttctcttgcctggtccttgattctctggccgctccctgaccttcctccttccactgccttgactttcttcctttttattcctggtgccatctgtccaggcagctagacaagaacttgttcgccagcagccagattcaggccttcccaggggcataataagtgaccagcccctcctctccggacatcagatccaacacataaggaccctggcctaccctccagcccaacagccagttctgggtcagctgccaacttaggggtggtttgattatcccattgaaattcaccagtgcctttgccaaagaccctctcatttggacatacccagattcattccctggctccaactgaaaagactcagtttcaatcgttaaaagttcctttagggccagaagaataaatgaattataatcccattttgaagaaccgatttataaccaatgaaaaggttataatgtaatttatattcttggaggaacaagattttcatttgggattatttccttcaaccattcaacaaacatttgttgtatgccactaagcgccaggcacggcgttgggctctgcaaacacagtggttagtagcagtctggacctggtccctactggcatggaacccatcactccccaacatgcaaagcccacatttaaaggccagcctctgccccttcagtgatgcgctctttagaaatgccagtccactatattcagaaatccgcagggcacaaaacttccagcaagtcactgttgtggtgaaatgggcagtgggggtggggggtcttctttaaacaggcccccttcccatctacctagccagtacccatccaatgagtccccagagcctccagaagctgttgtctcctctctggggacagcagctcctgcctttggaggccaaagccccagatctctccagccccagagctgaaaacaccaagtgcctatttgagggtgtctgtctggagacttagagtttgtcatgtgtgtgtgtgtgtttggttaatgtgggtttatgggttttctttcttttttttctttttttttttagtctacattagggggaagtgagcgcctcccatgtgcagacagtgtgtctttatagatttttctaaggctttccccaatgatgtcggtaatttctgatgtttctgaagttcccaggactcacacacccgttcccatctcacttgcccacccagtgtgacaaccctcggtgtggatatacccccgtggactcatggctcttccccacccccactttctataaatgtaggcctagaatacgcttctctgttgcaaaactcagctaagttcctgcttccaccttgatgttgaaatatcttatgtaagagggcaggggatgtcgtgaagatggcaagaagaacacagtttcaaatttctggaaaagagcctgtggtggagatctaaagatgtttagggaagagctcgactaaagaacaatgaaataaatggtccaaggggaagtca

SEQ ID NO: 21830 - DNA, 2333 bp, Homo sapiens
gcaggctgctggagaaggcgcacctgctgcaggtgctcccggccgccccggaccagcgagcgcgggcactgcggcggggaggatgctgcgcgagcggaccgtgcggctgcagtacgggagccgcgtggaggcggtgtacgtgctgggcacctacctctggaccgatgtctacagcgcggccccagccggggcccaaaccttcagcctgaagcactcggaacacgtgtgggtggaggtggtgcgtgatggggaggctgaggaggtggccaccaatggcaagcagcgctggcttctctcgcccagcaccaccctgcgggtcaccatgagccaggcgagcaccgaggccagcagtgacaaggtcaccgtcaactactatgacgaggaagggagcattcccatcgaccaggcggggctcttcctcacagccattgagatctccctggatgtggacgcagaccgggatggtgtggtggagaagaacaacccaaagaagacccgttcttcggccaacgctatatccacatcctgggccggcggaagctctaccatgtggtcaagtacacgggtggctccgcggagctgctgttcttcgtggaaggcctctgtttccccgacgagggcttctcaggcctggtctccatccatgtcagcctgctggagtacatggcccagcatgaaggataattacctgttcctgaaagaggtgaagaaccttgtggagaaaaccaactgtgagctgaaggtctgcttccagtacctaaaccgaggcgatcgctggatccaggatgaaattgagtttggctacatcgaggccccccataaaggcttccccgtggtgctggactctccccgagatggaaacctaaaggacttccctgtgaaggagctcctgggcccagattttggctacgtgacccgggagcccctctttgagtctgtcaccagccttgactcatttggaaacctggaggtcagtcccccagtgaccgtgaacggcaagacatacccgcttggccgcatcctcatcgggagcagctttcctctgtctggtggtcggaggatgaccaaggtggtgcgtgacttcctgaaggcccagcaggtgcaggcgcccgtggagctctactcagactggctgactgtgggccacgtggatgagttcatgtcctttgtccccatccccggcacaaagaaattcctgctactcatggccagcacctcggcctgctacaagctcttccgagagaagcagaaggacggccatggagaggccatcatgttcaaaggcttgggtgggatgagcagcaagcgaatcaccatcaacaagattctgtccaacgagagccttgtgcaggagaacctgtacttccagcgctgcctagactggaaccgtgacatcctcaagaaggagctgggactgacagagcaggacatcattgacctgcccgctctgttcaagatggacgaggaccaccgtgccagagccttcttcccaaacatggtgaacatgatcgtgctggacaaggacctgggcatccccaagccattcgggccacaggttgaggaggaatgctgcctggagatgcacgtgcgtggcctcctggagcccctgggcctcgaatgcaccttcatcgacgacatttctgcctaccacaaatttctgggggaagtccactgtggcaccaacgtccgcaggaagcccttcaccttcaagtggtggcacatggtgccctgacctgccaggggccctggcgtttgcctccttcgcttagttctccagaccctccctcacacgcccagagccttctgctgacatggactggacagccccgctgggagacctttgggacgtggggtggaatttggggtatctgtgccttgccctccctgagaggggcctcagtgtcctctgaagccatccccagtgagcctcgactctgtccctgctgaaaatagctgggccagtgtctctgtagccctgacataaggaacagaacacaacaaaacacagcaaaccatgtgcccaaactgctccccaaagaattttgagtctctaatctgacactgaatgaggggagaagggaaggagattctgggattgccagttcttccagcagccatgctctgaaaatcaaggtagaatccatggaaagggaccccaggaccccgggaccctagacgtatcttgaactgccatcgtcatttcaaatacatctccctcagggtttccaggtggccacccccaattattcattccttaccaacctctcaaatcctcttggctttctctctgcagtgtggacactgttggctagtcctccccactccctgagggt

SEQ ID NO: 21831 - DNA, 3189 bp, Homo sapiens
agtgttggggttggcggccacagctaagtccaacaccagcatgtcgctgcagagaatcgtgcgtgtgtccctggagcatcccaccagcgcggtgtgtgtggctggcgtggagaccctcgtggacatttatgggtcagtgcctgagggcacagaaatgtttgaggtctatgggacgcctggcgtggacatctacatctctcccaacatggagaggggccgggagcgtgcagacaccaggcggtggcgctttgacgcgactttggagatcatcgtggtcatgaactcccccagcaatgacctcaacgacagccatgttcagatttcctaccactccagccatgagcctctgcccctggcctatgcggtgctctacctcacctgtgttgacatctctctggattgcgacctgaactgtgagggaaggcaggacaggaactttgtagacaagcggcagtgggtctgggggcccagtgggtatggcggcatcttgctggtgaactgtgaccgtgatgatccgagctgtgatgtccaggacaattgtgaccagcacgtgcactgcctgcaagacctggaagacatgtctgtcatggtcctgcggacgcagggccctgcagccctctttgatgaccacaaacttgtcctccatacctccagctatgatgccaaacgggcacaggtcttccacatctgcggtcctgaggatgtgtgtgaggcctataggcatgtgctgggccaagataaggtgtcctatgaggtaccccgcttgcatggggatgaggagcgcttcttcgtggaaggcctgtccttccctgatgccggcttcacaggactcatctccttccatgtcactctgctggacgactccaacgaggatttctcggcatcccctatcttcactgacactgtggtgttccgagtggcaccctggatcatgacgcccagcactctgccacccctagaggtgtatgtgtgccgtgtgaggaacaacacgtgttttgtggatgcggtggcagagctggccaggaaggccggctgcaagctgaccatctgcccacaggccgagaaccgcaacgaccgctggatccaggatgagatggagctgggctacgttcaggcgccgcacaagaccctcccggtggtctttgactccccaaggaatggggaactgcaggatttcccttacaaaagaatcctgggtccagattttggttacgtgactcgggaaccacgcgacaggtctgtgagtggcctggactcctttgggaacctggaggtcagccctccagtggtggccaatgggaaagagtaccccctggggaggatcctcattgggggcaacctgcctgggtcaagtggccgcagggtcacccaggtggtgcgggacttcctccatgcccagaaggtgcagccccccgtggagctctttgtggactggttggccgtgggccatgtggatgagtttctgagctttgtccctgcccccgatgggaagggcttccggatgctcctggccagccctggggcctgcttcaagctcttccaggaaaagcagaagtgtggccacgggagggccctcctgttccagggggttgttgatgatgagcaggtcaagaccatctccatcaaccaggtgctctccaataaagacctcatcaactacaataagtttgtgcagagctgcatcgactggaaccgtgaggtgctgaagcgggagctgggcctggcagagtgtgacatcattgacatcccacagctcttcaagaccgagaggaaaaaagcaacggccttcttccctgacttggtgaacatgctggtgctggggaagcacctgggcatccccaagccctttgggcccatcatcaatggctgctgctgcctggaggagaaggtgcggtccctgctggagccgctgggcctccactgcaccttcattgatgacttcactccataccacatgctgcatggggaggtgcactgtggcaccaatgtgtgcagaaagcccttctctttcaagtggtggaacatggtgccctgagacagctcccacccaccatcctgtccccctggggcgggcattggcccaggtggtggagacagagacaggcccctgaacgataagcaccaagagaccccaaggctccagatggaacactgagggtgaccgtccctctcagaagccttttccctggaagtgtccatgcctcacctgcaacccatgtggttctcagacttgaatcttctcggccccccaaaaagaaggacctcatttcttatagcctctcctgtgattcaacacaacccatggagatgtccccttctcactctgaaatcatccatttggggacaaatccacattggggtctagaaacatccacgtatctcatcagccatcttgtcctgtgcatcctaacagaggaaggatccatgattctgctttggtccaattgcttcctctctgcagaggaacaaccctaaaaccagaccactccacgcaggacaggcaggagagattcttcctaaagcctcccccataaaaagggagctgtggatccacttagatcagggcggaaccatctttcacccggccaagctcctgcccagatgttgaccctcacccagcgtgagctgtcacatagtaggagcttctagatgcatgtggaagcaatgagagttgtcccttagccttataaactccccatgatctgacatgcagaaatccagccttgtccagaatcctcctggaatttcttggagacgaaagtatctgggggattgttgggtactagggagactgggtacaagggtgaaaagtagttcccataatacacatggttgactatggtgatccaccttgtgatggttaatattaggtgtctggagaaggttgcttcattggccctgggacttctctctgcaggaggagagaacgctgcctctcctctggattggtctcaggctctctgttggcctttggtcagcgtttccacatcctgctctgctgcaggagagggggctaaggggctggatccaccaaggcagctcacagcgggaaaactctgggaatgaaccactgaattcaggggatgggggtgggggggcggttctcgaggtgtgtgccagctacacgtgtgttctgtatgggtccagctgcgtttccatcactcgctaataaatcaacagaaacacaaa

SEQ ID NO: 21832 - DNA, 833 bp, Homo sapiens
acagccagagggacgagctagcccgacgatggcccaggggacattgatccgtgtgaccccagagcagcccacccatgccgtgtgtgtgctgggcaccttgactcagcttgacatctgcagctctgcccctgaggactgcacgtccttcagcatcaacgcctccccaggggtggtcgtggatattgcccacggccctccagccaagaagaaatccacaggttcctccacatggcccctggaccctggggtagaggtgaccctgacgatgaaagtggccagtggtagcacaggcgaccagaaggttcagatttcatactacggacccaagactccaccagtcaaagctctactctacctcaccggggtggatggagtctcaccctgtcacccaggctggagtgcaatgcatgatctcgctcactgcaacctgcgtctccaggttcaagcgatcctctgcttcagcgtccctagtagctggactacaggcgcttgccaccacgcctggctaatttttgtatttttagtagagatggagtttcaccatgttggccaggctggtctcgaacttctgacctcaggtgatctgcctgcctcaggctcccaaagtgctcggattactggcatgaaccactgcgccaggccctctatttttttgatactcaaatatctataacaaaaagtagataatgacactgtcttatacaagaatatagatagtgttcctcaaattccattatttatatctcatcttcaccatttctgccatatcaatgatccacctatactcatatttatgtaatgttcttctttaaataaaatccattcttaaactt

SEQ ID NO: 21833 - DNA, 2267 bp, Homo sapiens
agccagagggacgagctagcccgacgatggcccaggggacattgatccgtgtgaccccagagcagcccacccatgccgtgtgtgtgctgggcaccttgactcagcttgacatctgcagctctgcccctgaggactgcacgtccttcagcatcaacgcctccccaggggtggtcgtggatattgcccacggccctccagccaagaagaaatccacaggttcctccacatggcccctggaccctggggtagaggtgaccctgacgatgaaagtggccagtggtagcacaggcgaccagaaggttcagatttcatactacggacccaagactccaccagtcaaagctctactctacctcaccggggtggaaatctccttgtgcgcagacatcacccgcaccggcaaagtgaagccaaccagagctgtgaaagatcagaggacctggacctggggcccttgtggacagggtgccatcctgctggtgaactgtgacagagacaatctcgaatcttctgccatggactgcgaggatgatgaagtgcttgacagcgaagacctgcaggacatgtcgctgatgaccctgagcacgaagacccccaaggacttcttcacaaaccatacactggtgctccacgtggccaggtctgagatggacaaagtgagggtgtttcaggccacacggggcaaactgtcctccaagtgcagcgtagtcttgggtcccaagtggccctctcactacctgatggtccccggtggaaagcacaacatggacttctacgtggaggccctcgctttcccggacaccgacttcccggggctcattaccctcaccatctccctgctggacacgtccaacctggagctccccgaggctgtggtgttccaagacagcgtggtcttccgcgtggcgccctggatcatgacccccaacacccagcccccgcaggaggtgtacgcgtgcagtatttttgaaaatgaggacttcctgaagtcagtgactactctggccatgaaagccaagtgcaagctgaccatctgccctgaggaggagaacatggatgaccagtggatgcaggatgaaatggagatcggctacatccaagccccacacaaaacgctgcccgtggtcttcgactctccaaggaacagaggcctgaaggagtttcccatcaaacgcgtgatgggtccagattttggctatgtaactcgagggccccaaacagggggtatcagtggactggactcctttgggaacctggaagtgagccccccagtcacagtcaggggcaaggaatacccgctgggcaggattctcttcggggacagctgttatcccagcaatgacagccggcagatgcaccaggccctgcaggacttcctcagtgcccagcaggtgcaggcccctgtgaagctctattctgactggctgtccgtgggccacgtggacgagttcctgagctttgtgccagcacccgacaggaagggcttccggctgctcctggccagccccaggtcctgctacaaactgttccaggagcagcagaatgagggccacggggaggccctgctgttcgaagggatcaagaaaaaaaaacagcagaaaataaagaacattctgtcaaacaagacattgagagaacataattcatttgtggagagatgcatcgactggaaccgcgagctgctgaagcgggagctgggcctggccgagagtgacatcattgacatcccgcagctcttcaagctcaaagagttctctaaggcggaagcttttttccccaacatggtgaacatgctggtgctagggaagcacctgggcatccccaagcccttcgggcccgtcatcaacggccgctgctgcctggaggagaaggtgtgttccctgctggagccactgggcctccagtgcaccttcatcaacgacttcttcacctaccacatcaggcatggggaggtgcactgcggcaccaacgtgcgcagaaagcccttctccttcaagtggtggaacatggtgccctgagcccatcttccctggcgtcctctccctcctggccagatgtcgctgggtcctctgcagtgtggcaagcaagagctcttgtgaatattgtggctccctgggggcggccagccctcccagcagtggcttgctttcttctcctgtgatgtcccagtttcccactctgaagatcccaacatggtcctagcactgcacactcagttctgctctaagaagctgcaataaagtttttttaagtcactttgtacatga

SEQ ID NO: 21834 - DNA, 841 bp, Homo sapiens
acagccagagggacgagctagcccgacgatggcccaggggacattgatccgtgtgaccccagagcagcccacccatgccgtgtgtgtgctgggcaccttgactcagcttgacatctgcagctctgcccctgaggactgcacgtccttcagcatcaacgcctccccaggggtggtcgtggatattgcccacggccctccagccaagaagaaatccacaggttcctccacatggcccctggaccctggggtagaggtgaccctgacgatgaaagtggccagtggtagcacaggcgaccagaaggttcagatttcatactacggacccaagactccaccagtcaaagctctactctacctcaccggggtggatggagtctcaccctgtcacccaggctggagtgcaatggcatgatctcggctcactgcaacctgcgtctcccaggttcaagcgatcctcctgcttcagcgtccctagtagctgggactacaggcgcttgccaccacgcctggctaatttttgtatttttagtagagatggagtttcaccatgttggccaggctggtctcgaacttctgacctcaggtgatctgcctgcctcaggctcccaaagtgctcggattactggcatgaaccactgcgccaggccctctattcctttttgatacctcaaatatctataacaaaaagtagataatgacactgtcttatacaagaatatagatagtgttcctcaaattccattatttatatctcatcttcaccatttctgccatatcaatgatccacctatactcatatttatgtaatgttcttctttaaataaaatccattcttaaactt

SEQ ID NO: 21835 - DNA, 3446 bp, Homo sapiens
ggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtttaaagaaactaccagaccattttccaatgaatgtcttggtaccaccagacccgtagttcctattgattcatcagattttgcattggatattcgcatgcctggggttacacctaaacagttgacttcaagcctcgagccagcatggatactgtccatcacatgttactttttggatgcaatatgccttcatccactggaagttactggttttgtgatgaaggaacctgtacagataaagccaatattctgtatgcctgggcgagaaatgctccccctacccggctccccaaaggtgttggattcagagttggaggagagactggaagtaaatactttgtactacaggtacactatggggatattagtgcttttagagataataacaaggactgttctggtgtgtccttacacctcacacgtctgccacagcctttaattgctggcatgtaccttatgatgtctgttgacactgttatcccagcaggagaaaaagtggtgaattctgacatttcatgccattataaaaattatccaatgcatgtctttgcctatagagttcacactcaccatttaggtaaggtagtaagtggatacagagtaagaaatggacagtggacactgattggacggcagagccctcagctgccacaggctttctaccctgtggggcatccagttgatgtaagttttggtgacctactggctgcaagatgtgtattcactggtgaaggaaggacagaagccacacacattggtggcacgtctagtgatgaaatgtgcaacttatacattatgtattacatggaagccaagcatgcagtttctttcatgacctgtacccagaatgtagctccagatatgttcagaaccataccaccagaggccaacattccaattcccgtgaagtctgatatggttatgatgcatgaacatcataaagaaacagaatataaagataagattcctttactacagcagccaaaacgagaagaagaagaagtgttagaccagggtgatttctattcactactttccaagctgctaggagaaagggaagatgttgttcatgtgcacaaatataatcctacagaaaaggcagaatcagagtcagacctggtagctgagattgcaaatgtagtccaaaaaaaggatcttggtcgatctgatgccagagagggtgcagaacatgagaggggtaatgctattcttgtcagagacagaattcacaaattccacagactagtatctaccttgaggccaccagagagcagagttttctcattacagcagcccccacctggtgaaggcacctgggaaccagaacacacaggagatttccacatggaagaggcactggattggcctggagtatacttgttaccaggccaggtttctggggtggctctagaccctaagaataacctggtgattttccacagaggtgaccatgtctgggatggaaactcgtttgacagcaagtttgtttaccagcaaataggactcggaccaattgaagaagacactattcttgtcatagatccaaataatgctgcagtactccagtccagtggaaaaaatctgttttacttgccacatggcttgagtatagataaagatgggaattattgggtcacagacgtggctctccatcaggtgttcaaactggatccaaacaataaagaaggccctgtattaatcctgggaaggagcatgcaaccaggcagtgaccagaatcacttctgtcaacccactgatgtggctgtggatccaggcactggagccatttatgtatcagatggttactgcaacagcaggattgtgcagttttcaccaagtggaaagttcatcacacagtggggagaagagtcttcagggagcagtcctctgccaggccagttcactgttcctcacagcttggctcttgtgcctcttttgggccaattatgtgtggcagaccgggaaaatggtcggatccagtgttttaaaactgacaccaaagaatttgtgagagagattaagcattcatcatttggaagaaatgtatttgcaatttcatatataccaggcttgctctttgcagtgaatgggaagcctcattttggggaccaagaacctgtacaaggatttgtgatgaacttttccaatggggaaattatagacatcttcaagccagtgcgcaagcactttgatatgcctcatgatattgttgcatctgaagatgggactgtgtacattggagatgctcataccaacaccgtgtggaagttcaccttgactgagaaattggaacatcgatcagttaaaaaggctggcattgaggtccaggaaatcaaagccgaggcagttgttgaaaccaaaatggagaacaaacccacctcctcagaattgcagaagatgcaagagaaacagaaactgatcaaagagccaggctcgggagtgcctgttgttctcattacaacccttctggttattccggtggttgtcctgctggccattgccatatttattcggtggaaaaaatcaagggcctttggagattctgaacacaaactcgagacgagttcaggaagagtactgggaagatttagaggaaagggaagtggaggcttaaaccttggtaatttctttgcaagccgtaagggctacagtcgaaaagggtttgaccggcttagcactgagggcagtgaccaagagaaagaggatgatggaagtgaatcagaagaggagtattcagcacctctgcctgcgctcgcaccttcctcctcctgaaaaccaagctttgatttagattgagtaagatttacccagaatgtcagattcctttccctttagcacgtttaaagttctgtgtatttaattgtaaactgtactagtctgtgtgggactgtacacactttatttacttcgttttggttaagttggcttctgtttctagttgaggagtttcctaaaagttcataacagtgccattgtctttatatgaacatagactagagaaaccgtcctctttttccatcataattctaatctaacaatggaagatttgcccatttacacttttgagactttttggtggatgtaaataaccccattctttgcttgaacacagtattttcccaatagcactttcattgccagtgtctttctttggtgcctttcctgttcagcattcttagcctgtggcagtaaagagaaactttgtgctacatgacgac

SEQ ID NO: 21836 - DNA, 3156 bp, Homo sapiens
gaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtttaaagaaactaccagaccattttccaatgaatgtcttggtaccaccagacccgtagttcctattgattcatcagattttgcattggatattcgcatgcctggggttacacctaaacagtccgatacatacttctgcatgtctatgcgaataccagtggatgaggaagccttcgtgattgacttcaagcctcgagccagcatggatactgtccatcacatgttactttttggatgcaatatgccttcatccactggaagttactggttttgtgatgaaggaacctgtacagataaagccaatattctgtatgcctgggcgagaaatgctccccctacccggctccccaaaggtgttggattcagagttggaggagagactggaagtaaatactttgtactacaggtacactatggggatattagtgcttttagagataataacaaggactgttctggtgtgtccttacacctcacacgtctgccacagcctttaattgctggcatgtaccttatgatgtctgttgacactgttatcccagcaggagaaaaagtggtgaattctgacatttcatgccattataaaaattatccaatgcatgtctttgcctatagagttcacactcaccatttaggtaaggtagtaagtggatacagagtaagaaatggacagtggacactgattggacggcagagccctcagctgccacaggctttctaccctgtggggcatccagttgatgtaagttttggtgacctactggctgcaagatgtgtattcactggtgaaggaaggacagaagccacacacattggtggcacgtctagtgatgaaatgtgcaacttatacattatgtattacatggaagccaagcatgcagtttctttcatgacctgtacccagaatgtagctccagatatgttcagaaccataccaccagaggccaacattccaattcccgtgaagtctgatatggttatgatgcatgaacatcataaagaaacagaatataaagataagattcctttactacagcagccaaaacgagaagaagaagaagtgttagaccagggtgatttctattcactactttccaagctgctaggagaaagggaagatgttgttcatgtgcacaaatataatcctacagaaaaggcagaatcagagtcagacctggtagctgagattgcaaatgtagtccaaaaaaaggatcttggtcgatctgatgccagagagggtgcagaacatgagaggggtaatgctattcttgtcagagacagaattcacaaattccacagactagtatctaccttgaggccaccagagagcagagttttctcattacagcagcccccacctggtgaaggcacctgggaaccagaacacacaggagatttccacatggaagaggcactggattggcctggagtatacttgttaccaggccaggtttctggggtggctctagaccctaagaataacctggtgattttccacagaggtgaccatgtctgggatggaaactcgtttgacagcaagtttgtttaccagcaaataggactcggaccaattgaagaagacactattcttgtcatagatccaaataatgctgcagtactccagtccagtggaaaaaatctgttttacttgccacatggcttgagtatagataaagatgggaattattgggtcacagacgtggctctccatcaggtgttcaaactggatccaaacaataaagaaggccctgtattaatcctgggaaggagcatgcaaccaggcagtgaccagaatcacttctgtcaacccactgatgtggctgtggatccaggcactggagccatttatgtatcagatggttactgcaacagcaggattgtgcagttttcaccaagtggaaagttcatcacacagtggggagaagagtcttcagggagcagtcctctgccaggccagttcactgttcctcacagcttggctcttgtgcctcttttgggccaattatgtgtggcagaccgggaaaatggtcggatccagtgttttaaaactgacaccaaagaatttgtgagagagattaagcattcatcatttggaagaaatgtatttgcaatttcatatataccaggcttgctctttgcagtgaatgggaagcctcattttggggaccaagaacctgtacaaggatttgtgatgaacttttccaatggggaaattatagacatcttcaagccagtgcgcaagcactttgatatgcctcatgatattgttgcatctgaagatgggactgtgtacattggagatgctcataccaacaccgtgtggaagttcaccttgactgagaaattggaacatcgatcagttaaaaaggctggcattgaggtccaggaaatcaaagaagccgaggcagttgttgaaaccaaaatggagaacaaacccacctcctcagaattgcagaagatgcaagagaaacagaaactgatcaaagagccaggctcgggagtgcctgttgttctcattacaacccttctggttattccggtggttgtcctgctggccattgccatatttattcggtggaaaaaatcaagggcctttggagcagattctgaacacaaactcgagacgagttcaggaagagtactgggaagatttagaggaaagggaagtggaggcttaaaccttggtaatttctttgcaagccgtaagggctacagtcgaaaagggtttgaccggcttagcactgagggcagtgaccaagagaaagaggatgatggaagtgaatcagaagaggagtattcagcacctctgcctgcgctcgcaccttcctcctcctgaaaaccaagctttgatttagattgagtaagatttacccagaatgtc

SEQ ID NO: 21837 - DNA, 3302 bp, Homo sapiens
aatgtattaaagaacctcagctgggatttgctgaggacaaatgctgtaacgtgttagtcatccattatctgcttctatttttgcaggttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtttaaagaaactaccagaccattttccaatgaatgtcttggtaccaccagacccgtagttcctattgattcatcagattttgcattggatattcgcatgcctggggttacacctaaacagtccgatacatacttctgcatgtctatgcgaataccagtggatgaggaagccttcgtgattgacttcaagcctcgagccagcatggatactgtccatcacatgttactttttggatgcaatatgccttcatccactggaagttactggttttgtgatgaaggaacctgtacagataaagccaatattctgtatgcctgggcgagaaatgctccccctacccggctccccaaaggtgttggattcagagttggaggagagactggaagtaaatactttgtactacaggtacactatggggatattagtgcttttagagataataacaaggactgttctggtgtgtccttacacctcacacgtctgccacagcctttaattgctggcatgtaccttatgatgtctgttgacactgttatcccagcaggagaaaaagtggtgaattctgacatttcatgccattataaaaattatccaatgcatgtctttgcctatagagttcacactcaccatttaggtaaggtagtaagtggatacagagtaagaaatggacagtggacactgattggacggcagagccctcagctgccacaggctttctaccctgtggggcatccagttgatgtaagttttggtgacctactggctgcaagatgtgtattcactggtgaaggaaggacagaagccacacacattggtggcacgtctagtgatgaaatgtgcaacttatacattatgtattacatggaagccaagcatgcagtttctttcatgacctgtacccagaatgtagctccagatatgttcagaaccataccaccagaggccaacattccaattcccgtgaagtctgatatggttatgatgcatgaacatcataaagaaacagaatataaagataagattcctttactacagcagccaaaacgagaagaagaagaagtgttagaccagggtgatttctattcactactttccaagctgctaggagaaagggaagatgttgttcatgtgcacaaatataatcctacagaaaaggcagaatcagagtcagacctggtagctgagattgcaaatgtagtccaaaaaaaggatcttggtcgatctgatgccagagagggtgcagaacatgagaggggtaatgctattcttgtcagagacagaattcacaaattccacagactagtatctaccttgaggccaccagagagcagagttttctcattacagcagcccccacctggtgaaggcacctgggaaccagaacacacaggagatttccacatggaagaggcactggattggcctggagtatacttgttaccaggccaggtttctggggtggctctagaccctaagaataacctggtgattttccacagaggtgaccatgtctgggatggaaactcgtttgacagcaagtttgtttaccagcaaataggactcggaccaattgaagaagacactattcttgtcatagatccaaataatgctgcagtactccagtccagtggaaaaaatctgttttacttgccacatggcttgagtatagataaagatgggaattattgggtcacagacgtggctctccatcaggtgttcaaactggatccaaacaataaagaaggccctgtattaatcctgggaaggagcatgcaaccaggcagtgaccagaatcacttctgtcaacccactgatgtggctgtggatccaggcactggagccatttatgtatcagatggttactgcaacagcaggattgtgcagttttcaccaagtggaaagttcatcacacagtggggagaagagtcttcagggagcagtcctctgccaggccagttcactgttcctcacagcttggctcttgtgcctcttttgggccaattatgtgtggcagaccgggaaaatggtcggatccagtgttttaaaactgacaccaaagaatttgtgagagagattaagcattcatcatttggaagaaatgtatttgcaatttcatatataccaggcttgctctttgcagtgaatgggaagcctcattttggggaccaagaacctgtacaaggatttgtgatgaacttttccaatggggaaattatagacatcttcaagccagtgcgcaagcactttgatatgcctcatgatattgttgcatctgaagatgggactgtgtacattggagatgctcataccaacaccgtgtggaagttcaccttgactgagaaattggaacatcgatcagttaaaaaggctggcattgaggtccaggaaatcaaaggaaagggaagtggaggcttaaaccttggtaatttctttgcaagccgtaagggctacagtcgaaaagggtttgaccggcttagcactgagggcagtgaccaagagaaagaggatgatggaagtgaatcagaagaggagtattcagcacctctgcctgcgctcgcaccttcctcctcctgaaaaccaagctttgatttagattgagtaagatttacccagaatgtcagattcctttccctttagcacgtttaaagttctgtgtatttaattgtaaactgtactagtctgtgtgggactgtacacactttatttacttcgttttggttaagttggcttctgtttctagttgaggagtttcc

SEQ ID NO: 21838 - DNA, 3622 bp, Homo sapiens
gttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtttaaagaaactaccagaccattttccaatgaatgtcttggtaccaccagacccgtagttcctattgattcatcagattttgcattggatattcgcatgcctggggttacacctaaacagtccgatacatacttctgcatgtctatgcgaataccagtggatgaggaagccttcgtgattgacttcaagcctcgagccagcatggatactgtccatcacatgttactttttggatgcaatatgccttcatccactggaagttactggttttgtgatgaaggaacctgtacagataaagccaatattctgtatgcctgggcgagaaatgctccccctacccggctccccaaaggtgttggattcagagttggaggagagactggaagtaaatactttgtactacaggtacactatggggatattagtgcttttagagataataacaaggactgttctggtgtgtccttacacctcacacgtctgccacagcctttaattgctggcatgtaccttatgatgtctgttgacactgttatcccagcaggagaaaaagtggtgaattctgacatttcatgccattataaaaattatccaatgcatgtctttgcctatagagttcacactcaccatttaggtaaggtagtaagtggatacagagtaagaaatggacagtggacactgattggacggcagagccctcagctgccacaggctttctaccctgtggggcatccagttgatgtaagttttggtgacctactggctgcaagatgtgtattcactggtgaaggaaggacagaagccacacacattggtggcacgtctagtgatgaaatgtgcaacttatacattatgtattacatggaagccaagcatgcagtttctttcatgacctgtacccagaatgtagctccagatatgttcagaaccataccaccagaggccaacattccaattcccgtgaagtctgatatggttatgatgcatgaacatcataaagaaacagaatataaagataagattcctttactacagcagccaaaacgagaagaagaagaagtgttagaccaggatttccacatggaagaggcactggattggcctggagtatacttgttaccaggccaggtttctggggtggctctagaccctaagaataacctggtgattttccacagaggtgaccatgtctgggatggaaactcgtttgacagcaagtttgtttaccagcaaataggactcggaccaattgaagaagacactattcttgtcatagatccaaataatgctgcagtactccagtccagtggaaaaaatctgttttacttgccacatggcttgagtatagataaagatgggaattattgggtcacagacgtggctctccatcaggtgttcaaactggatccaaacaataaagaaggccctgtattaatcctgggaaggagcatgcaaccaggcagtgaccagaatcacttctgtcaacccactgatgtggctgtggatccaggcactggagccatttatgtatcagatggttactgcaacagcaggattgtgcagttttcaccaagtggaaagttcatcacacagtggggagaagagtcttcagggagcagtcctctgccaggccagttcactgttcctcacagcttggctcttgtgcctcttttgggccaattatgtgtggcagaccgggaaaatggtcggatccagtgttttaaaactgacaccaaagaatttgtgagagagattaagcattcatcatttggaagaaatgtatttgcaatttcatatataccaggcttgctctttgcagtgaatgggaagcctcattttggggaccaagaacctgtacaaggatttgtgatgaacttttccaatggggaaattatagacatcttcaagccagtgcgcaagcactttgatatgcctcatgatattgttgcatctgaagatgggactgtgtacattggagatgctcataccaacaccgtgtggaagttcaccttgactgagaaattggaacatcgatcagttaaaaaggctggcattgaggtccaggaaatcaaagaagccgaggcagttgttgaaaccaaaatggagaacaaacccacctcctcagaattgcagaagatgcaagagaaacagaaactgatcaaagagccaggctcgggagtgcctgttgttctcattacaacccttctggttattccggtggttgtcctgctggccattgccatatttattcggtggaaaaaatcaagggcctttggagattctgaacacaaactcgagacgagttcaggaagagtactgggaagatttagaggaaagggaagtggaggcttaaaccttggtaatttctttgcaagccgtaagggctacagtcgaaaagggtttgaccggcttagcactgagggcagtgaccaagagaaagaggatgatggaagtgaatcagaagaggagtattcagcacctctgcctgcgctcgcaccttcctcctcctgaaaaccaagctttgatttagattgagtaagatttacccagaatgtcagattcctttccctttagcacgtttaaagttctgtgtatttaattgtaaactgtactagtctgtgtgggactgtacacactttatttacttcgttttggttaagttggcttctgtttctagttgaggagtttcctaaaagttcataacagtgccattgtctttatatgaacatagactagagaaaccgtcctctttttccatcataattctaatctaacaatggaagatttgcccatttacacttttgagactttttggtggatgtaaataaccccattctttgcttgaacacagtattttcccaatagcactttcattgccagtgtctttctttggtgcctttcctgttcagcattcttagcctgtggcagtaaagagaaactttgtgctacatgacgacaaagctgctaaatctcctatttttttaaaatcactaacattatattgcaatgaaggaaataaaaaagtctctatttaaattcttttttaaattttcttcagttggtgtgtttttgggatgtcttatttttagatggttacactgttagaacactattttcagaatctgaatgtaatttgtgtaataaagtgttttcagagca

SEQ ID NO: 21839 - DNA, 3241 bp, Homo sapiens
gttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtttaaagaaactaccagaccattttccaatgaatgtcttggtaccaccagacccgtagttcctattgattcatcagattttgcattggatattcgcatgcctggggttacacctaaacagtccgatacatacttctgcatgtctatgcgaataccagtggatgaggaagccttcgtgattgacttcaagcctcgagccagcatggatactgtccatcacatgttactttttggatgcaatatgccttcatccactggaagttactggttttgtgatgaaggaacctgtacagataaagccaatattctgtatgcctgggcgagaaatgctccccctacccggctccccaaaggtgttggattcagagttggaggagagactggaagtaaatactttgtactacaggtacactatggggatattagtgcttttagagataataacaaggactgttctggtgtgtccttacacctcacacgtctgccacagcctttaattgctggcatgtaccttatgatgtctgttgacactgttatcccagcaggagaaaaagtggtgaattctgacatttcatgccattataaaaattatccaatgcatgtctttgcctatagagttcacactcaccatttaggtaaggtagtaagtggatacagagtaagaaatggacagtggacactgattggacggcagagccctcagctgccacaggctttctaccctgtggggcatccagttgatgtaagttttggtgacctactggctgcaagatgtgtattcactggtgaaggaaggacagaagccacacacattggtggcacgtctagtgatgaaatgtgcaacttatacattatgtattacatggaagccaagcatgcagtttctttcatgacctgtacccagaatgtagctccagatatgttcagaaccataccaccagaggccaacattccaattcccgtgaagtctgatatggttatgatgcatgaacatcataaagaaacagaatataaagataagattcctttactacagcagccaaaacgagaagaagaagaagtgttagaccagggtgatttctattcactactttccaagctgctaggagaaagggaagatgttgttcatgtgcacaaatataatcctacagaaaaggcagaatcagagtcagacctggtagctgagattgcaaatgtagtccaaaaaaaggatcttggtcgatctgatgccagagagggtgcagaacatgagaggggtaatgctattcttgtcagagacagaattcacaaattccacagactagtatctaccttgaggccaccagagagcagagttttctcattacagcagcccccacctggtgaaggcacctgggaaccagaacacacaggagatttccacatggaagaggcactggattggcctggagtatacttgttaccaggccaggtttctggggtggctctagaccctaagaataacctggtgattttccacagaggtgaccatgtctgggatggaaactcgtttgacagcaagtttgtttaccagcaaataggactcggaccaattgaagaagacactattcttgtcatagatccaaataatgctgcagtactccagtccagtggaaaaaatctgttttacttgccacatggcttgagtatagataaagatgggaattattgggtcacagacgtggctctccatcaggtgttcaaactggatccaaacaataaagaaggccctgtattaatcctgggaaggagcatgcaaccaggcagtgaccagaatcacttctgtcaacccactgatgtggctgtggatccaggcactggagccatttatgtatcagatggttactgcaacagcaggattgtgcagttttcaccaagtggaaagttcatcacacagtggggagaagagtcttcagggagcagtcctctgccaggccagttcactgttcctcacagcttggctcttgtgcctcttttgggccaattatgtgtggcagaccgggaaaatggtcggatccagtgttttaaaactgacaccaaagaatttgtgagagagattaagcattcatcatttggaagaaatgtatttgcaatttcatatataccaggcttgctctttgcagtgaatgggaagcctcattttggggaccaagaacctgtacaaggatttgtgatgaacttttccaatggggaaattatagacatcttcaagccagtgcgcaagcactttgatatgcctcatgatattgttgcatctgaagatgggactgtgtacattggagatgctcataccaacaccgtgtggaagttcaccttgactgagaaattggaacatcgatcagttaaaaaggctggcattgaggtccaggaaatcaaagaagccgaggcagttgttgaaaccaaaatggagaacaaacccacctcctcagaattgcagaagatgcaagagaaacagaaactgatcaaagagccaggctcgggagtgcctgttgttctcattacaacccttctggttattccggtggttgtcctgctggccattgccatatttattcggtggaaaaaatcaagggcctttggaggcaaaggaagtggaggcttaaaccttggtaatttctttgcaagccgtaagggctacagtcgaaaagggtttgaccggcttagcactgagggcagtgaccaagagaaagaggatgatggaagtgaatcagaagaggagtattcagcacctctgcctgcgctcgcaccttcctcctcctga

SEQ ID NO: 21840 - DNA, 1449 bp, Homo sapiens
aggtttaaagaaactaccagaccattttccaatgaatgtcttggtaccaccagacccgtagttcctattgattcatcagattttgcattggatattcgcatgcctggggttacacctaaacagtccgatacatacttctgcatgtctatgcgaataccagtggatgaggaagccttcgtgattgacttcaagcctcgagccagcatggatactgtccatcacatgttactttttggatgcaatatgccttcatccactggaagttactggttttgtgatgaaggaacctgtacagataaagccaatattctgtatgcctgggcgagaaatgctccccctacccggctccccaaaggtgttggattcagagttggaggagagactggaagtaaatactttgtactacaggtacactatggggatattagtgcttttagagataataacaaggactgttctggtgtgtccttacacctcacacgtctgccacagcctttaattgctggcatgtaccttatgatgtctgttgacactgttatcccagcaggagaaaaagtggtgaattctgacatttcatgccattataaaaattatccaatgcatgtctttgcctatagagttcacactcaccatttaggtaaggtagtaagtggatacagagtaagaaatggacagtggacactgattggacggcagagccctcagctgccacaggctttctaccctgtggggcatccagttgatgtaagttttggtgacctactggctgcaagatgtgtattcactggtgaaggaaggacagaagccacacacattggtggcacgtctagtgatgaaatgtgcaacttatacattatgtattacatggaagccaagcatgcagtttctttcatgacctgtacccagaatgtagctccagatatgttcagaaccataccaccagaggccaacattccaattcccgtgaagtctgatatggttatgatgcatgaacatcataaagaaacagaatataaagataagattcctttactacagcagccaaaacgagaagaagaagaagtgttagaccagggtgatttctattcactactttccaagctgctaggagaaagggaagatgttgttcatgtgcacaaatataatcctacagaaaaggcagaatcagagtcagacctggtagctgagattgcaaatgtagtccaaaaaaaggatcttggtcgatctgatgccagagagggtgcagaacatgagaggggtaatgctattcttgtcagagacagaattcacaaattccacagactagtatctaccttgaggccaccagagagcagagttttctcattacagcagcccccacctggtgaaggcacctgggaaccagaacacacaggagctagaagagaagatatgaaatgtttccagtgcaaagaaatgataagtgttcaa

SEQ ID NO: 21841 - DNA, 5432 bp, Homo sapiens
gtgaaactactaatgtattaaagaacctcagctgggatttgctgaggacaaatgctgtaacgtgttagtcatccattatctgcttctatttttgcaggttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtttaaagaaactaccagaccattttccaatgaatgtcttggtaccaccagacccgtagttcctattgattcatcagattttgcattggatattcgcatgcctggggttacacctaaacagtccgatacatacttctgcatgtctatgcgaataccagtggatgaggaagccttcgtgattgacttcaagcctcgagccagcatggatactgtccatcacatgttactttttggatgcaatatgccttcatccactggaagttactggttttgtgatgaaggaacctgtacagataaagccaatattctgtatgcctgggcgagaaatgctccccctacccggctccccaaaggtgttggattcagagttggaggagagactggaagtaaatactttgtactacaggtacactatggggatattagtgcttttagagataataacaaggactgttctggtgtgtccttacacctcacacgtctgccacagcctttaattgctggcatgtaccttatgatgtctgttgacactgttatcccagcaggagaaaaagtggtgaattctgacatttcatgccattataaaaattatccaatgcatgtctttgcctatagagttcacactcaccatttaggtaaggtagtaagtggatacagagtaagaaatggacagtggacactgattggacggcagagccctcagctgccacaggctttctaccctgtggggcatccagttgatgtaagttttggtgacctactggctgcaagatgtgtattcactggtgaaggaaggacagaagccacacacattggtggcacgtctagtgatgaaatgtgcaacttatacattatgtattacatggaagccaagcatgcagtttctttcatgacctgtacccagaatgtagctccagatatgttcagaaccataccaccagaggccaacattccaattcccgtgaagtctgatatggttatgatgcatgaacatcataaagaaacagaatataaagataagattcctttactacagcagccaaaacgagaagaagaagaagtgttagaccagggtgatttctattcactactttccaagctgctaggagaaagggaagatgttgttcatgtgcacaaatataatcctacagaaaaggcagaatcagagtcagacctggtagctgagattgcaaatgtagtccaaaaaaaggatcttggtcgatctgatgccagagagggtgcagaacatgagaggggtaatgctattcttgtcagagacagaattcacaaattccacagactagtatctaccttgaggccaccagagagcagagttttctcattacagcagcccccacctggtgaaggcacctgggaaccagaacacacaggagatttccacatggaagaggcactggattggcctggagtatacttgttaccaggccaggtttctggggtggctctagaccctaagaataacctggtgattttccacagaggtgaccatgtctgggatggaaactcgtttgacagcaagtttgtttaccagcaaataggactcggaccaattgaagaagacactattcttgtcatagatccaaataatgctgcagtactccagtccagtggaaaaaatctgttttacttgccacatggcttgagtatagataaagatgggaattattgggtcacagacgtggctctccatcaggtgttcaaactggatccaaacaataaagaaggccctgtattaatcctgggaaggagcatgcaaccaggcagtgaccagaatcacttctgtcaacccactgatgtggctgtggatccaggcactggagccatttatgtatcagatggttactgcaacagcaggattgtgcagttttcaccaagtggaaagttcatcacacagtggggagaagagtcttcagggagcagtcctctgccaggccagttcactgttcctcacagcttggctcttgtgcctcttttgggccaattatgtgtggcagaccgggaaaatggtcggatccagtgttttaaaactgacaccaaagaatttgtgagagagattaagcattcatcatttggaagaaatgtatttgcaatttcatatataccaggcttgctctttgcagtgaatgggaagcctcattttggggaccaagaacctgtacaaggatttgtgatgaacttttccaatggggaaattatagacatcttcaagccagtgcgcaagcactttgatatgcctcatgatattgttgcatctgaagatgggactgtgtacattggagatgctcataccaacaccgtgtggaagttcaccttgactgagaaattggaacatcgatcagttaaaaaggctggcattgaggtccaggaaatcaaagaagccgaggcagttgttgaaaccaaaatggagaacaaacccacctcctcagaattgcagaagatgcaagagaaacagaaactgatcaaagagccaggctcgggagtgcctgttgttctcattacaacccttctggttattccggtggttgtcctgctggccattgccatatttattcggtggaaaaaatcaagggcctttggagattctgaacacaaactcgagacgagttcaggaagagtactgggaagatttagaggaaagggaagtggaggcttaaaccttggtaatttctttgcaagccgtaagggctacagtcgaaaagggtttgaccggcttagcactgagggcagtgaccaagagaaagaggatgatggaagtgaatcagaagaggagtattcagcacctctgcctgcgctcgcaccttcctcctcctgaaaaccaagctttgatttagattgagtaagatttacccagaatgtcagattcctttccctttagcacgtttaaagttctgtgtatttaattgtaaactgtactagtctgtgtgggactgtacacactttatttacttcgttttggttaagttggcttctgtttctagttgaggagtttcctaaaagttcataacagtgccattgtctttatatgaacatagactagagaaaccgtcctctttttccatcataattctaatctaacaatggaagatttgcccatttacacttttgagactttttggtggatgtaaataaccccattctttgcttgaacacagtattttcccaatagcactttcattgccagtgtctttctttggtgcctttcctgttcagcattcttagcctgtggcagtaaagagaaactttgtgctacatgacgacaaagctgctaaatctcctatttttttaaaatcactaacattatattgcaatgaaggaaataaaaaagtctctatttaaattcttttttaaattttcttcagttggtgtgtttttgggatgtcttatttttagatggttacactgttagaacactattttcagaatctgaatgtaatttgtgtaataaagtgttttcagagcattagctgtcagtgtattttccagtttttgcgtatttgcagattttacatacaacttttataataattacacaaacccacaaatattagtgaaacttactcgatgtcttcaactaaaagaaatgtgtgtattgtacaaaatttagaagatactttagccaatataaattaaaaaccagcctgagtttacataaatttgtaaagtcaggctcttctaaaatccaaagagggtttttgcctatatatcaatcagaggataaatactttaataaaaggtaatcacagctaagtggatacctgtgtctcaaattacatatgcaaatgatccatcagtagggatcactaataatagttttccttttaaaaaataatttcagggcaggtacagtggctcaagcctatacttccaggactttgggaggccaagcagaaggattgtgggaggccaagcagaaggattgtttgagcccagaaattcaaggctgcagtgagctatgatcaatccactgtactccagcctaggctacagagtgagatcctttctctaaaataaaatacaatttccatgtatccataggaatatattcatcttttacagtgattgcagattagttttaaaacgtctttttcgtaattcgtcaatgcaagttagtaagaaccagataattttccattttaaaatgataggaatctaaaactctttttcaaaaatgccaacctgtttttccggcatcatagtagttggaataatacagatataattgactaatcataaagtacatgagagtacagaagggaaatttggaaacggtaagtctgctagggcattacaatcctgtcctagcactccacctttattctgccaacctgggttaattaaagatggtagcctggaaagtaatgaatgacattgacttcaggcaatctttccactgattattcttggctgaacttcatttatcgagtcagagaatgcactgcctgagaaatgtcccagaggagtgaatcctaggcctggccacagtagaatcgcctggagaatttaagaaaaaaattgttgggcactcactctttccagtgatctttatttagttggcttacaatggaatacaggtatggttcatgtttttaaatttgtccaggtgtttctattgtgcagtcacagttgaaaaccattgtcttcgagaatagctattctatcttgccagttacaataagtggatagctatattttcacataaattatagtttacagatgtttggagggggaagacaggatctgaggtgttttgatatgactgttagcaccaaaatctgaatgccttaattgttgaatgtgttaaattggataattaaaatgggcataaatgacttattaaaaaagcaaagggaaa

SEQ ID NO: 21842 - DNA, 2898 bp, Homo sapiens
ggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtttaaagaaactaccagaccattttccaatgaatgtcttggtaccaccagacccgtagttcctattgattcatcagattttgcattggatattcgcatgcctggggttacacctaaacagtccgatacatacttctgcatgtctatgcgaataccagtggatgaggaagccttcgtgattgacttcaagcctcgagccagcatggatactgtccatcacatgttactttttggatgcaatatgccttcatccactggaagttactggttttgtgatgaaggaacctgtacagataaagccaatattctgtatgcctgggcgagaaatgctccccctacccggctccccaaaggtgttggattcagagttggaggagagactggaagtaaatactttgtactacaggtacactatggggatattagtgcttttagagataataacaaggactgttctggtgtgtccttacacctcacacgtctgccacagcctttaattgctggcatgtaccttatgatgtctgttgacactgttatcccagcaggagaaaaagtggtgaattctgacatttcatgccattataaaaattatccaatgcatgtctttgcctatagagttcacactcaccatttaggtaaggtagtaagtggatacagagtaagaaatggacagtggacactgattggacggcagagccctcagctgccacaggctttctaccctgtggggcatccagttgatgtaagttttggtgacctactggctgcaagatgtgtattcactggtgaaggaaggacagaagccacacacattggtggcacgtctagtgatgaaatgtgcaacttatacattatgtattacatggaagccaagcatgcagtttctttcatgacctgtacccagaatgtagctccagatatgttcagaaccataccaccagaggccaacattccaattcccgtgaagtctgatatggttatgatgcatgaacatcataaagaaacagaatataaagataagattcctttactacagcagccaaaacgagaagaagaagaagtgttagaccagggtgatttctattcactactttccaagctgctaggagaaagggaagatgttgttcatgtgcacaaatataatcctacagaaaaggcagaatcagagtcagacctggtagctgagattgcaaatgtagtccaaaaaaaggatcttggtcgatctgatgccagagagggtgcagaacatgagaggggtaatgctattcttgtcagagacagaattcacaaattccacagactagtatctaccttgaggccaccagagagcagagttttctcattacagcagcccccacctggtgaaggcacctgggaaccagaacacacaggagatttccacatggaagaggcactggattggcctggagtatacttgttaccaggccaggtttctggggtggctctagaccctaagaataacctggtgattttccacagaggtgaccatgtctgggatggaaactcgtttgacagcaagtttgtttaccagcaaataggactcggaccaattgaagaagacactattcttgtcatagatccaaataatgctgcagtactccagtccagtggaaaaaatctgttttacttgccacatggcttgagtatagataaagatgggaattattgggtcacagacgtggctctccatcaggtgttcaaactggatccaaacaataaagaaggccctgtattaatcctgggaaggagcatgcaaccaggcagtgaccagaatcacttctgtcaacccactgatgtggctgtggatccaggcactggagccatttatgtatcagatggttactgcaacagcaggattgtgcagttttcaccaagtggaaagttcatcacacagtggggagaagagtcttcagggagcagtcctctgccaggccagttcactgttcctcacagcttggctcttgtgcctcttttgggccaattatgtgtggcagaccgggaaaatggtcggatccagtgttttaaaactgacaccaaagaatttgtgagagagattaagcattcatcatttggaagaaatgtatttgcaatttcatatataccaggcttgctctttgcagtgaatgggaagcctcattttggggaccaagaacctgtacaaggatttgtgatgaacttttccaatggggaaattatagacatcttcaagccagtgcgcaagcactttgatatgcctcatgatattgttgcatctgaagatgggactgtgtacattggagatgctcataccaacaccgtgtggaagttcaccttgactgagaaattggaacatcgatcagttaaaaaggctggcattgaggtccaggaaatcaaagattctgaacacaaactcgagacgagttcaggaagagtactgggaagatttagaggaaagggaagtggaggcttaaaccttggtaatttctttgcaagccgtaagggctacagtcgaaaagggtttgaccggcttagcactgagggcagtgaccaagagaaagaggatgatggaagtgaatcagaagaggagtattcagcacctctgcctgcgctcgcaccttcctcctcctgaaaaccaagctttgatttagattgagtaagatttacccagaatgtcagattcctttccctttagcacgtttaaagttctgtgtatttaattgtaaactgta

SEQ ID NO: 21843 - DNA, 570 bp, Homo sapiens
gctaccacaccagattctgaaggggaggagttgtctggaaagaccagagctgggtgctggggatctggagcagctcgggacccgcgctgcagggagctgggatgggagaggttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaag

SEQ ID NO: 21844 - DNA, 616 bp, Homo sapiens
gatgcatgtatataagcatgcctttgttctcaaaagtctttttctatctgattactgtggtatccagtgctttgtctttgcctctcttcgttttttgttttgtttttttccttgcgccttagccggtcatttgtgtgatgtttacattcagcagagaggttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtcttta

SEQ ID NO: 21845 - DNA, 564 bp, Homo sapiens
atttttggtgagagaaaggagtgatagaggaagttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtttaaagaaactaccagaccattttccaatgaatgtcttggtaccaccagacccgtagttcctattgat

SEQ ID NO: 21846 - DNA, 528 bp, Homo sapiens
aattctgtgatgatccttgggagctcttggttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtttaaagaaactaccagaccattttccaatgaatgt

SEQ ID NO: 21847 - DNA, 609 bp, Homo sapiens
acttatcatgaagaatctcacttcatttaaggttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtttaaagaaactaccagaccattttccaatgaatgtcttggtaccaccagacccgtagttcctattgattcatcagattttgcattggatattcgcatgcctggggttacaccta

SEQ ID NO: 21848 - DNA, 575 bp, Homo sapiens
gcgcaggttggtgttgttgccgctgctgccgccactgcgaggcggtcagggcaagggtgagggtgggggcgcggaagggggcctgggctcgggatcctgctgccaccaattcctggtgccccaggaggttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactt

SEQ ID NO: 21849 - DNA, 1739 bp, Homo sapiens
cggtatcgccacttggagaccaccgcgaatgaagtttgcattttcctctgttcttgagcccagcttcttctcgtctcccaccccagcttcccggcattggaagaagggaccgtcctcttccttgtcttggccacccaaatcctggtatcgaaagggttgaacggaccggaagtgtgcagcagcgacgggtccccagctaatcgacgccggaagtagcaattactagacaagcattccgccgccggcttcgctatggcggcaattcccccagattcctggcagccacccaacgtttacttggagaccagcatgggaatcattgtgctggagctgtactggaagcatgctccaaagacctgtaagaactttgctgagttggctcgtcgaggttactacaatggcacaaaattccacagaattatcaaagacttcatgatccaaggaggtgacccaacagggacaggtcgaggtggtgcatctatctatggcaaacagtttgaagatgaacttcatccagacttgaaattcacgggggctggaattctcgcaatggccaatgcggggccagataccaatggcagccagttctttgtgaccctcgcccccacccagtggcttgacggcaaacacaccatttttggccgagtgtgtcagggcataggaatggtgaatcgcgtgggaatggtagaaacaaactcccaggaccgccctgtggacgacgtgaagatcattaaggcatacccttctgggtagacttgctaccctcttgagcagctcttctgagatggccccagtgaaccagcttctagatgacatagaatgacatgtaatgctaaattcattttggctttgcaagtcatgaagcttaggaggcctggcatcttgggtgagttagagatggaagtacattttaataggatgcttcttttctcttcccccagtgcctaggttgccagagcatttgcacaaatgcccctgtttatcaataggtgactacttactacacatgaaccataatgctgcttcttgtgcatgtctgctctgatatacgtcgaacaatgtagcagccactgtcatttctcagtggttttgcctaaccaaacttcttcctaaggagatttatattctggcctacacagcagtccttgatggctgacagccacagaattccaaaccaagtagtgtctgtcagccctcttaactctgtgcacgccctatttcagtcttttacatttgttcttctagggaatgtatgcatctctatatatattttccctctcaaaaccagaacatcaacagtgctgtttctgacacttcagacatcccacgcaaagccacattgaatttttgccaaatgaaaaacacatccaacaatcaagtttctaagaaggtgtcaagtggggaataataataatgtataataatcaagaaattagtttattaaaaggaagcagaagcattgaccattttttcccagagaagaggagaaatctgtagtgagcaaaggacagaccatgaatcctccttgagaagtagtactctcagaaaggagaagcgccactcaagttcttttaacccaagactttagagaaattaggtccaagatttttatatgttcagttgtttatgtataaaaataactttctggattttgtggggaggagcaggagaggaaggaagttaatacctatgtaatacatagaaacttccacaataaaatgccattgatggttgaaatt

SEQ ID NO: 21850 - DNA, 2817 bp, Homo sapiens
ggaagtggtcacggaactcggctgcggctccatggtctgagttgtcagccgttgttttttcgtgctcgctagtcgccgccgccgctccgccatggggaagcgacagcaccaaaaggacaaaatgtacattacctgtgctgaatacactcacttttatggtggcaagaagccagatctcccacaaacaaattttcgtcgtttaccttttgaccactgcagtctctctctgcagccctttgtctacccagtctgcactcccgatggcatcgtctttgacttactgaacattgttccatggcttaagaagtacgggaccaaccccagcaatggagagaagctggacgggaggtccctgatcaagctgaacttttccaagaacagtgaggggaagtaccactgcccagtgctgtttaccgtgttcaccaacaacacccacatcgtggctgtgaggacgaccggcaacgtctacgcctatgaggcagtggaacagctaaatatcaaggccaagaacttccgggacctgctgaccgacgagcccttctcccggcaggacatcatcaccctccaggaccccaccaatttggacaagttcaatgtctctaacttctatcatgtgaagaataacatgaaaataatagacccagatgaagagaaggccaaacaggacccgtcttattatctgaaaaatacaaatgccgagacccgagagaccctgcaggagctctacaaggagttcaaaggggacgagattctggcagccaccatgaaggccccggagaagaagaaagtggacaagctgaacgctgcccactattccacagggaaggtcagcgcttccttcacctccaccgcgatggtcccggagaccacacatgaagcagctgccatcgacgaggatgtgctgcgctaccagtttgtgaagaagaagggctacgtgcggctgcacaccaacaagggcgacctcaacctggagctgcactgcgacctgacaccaaaaacctgcgaaaacttcatcaggctttgcaagaagcattattacgatggcaccatcttccacagatccatccggaactttgtgatccaagggggcgaccccacaggcacaggcacgggtggggagtcatactgggggaagcccttcaaagacgagttccggcccaacctctcgcacacgggccgcggcatcctcagcatggccaactccgggcccaacagcaacaggtctcaattcttcatcacgtttcgctcctgtgcctacctggacaagaagcataccatctttggacgggttgttgggggctttgacgtactgacagccatggagaatgtggagagtgaccccaaaactgaccgccctaaggaggagatccgcattgatgccactacagtgttcgtggacccctatgaggaggccgatgcccagattgcgcaggagcggaagacacagctcaaggtagccccggagaccaaagtgaagagcagccagccccaggcagggagccagggcccccagaccttccgccagggcgtgggcaagtacatcaacccagcagccacgaagcgagcagcagaggaagagccctcaaccagtgccactgtccccatgtccaagaagaagcccagtcggggttttggggacttcagctcctggtagcagcagcaacttgcaggctgtacctctgcccttccttttctcatcaatcactgatgctgaagctgcaggcctgagccctttgtctccctggatgctgggtggcgcctcatctgcatctctgcctcaccccatccactgccacaggctgcctgatgaccactagaggtatgtctgcccctcgtcaccctgctgcacaccaatctgtggcccttcatcatgctaagaacaagaactgcgccatggctggctccttctcttctccagcccatccctctgcagcctgtcatccctgtctgtgaccattggtcgggcccctgggctctagagtgacttttgacgccctccatccctcccgccaggcactgtcctccgcaaggcctggtgcagccctggcagtaactggcttgtaagaggctcagacaccaagctgggcctgcagaggaggggcacagtaggacacagtgactgcccaggtgtccacacacctgtaggcctctgagccagcgtccagggtacaggtgcgggtggtggggatgaaggcctgaccagggagggagaagcaggtttggagaggaccctgtgcccaccctgacagacaccctggctggccctgactgactgtattctctggccacattcaagtcccccattggtgggggcagagaagtaggaccaggccatccttggctccagagctcgaagaccccaagacagccctctgctctcagcggcgccacagagagcctgggctcagccttctgcatcaggacatggcctcgtccactgagggcacgatttaaacatttgacatcagaagctttatttgtaaacctcacacagataaggaccaagggctggcggtgtggccagaggacaggggaagctgaaggccccgtgcttgagctcggcagtcctgctccttgcagtgaagccaccatgggtgaccgtccagcctcacccggtggcctgcacagtgagggaagggcttcagggccatctgctcccagggcaggggacaggccaccaaggacctttggcaaatgaaggtttacatttctgtagtttgtttgttttagagcttaatttgtagttttttagctattaaaaccatttgaatttttaacgacctgatgagggcatcaggtaaattaaaggattttggg

SEQ ID NO: 21851 - DNA, 2574 bp, Homo sapiens
gaactcggctgcggctccatggtctgagttgtcagccgttgttttttcgtgctcgctagtcgccgccgccgctccgccatggggaagcgacagcaccaaaaggacaaaatgtacattacctgtgctgaatacactcacttttatggtggcaagaagccagatctcccacaaacaaattttcgtcgtttaccttttgaccactgcagtctctctctgcagccctttgtctacccagtctgcactcccgatggcatcgtctttgacttactgaacattgttccatggcttaagaagtacgggaccaaccccagcaatggagagaagctggacgggaggtccctgatcaagctgaacttttccaagaacagtgaggggaagtaccactgcccagtgctgtttaccgtgttcaccaacaacacccacatcgtggctgtgaggacgaccggcaacgtctacgcctatgaggcagtggaacagctaaatatcaaggccaagaacttccgggacctgctgaccgacgagcccttctcccggcaggacatcatcaccctccaggaccccaccaatttggacaagttcaatgtctctaacttctatcatgtgaagaataacatgaaaataatagacccagatgaagagaaggccaaacaggacccgtcttattatctgaaaaatacaaatgccgagacccgagagaccctgcaggagctctacaaggagttcaaaggggacgagattctggcagccaccatgaaggccccggagaagaagaaagtggacaagctgaacgctgcccactattccacagggaaggtcagcgcttccttcacctccaccgcgatggtcccggagaccacacatgaagcagctgccatcgacgaggatgtgctgcgctaccagtttgtgaagaagaagggctacgtgcggctgcacaccaacaagggcgacctcaacctggagctgcactgcgacctgacaccaaaaacctgcgaaaacttcatcaggctttgcaagaagcattattacgatggcaccatcttccacagatccatccggaactttgtgatccaagggggcgaccccacaggcacaggcacgggtggggagtcatactgggggaagcccttcaaagacgagttccggcccaacctctcgcacacgggccgcggcatcctcagcatggccaactccgggcccaacagcaacaggtctcaattcttcatcacgtttcgctcctgtgcctacctggacaagaagcataccatctttggacgggttgttgggggctttgacgtactgacagccatggagaatgtggagagtgaccccaaaactgaccgccctaaggaggagatccgcattgatgccactacagtgttcgtggacccctatgaggaggccgatgcccagattgcgcaggagcggaagacacagctcaaggtagccccggagaccaaagtgaagagcagccagccccaggcagggagccagggcccccagaccttccgccagggcgtgggcaagtacatcaacccagcagccacgaagcgagcagcagaggaagagccctcaaccagtgccactgtccccatgtccaagaagaagcccagtcggggttttggggacttcagctcctggtagcagcaggttggccgctgtggaccttggtggggttgcagggctgggggcccatgtccacatctccatttccagcctttctagcctgccctctgctgccagccaataaattgcttgcctgctgcctgcatcccctttcctggcccctgggagcccacagccttcccatcccttaacctgttgccaagggccttggccctgtttccaggacctggcccagccagagcccactgctgggaccttcaagcacaaggcctgccctacacccaggctggtgcctcaggcctcccctctagtaggcaggccaggttagtgaggaaggactgtgtctccagattgtggtttcctctttaagacagggtcttgctctgttgcccaggctccagtgcagtggtgtgatcatggctcactgcagcctcgacctcctgggctcaagcaatcctcctgcctcagcctcgcaagtagctgggactacagccgtgcaccactacatccagctgtatatgtctggttttcttacccctacttctgtcatcttctcagggacagcctatttatacaaccagtgtggtcccctgaccaacgccattacctgggacaagttttcagaccccagacttactgagcctaagcctctgcagggtgggcttctcggtctgttttgacaaaacttcaggggcttctgaaggctggtgttggacggcagcattgagtttcctgccgtgccctgcctgagctctcagggccctgctcacctgctctggctgtgaaccacctgggcttcatctcaagcctgcctggcgtctctgtgcccctgtgagaatcttgaggggacccacactgggttgaggccagtgtctcctgctgtgagaacaagtggatgtccctctccccgccctcctgctgaagtggccttgctgctctcaggcccggcca

SEQ ID NO: 21852 - DNA, 3875 bp, Homo sapiens
atggtctgagttgtcagccgttgttttttcgtgctcgctagtcgccgccgccgctccgccatggggaagcgacagcaccaaaaggacaaaatgtacattacctgtgctgaatacactcacttttatggtggcaagaagccagatctcccacaaacaaattttcgtcgtttaccttttgaccactgcagtctctctctgcagccctttgtctacccagtctgcactcccgatggcatcgtctttgacttactgaacattgttccatggcttaagaagtacgggaccaaccccagcaatggagagaagctggacgggaggtccctgatcaagctgaacttttccaagaacagtgaggggaagtaccactgcccagtgctgtttaccgtgttcaccaacaacacccacatcgtggctgtgaggacgaccggcaacgtctacgcctatgaggcagtggaacagctaaatatcaaggccaagaacttccgggacctgctgaccgacgagcccttctcccggcaggacatcatcaccctccaggaccccaccaatttggacaagttcaatgtctctaacttctatcatgtgaagaataacatgaaaataatagacccagatgaagagaaggccaaacaggacccgtcttattatctgaaaaatacaaatgccgagacccgagagaccctgcaggagctctacaaggagttcaaaggggacgagattctggcagccaccatgaaggccccggagaagaagaaagtggacaagctgaacgctgcccactattccacagggaaggtcagcgcttccttcacctccaccgcgatggtcccggagaccacacatgaagcagctgccatcgacgaggatgtgctgcgctaccagtttgtgaagaagaagggctacgtgcggctgcacaccaacaagggcgacctcaacctggagctgcactgcgacctgacaccaaaaacctgcgaaaacttcatcaggctttgcaagaagcattattacgatggcaccatcttccacagatccatccggaactttgtgatccaagggggcgaccccacaggcacaggcacgggtggggagtcatactgggggaagcccttcaaagacgagttccggcccaacctctcgcacacgggccgcggcatcctcagcatggccaactccgggcccaacagcaacaggtctcaattcttcatcacgtttcgctcctgtgcctacctggacaagaagcataccatctttggacgggttgttgggggctttgacgtactgacagccatggagaatgtggagagtgaccccaaaactgaccgccctaaggaggagatccgcattgatgccactacagtgttcgtggacccctatgaggaggccgatgcccagattgcgcaggagcggaagacacagctcaaggtagccccggagaccaaagtgaagagcagccagccccaggcagggagccagggcccccagaccttccgccagggcgtgggcaagtacatcaacccagcagccacgaagcgagcagcagaggaagagccctcaaccagtgccactgtccccatgtccaagaagaagcccagtcggggttttggggacttcagctcctggtagcagcagggacagcctatttatacaaccagtgtggtcccctgaccaacgccattacctgggacaagttttcagaccccagacttactgagcctaagcctctgcagggtgggcttctcggtctgttttgacaaaacttcaggggcttctgaaggctggtgttggacggcagcattgagtttcctgccgtgccctgcctgagctctcagggccctgctcacctgctctggctgtgaaccacctgggcttcatctcaagcctgcctggcgtctctgtgcccctgtgagaatcttgaggggacccacactgggttgaggccagtgtctcctgctgtgagaacaagtggatgtccctctccccgccctcctgctgaagtggccttgctgctctcaggcccggccactgggctccaagactctgctcctcctgtcagtcactgactctgatggccttgggccagctgcatcagcagcccttaaagaaagacccctccctcaacccccatttttctgttaaatgtgcccctggctggctttttcttcgtcttcagcccaggccagtggtcagtgttctcatgtcatggactctccttgcctgacacttgcctcttgggctccctgttgccctcaggccaccccccacttctagttcttcacactaagccctaacttaggccttgttcttggttttctcatttttgttgccccaaatcttgaacctgtcagcaacttgcaggctgtacctctgcccttccttttctcatcaatcactgatgctgaagctgcaggcctgagccctttgtctccctggatgctgggtggcgcctcatctgcatctctgcctcaccccatccactgccacaggctgcctgatgaccactagaggtatgtctgcccctcgtcaccctgctgcacaccaatctgtggcccttcatcatgctaagaacaagaactgcgccatggctggctccttctcttctccagcccatccctctgcagcctgtcatccctgtctgtgaccattggtcgggcccctgggctctagagtgacttttgacgccctccatccctcccgccaggcactgtcctccgcaaggcctggtgcagccctggcagtaactggcttgtaagaggctcagacaccaagctgggcctgcagaggaggggcacagtaggacacagtgactgcccaggtgtccacacacctgtaggcctctgagccagcgtccagggtacaggtgcgggtggtggggatgaaggcctgaccagggagggagaagcaggtttggagaggaccctgtgcccaccctgacagacaccctggctggccctgactgactgtattctctggccacattcaagtcccccattggtgggggcagagaagtaggaccaggccatccttggctccagagctcgaagaccccaagacagccctctgctctcagcggcgccacagagagcctgggctcagccttctgcatcaggacatggcctcgtccactgagggcacgatttaaacatttgacatcagaagctttatttgtaaacctcacacagataaggaccaagggctggcggtgtggccagaggacaggggaagctgaaggccccgtgcttgagctcggcagtcctgctccttgcagtgaagccaccatgggtgaccgtccagcctcacccggtggcctgcacagtgagggaagggcttcagggccatctgctcccagggcaggggacaggccaccaaggacctttggcaaatgaaggtttacatttctgtagtttgtttgttttagagcttaatttgtagttttttagctattaaaaccatttgaatttttaacgacctgatgagggcatcaggtaaattaaaggattttgggaagattcttattttcaattctaatatctgacagatgccatcaagaataagcattaaggtataaaaaatactgtgtgtataaaacaatgccaaaccacattcctacagcaaatgcactgtgccatttataaccctgacatcacctcccaaggctctcaaggaagatttattttaaataacttaaatagaagtcctagatgatattgtttaggaatttaagagggtggtggatatggtcctgtgaatagcacttcccctgaagccagctcatggtctgttcatttggtttaaaaatgagcttgtattttgcagaagcccaacaaaaaaaaagtgataaaagtgttgttggtataaattacaaaaaaaaaaaaaaa

SEQ ID NO: 21853 - DNA, 2709 bp, Homo sapiens
gtttccggggcgcgccgcggaacccggaagtggtcacggaactcggctgcggctccatggtctgagttgtcagccgttgttttttcgtgctcgctagtcgccgccgccgctccgccatggggaagcgacagcaccaaaaggacaaaatgtacattacctgtgctgaatacactcacttttatggtggcaagaagccagatctcccacaaacaaattttcgtcgtttaccttttgaccactgcagtctctctctgcagccctttgtctacccagtctgcactcccgatggcatcgtctttgacttactgaacattgttccatggcttaagaagtacgggaccaaccccagcaatggagagaagctggacgggaggtccctgatcaagctgaacttttccaagaacagtgaggggaagtaccactgcccagtgctgtttaccgtgttcaccaacaacacccacatcgtggctgtgaggacgaccggcaacgtctacgcctatgaggcagtggaacagctaaatatcaaggccaagaacttccgggacctgctgaccgacgagcccttctcccggcaggacatcatcaccctccaggaccccaccaatttggacaagttcaatgtctctaacttctatcatgtgaagaataacatgaaaataatagacccagatgaagagaaggccaaacaggacccgtcttattatctgaaaaatacaaatgccgagacccgagagaccctgcaggagctctacaaggagttcaaaggggacgagattctggcagccaccatgaaggccccggagaagaagaaagtggacaagctgaacgctgcccactattccacagggaaggtcagcgcttccttcacctccaccgcgatggtcccggagaccacacatgaagcagctgccatcgacgaggatgtgctgcgctaccagtttgtgaagaagaagggctacgtgcggctgcacaccaacaagggcgacctcaacctggagctgcactgcgacctgacaccaaaaacctgcgaaaacttcatcaggctttgcaagaagcattattacgatggcaccatcttccacagatccatccggaactttgtgatccaagggggcgaccccacaggcacaggcacgggtggggagtcatactgggggaagcccttcaaagacgagttccggcccaacctctcgcacacgggccgcggcatcctcagcatggccaactccgggcccaacagcaacaggtctcaattcttcatcacgtttcgctcctgtgcctacctggacaagaagcataccatctttggacgggttgttgggggctttgacgtactgacagccatggagaatgtggagagtgaccccaaaactgaccgccctaaggaggagatccgcattgatgccactacagtgttcgtggacccctatgaggaggccgatgcccagattgcgcaggagcggaagacacagctcaaggtagccccggagaccaaagtgaagagcagccagccccaggcagggagccagggcccccagaccttccgccagggcgtgggcaagtacatcaacccagcagccaccgagcagcagaggaagagccctcaaccagtgccactgtccccatgtccaagaagaagcccagtcggggttttggggacttcagctcctggtagcagcaggctgcctgatgaccactagaggtatgtctgcccctcgtcaccctgctgcacaccaatctgtggcccttcatcatgctaagaacaagaactgcgccatggctggctccttctcttctccagcccatccctctgcagcctgtcatccctgtctgtgaccattggtcgggcccctgggctctagagtgacttttgacgccctccatccctcccgccaggcactgtcctccgcaaggcctggtgcagccctggcagtaactggcttgtaagaggctcagacaccaagctgggcctgcagaggaggggcacagtaggacacagtgactgcccaggtgtccacacacctgtaggcctctgagccagcgtccagggtacaggtgcgggtggtggggatgaaggcctgaccagggagggagaagcaggtttggagaggaccctgtgcccaccctgacagacaccctggctggccctgactgactgtattctctggccacattcaagtcccccattggtgggggcagagaagtaggaccaggccatccttggctccagagctcgaagaccccaagacagccctctgctctcagcggcgccacagagagcctgggctcagccttctgcatcaggacatggcctcgtccactgagggcacgatttaaacatttgacatcagaagctttatttgtaaacctcacacagataaggaccaagggctggcggtgtggccagaggacaggggaagctgaaggccccgtgcttgagctcggcagtcctgctccttgcagtgaagccaccatgggtgaccgtccagcctcacccggtggcctgcacagtgagggaagggcttcagggccatctgctcccagggcaggggacaggccaccaaggacctttggcaaatgaaggtttacatttctgtagtttgtttgttttagagcttaatttgtagttttttagctattaaaaccatttgaatttttaacgacctgatgagggcatcaggtaaattaaaggattttgggaagattctt

SEQ ID NO: 21854 - DNA, 1870 bp, Homo sapiens
cgtgctcgctagtcgccgccgccgctccgccatggggaagcgacagcaccaaaaggacaaaatgtacattacctgtgctgaatacactcacttttatggtggcaagaagccagatctcccacaaacaaattttcgtcgtttaccttttgaccactgcaggaacattgttccatggcttaagaagtacgggaccaaccccagcaatggagagaagctggacgggaggtccctgatcaagctgaacttttccaagaacagtgaggggaagtaccactgcccagtgctgtttaccgtgttcaccaacaacacccacatcgtggctgtgaggacgaccggcaacgtctacgcctatgaggcagtggaacagctaaatatcaaggccaagaacttccgggacctgctgaccgacgagcccttctcccggcaggacatcatcaccctccaggaccccaccaatttggacaagttcaatgtctctaacttctatcatgtgaagaataacatgaaaataatagacccagatgaagagaaggccaaacaggacccgtcttattatctgaaaaatacaaatgccgagacccgagagaccctgcaggagctctacaaggagttcaaaggggacgagattctggcagccaccatgaaggccccggagaagaagaaagtggacaagctgaacgctgcccactattccacagggaaggtcagcgcttccttcacctccaccgcgatggtcccggagaccacacatgaagcagctgccatcgacgaggatgtgctgcgctaccagtttgtgaagaagaagggctacgtgcggctgcacaccaacaagggcgacctcaacctggagctgcactgcgacctgacaccaaaaacctgcgaaaacttcatcaggctttgcaagaagcattattacgatggcaccatcttccacagatccatccggaactttgtgatccaagggggcgaccccacaggcacaggcacgggtggggagtcatactgggggaagcccttcaaagacgagttccggcccaacctctcgcacacgggccgcggcatcctcagcatggccaactccgggcccaacagcaacaggtctcaattcttcatcacgtttcgctcctgtgcctacctggacaagaagcataccatctttggacgggttgttgggggctttgacgtactgacagccatggagaatgtggagagtgaccccaaaactgaccgccctaaggaggagatccgcattgatgccactacagtgttcgtggacccctatgaggaggccgatgcccagattgcgcaggagcggaagacacagctcaaggaagcgagcagcagaggaagagccctcaaccagtgccactgtccccatgtccaagaagaagcccagtcggggttttggggacttcagctcctggtagcagcagcaacttgcaggctgtacctctgcccttccttttctcatcaatcactgatgctgaagctgcaggcctgagccctttgtctccctggatgctgggtggcgcctcatctgcatctctgcctcaccccatccactgccacaggctgcctgatgaccactagaggtatgtctgcccctcgtcaccctgctgcacaccaatctgtggcccttcatcatgctaagaacaagaactgcgccatggctggctccttctcttctccagcccatccctctgcagcctgtcatccctgtctgtgaccattggtcgggcccctgggctctagagtgacttttgacgccctccatccctcccgccaggcactgtcctccgcaaggcctggtgcagccctggcagtaactggcttgtaagaggctcagacaccaagctgggcctgcagagga

SEQ ID NO: 21855 - DNA, 1841 bp, Homo sapiens
gaactcggctgcggctccatggtctgagttgtcagccgttgttttttcgtgctcgctagtcgccgccgccgctccgccatggggaagcgacagcaccaaaaggacaaaatgtacattacctgtgctgaatacactcacttttatggtggcaagaagccagatctcccacaaacaaattttcgtcgtttaccttttgaccactgcagtctctctctgcagccctttgtctacccagtctgcactcccgatggcatcgtctttgacttactgaacattgttccatggcttaagaagtacgggaccaaccccagcaatggagagaagctggacgggaggtccctgatcaagctgaacttttccaagaacagtgaggggaagtaccactgcccagtgctgtttaccgtgttcaccaacaacacccacatcgtggctgtgaggacgaccggcaacgtctacgcctatgaggcagtggaacagctaaatatcaaggccaagaacttccgggacctgctgaccgacgagcccttctcccggcaggacatcatcaccctccaggaccccaccaatttggacaagttcaatgtctctaacttctatcatgtgaagaataacatgaaaataatagacccagatgaagagaaggccaaacaggacccgtcttattatctgaaaaatacaaatgccgagacccgagagaccctgcaggagctctacaaggagttcaaaggggacgagattctggcagccaccatgaaggccccggagaagaagaaagtggacaagctgaacgctgcccactattccacagggaaggtcagcgcttccttcacctccaccgcgatggtcccggagaccacacatgaagcagctgccatcgacgaggatgtgctgcgctaccagtttgtgaagaagaagggctacgtgcggctgcacaccaacaagggcgacctcaacctggagctgcactgcgacctgacaccaaaaacctgcgaaaacttcatcaggctttgcaagaagcattattacgatggcaccatcttccacagatccatccggaactttgtgatccaagggggcgaccccacaggcacaggcacgggtggggagtcatactgggggaagcccttcaaagacgagttccggcccaacctctcgcacacgggccgcggcatcctcagcatggccaactccgggcccaacagcaacaggtctcaattcttcatcacgtttcgctcctgtgcctacctggacaagaagcataccatctttggacgggttgttgggggctttgacgtactgacagccatggagaatgtggagagtgaccccaaaactgaccgccctaaggaggagatccgcattgatgccactacagtgttcgtggacccctatgaggaggccgatgcccagattgcgcaggagcggaagacacagctcaaggtagccccggagaccaaagtgaagagcagccagccccaggcagggagccagggcccccagaccttccgccagggcgtgggcaagtacatcaacccagcagccacgaagcgagcagcagaggaagagccctcaaccagtgccactgtccccatgtccaagaagaagcccagtcggggttttggggacttcagctcctggtagcagcaggctccagtgcagtggtgtgatcatggctcactgcagcctcgacctcctgggctcaagcaatcctcctgcctcagcctcgcaagtagctgggactacagccgtgcaccactacatccagctgtatatgtctggttttcttacccctacttctgtcatcttctcagggacagcctatttatacaaccagtgtggtc

SEQ ID NO: 21856 - DNA, 2232 bp, Homo sapiens
cccggggtttgtagcggaggaggagcgggcgccatggcggttctactggagaccactttaggcgacgtcgtcatcgacttgtacaccgaagaacggccgcgtgcctgcttgaatttcttgaaactgtgcaaaataaaatattacaattattgccttattcacaatgtacagagggattttatcatacaaactggcgatcctacagggactggccgtggaggagagtctatctttggccaactgtatggtgatcaagcaagcttttttgaggcagaaaaagtcccaagaattaagcacaagaagaaaggcacagtgtccatggtgaataatggcagtgatcaacatggatctcagtttcttatcaccacaggagaaaatctagattatcttgatggtgtccatacggtgtttggtgaggtgacagaaggcatggacataattaagaaaattaatgagacctttgttgacaaggactttgtaccatatcaggatatcaggataaatcatacggtgattttagatgatccatttgatgaccctcctgatttattaatccctgatcgatcaccagaacctacaagggaacaattagatagtggtcgaataggagcagatgaagaaattgatgatttcaaaggaagatcagctgaggaagtagaagaaataaaggcagaaaaagaggctaaaactcaggctatacttttggagatggtgggagacctacctgatgcagatattaaacctccagaaaatgtactgtttgtgtgtaaattgaacccagtgaccacagatgaggatctggaaataatattctctagatttgggccaataagaagttgtgaagttatccgagactggaagacaggagagtccctctgttacgcttttattgaatttgaaaaggaagaagattgtgagaaagcattcttcaaaatggacaatgtgcttatagatgacagaagaatacatgtggattttagccagtcggttgcaaaggttaaatggaaaggaaaaggtgggaaatacaccaagagtgatttcaaggagtatgaaaaagaacaggataaaccacctaatttggttctgaaagataaagtaaagcccaaacaggatacaaaatacgatcttatattagatgagcaggccgaagactcaaaatcaagtcactcacacacaagtaaaaaacacaagaagaaaacccatcactgttctgaagagaaagaagatgaggactacatgccaatcaaaaatactaatcaggatatctatagagaaatggggtttggtcactatgaagaagaagaaagctgttgggagaaacaaaagagtgaaaagagagaccgaactcagaaccgaagtcgtagccgatctcgagagagggatggccattatagtaatagtcataaatcaaaataccaaacagatctttatgaaagagaaaggagtaaaaagagagaccgaagcagaagtccaaagaagtccaaagataaagaaaaatctaagtatagatgaaagatgaagaggcagaattgagaggctaacatatttactcttgtctaacttaagagtgccaggaaagcagatgcttagattttgtgtcaaagcttgttatttttttcatactaggattatggtctttagattaatactgattatatagagcacggaaagataaagaattgaacattttctttgtatacttttttacactaattttattgttatacataaatggtagtcttcatttttgaagtcttacattttcactctttttttaatgaagtatttcatactacaaaaatacataaacgtatatataaagggataataaatgtaaatatctgtgtactcatcagccagcttaagatacagatgttgtcgacattttagaagttccctaaggccctctccctctcaaataattatttggaattttgtgtttgtcatttgtctattatagttttacaacatacgtatgtatctgtaagtgaaatgttaattttgtatgtttctgaattttatataaatggcaaaatgtttacttctgtgactttctttcatttttattgctatatagtattatataaatatactacaacttattcattcttgatggacatttgagttttgtttatttgtttttgctgttgaaacaatgctgctgtgaacattgtatctagcagttatattgcttgatatattgataaaataatgccaaatttgtgttctgaa

SEQ ID NO: 21857 - DNA, 1089 bp, Homo sapiens
acacactatctcgttagatctttaaaaggtctcttaaagtctcacttctctcaaacttaggtctttcagatcttaaactcaggtcccaaatcctcagttttccactggacttaatgttctcatgggctcaatggctctacttgaacacggcatttgtgtgtaatttatttgaaagtttgatgttgtaatattcacatatatcgttaggtggcagcatgtggctacctagcaaaaatggatgtctgatttcaaattagtaatggagatggaattactatgattcttttgttccctttctctgtctctcgatatatgccatttataaaatagctcttatgctttttataaaataattattgttcttggttaggtggtttttttactaagctctttttttcttttcttaataaataggtgggaaatacaccaagagtgatttcaaggagtatgaaaaagaacaggataaaccacctaatttggttctgaaagataaagtaaagcccaaacaggatacaaaatacgatcttatattagatgagcaggccgaagactcaaaatcaagtcactcacacacaagtaaaaaacacaagaagaaaacccatcactgttctgaagagaaagaagatgaggactacatgccaatcaaaaatactaatcaggatatctatagagaaatggggtttggtcactatgaagaagaagaaagctgttgggagaaacaaaagagtgaaaagagagaccgaactcagaaccgaagtcgtagccgatctcgagagagggatggccattatagtaatagtcataaatcaaaataccaaacagatctttatgaaagagaaaggagtaaaaagagagaccgaagcagaagtccaaagaagtccaaagataaagaaaaatctaagtatagatgaaagatgaagaggcagaattgagaggctaacatatttactcttgtctaacttaagagtgccaggaaagcagatgcttagattttgtgtcaaagcttgttatttttttcatactaggattatggtctttagattaatactgattatatagagcacggaaagataaagaattgaacatttt

SEQ ID NO: 21858 - DNA, 827 bp, Homo sapiens
gttttgcagacgccaccgccgaggaaaaccgtgtactattagccatggtcaaccccaccgtgttcttcgacattgccgtcgacggcgagcccttgggccgcgtctcctttgaggtaaggggcctggataccaagaagtgactgctcatctaatccataaagctatgttaacagattggaggtagtagcattttcattacaagtgactaaaagaacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattg

SEQ ID NO: 21859 - DNA, 1412 bp, Homo sapiens
gttttgcagacgccaccgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagagtgttgatgtaggctttattttaagcagtaatgggttacttctgaaacatcacttgtttgcttaattctacacagtacttagattttttttactttccagtcccaggaagtgtcaatgtttgttgagtggaatattgaaaatgtaggcagcaactgggcatggtggctcactgtctgtaatgtattacctgaggcagaagaccacctgagggtaggagtcaagatcagcctgggcaacatagtgagacgctgtctctacaaaaaataattagcctggcctggtggtgcatgcctagtcctagctgatctggaggctgacgtgggaggattgcttgagcctagagtgagctattatcatgccactgtacagcctgggtgttcacagatcttgtgtctcaaaggtaggcagaggcaggaaaagcaaggagccagaattaagaggttgggtcagtctgcagtgagttcatgcatttagaggtgttcttcaagatgactaatgtcaaaaattgagacatctgttgcggttttttttttttttttttcccctggaatgcagtggcgtgatctcagctcactgcagcctccgcctcctgggttcaagtgattctagtgcctcagcctcctgagtagctgggataatgggcgtgtgccaccatgcccagctaatttttgtatttttagtatagatggggtttcatcattttgaccaggctggtctcaaactcttgacctcagctgatgcgcctgcctt

SEQ ID NO: 21860 - DNA, 2238 bp, Homo sapiens
cgttttgcagacgccaccgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagagtgttgatgtaggctttattttaagcagtaatgggttacttctgaaacatcacttgtttgcttaattctacacagtacttagattttttttactttccagtcccaggaagtgtcaatgtttgttgagtggaatattgaaaatgtaggcagcaactgggcatggtggctcactgtctgtaatgtattacctgaggcagaagaccacctgagggtaggagtcaagatcagcctgggcaacatagtgagacgctgtctctacaaaaaataattagcctggcctggtggtgcatgcctagtcctagctgatctggaggctgacgtgggaggattgcttgagcctagagtgagctattatcatgccactgtacagcctgggtgttcacagatcttgtgtctcaaaggtaggcagaggcaggaaaagcaaggagccagaattaagaggttgggtcagtctgcagtgagttcatgcatttagaggtgttcttcaagatgactaatgtcaaaaattgagacatctgttgcggttttttttttttttttttcccctggaatgcagtggcgtgatctcagctcactgcagcctccgcctcctgggttcaagtgattctagtgcctcagcctcctgagtagctgggataatgggcgtgtgccaccatgcccagctaatttttgtatttttagtatagatggggtttcatcattttgaccaggctggtctcaaactcttgacctcagctgatgcgcctgccttggcctcccaaactgctgagattacagatgtgagccaccgcaccctacctcattttctgtaacaaagctaagcttgaacactgttgatgttcttgagggaagcatattgggctttaggctgtaggtcaagtttatacatcttaattatggtggaattcctatgtagagtctaaaaagccaggtacttggtgctacagtcagtctccctgcagagggttaaggcgcagactacctgcagtgaggaggtactgcttgtagcatatagagcctctccctagctttggttatggaggctttgaggttttgcaaacctgaccaatttaagccataagatctggtcaaagggatacccttcccactaaggacttggtttctcaggaaattatatgtacagtgcttgctggcagttagatgtcaggacaatctaagctgagaaaaccccttctctgcccaccttaacagacctctagggttcttaacccagcaatcaagtttgcctatcctagaggtggcggatttgatcatttggtgtgttgggcaatttttgttttactgtctggttccttctgcgtgaattaccaccaccaccacttgtgcatctcagtcttgtgtgttgtctggttacgtattccctgggtgataccattcaatgtcttaatgtacttgtggctcagacctgagtgcaaggtggaaataaacatcaaacatcttttcatta

SEQ ID NO: 21861 - DNA, 785 bp, Homo sapiens
actataaagacagtaaaaagatcagtggttatctttgcagatgccaccatcactgtgagccctgtactatcagccatggtcaactccgtcgtcttttttgacatcaccgtcgacggcaagcccttgggccgcatctccatcaaactgtttgcagacaagattctaaagacagcggaaaactttcgtgctctgagcactggagagaaaggatttcgttataagggttcctgctttcacagaattattccagggtttatgtgtcagggtggtgacttcacacgccataatggcactggtgacaagtccatctatggggagaaatttgatgatgagaacctcatccgaaagcatacaggttctggcatcttgtccatggcaaatgctggacccaacacaaatggttcccagtttttcatctgtgctgccaagactgagtggttggatggcaagcatgtggcctttggcaaggtgaaagaacgtgtgaatattgtggaagccatggagcactttgggtacaggaatagcaagaccagcaagaagatcaccattgctgactgtggacaattctaatgagtttgacttgtgttttattttcaccaccagacccattccttctgtagctcaggagagcacccctccaccacatttgcttgcaatatcctagaatctttgtgctcttgctgcagttccctttgggttccatgttttccttgttcccttccatgcctagctggattgcagagttgagttaagtttatgattatgaaataaaaactaagtaacaa

SEQ ID NO: 21862 - DNA, 1081 bp, Homo sapiens
gtggcaaccacccacgagcccgcgtcggtgcccgccccgcagggggacctactatccggcgccgagccggaggggggaaacggcgcccgccgcccgcccggagcccgcgagcaaccccagtcccccccacccgcgcgtggcggcgccggctccctagccaccgcggccccaccctcttccggcctcagctgtccgggctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggtttttttttttttaatatataa

SEQ ID NO: 21863 - DNA, 1380 bp, Homo sapiens
ccgcaaccgggagcgcgcaggcgcagccggccggcagtcccgtcagctgtcccagagcctgtgtcgcgcccgtgccggtagcgcccgtgccggtagcgccgctgccaccgctcaccatgggcccgggtcctcggctgctgctacctctcgtgctttgcgtggggctcggcgcacttgtgttttcttcgggggccgagggcttccgcaagcgaggcccctcggtgacggccaaggtcttctttgatgtgaggattggagacaaagatgttggcagaattgtgattggcctctttggaaaagttgtgcccaagacagtggaaaattttgttgctctagcaacaggagagaaaggatatggatataaaggaagcaagtttcatcgtgtcatcaaggatttcatgattcaaggaggtgacatcaccactggagatggcactgggggtgtgagcatctatggtgagacatttccagatgagaacttcaagctgaagcactatggcattgggtgggtcagcatggccaacgctgggcctgacaccaatggctctcagttctttatcaccttgaccaagcccacctggttggacggcaaacatgtggtgtttggaaaagtcattgatgggatgacagtggtgcactccatagagctccaagcaactgatgggcatgaccgtccactcaccaactgctcgatcatcaacagtggcaagatagacgtgaaaacgccttttgtggttgagatcgctgattggtgacacaactggcagaaaacaaggatatgctttggcaggggtgtgtgtgtgtgtgtgtgtgtgtgtgtgttgtgttgtctttcaattatttgcttttttttttttactttctttttgtattctatcccagatcacaggaaagttataaaaatcaaaccgtcaccctttagtttgcttgaactttagtaaaccacctgcttagggactttgaacttaaatatatccccttcctcaagtggtgctattttaaaactaaaaaaaactttgaattggctatttttttaatgcaatattttttttctgaattcattatgatccccatattgggtaatgctgaacatttatctgaaacagatgaggatattattattttgtatccaaacagaaattcagataaagggaaatttgactagtgtaatctgagatatgtcatagggatttctttctgacaaaagggtgctttgctgttctttatattaaatacttttagatcaactctttttgcaagactttttaaaaatgtaaagttctttaagaaatatacaaaaatacacacactctagcattaacagtgaacagattagaaagattttataaatcaaactacaaacataattagataactcag

SEQ ID NO: 21864 - DNA, 1823 bp, Homo sapiens
ggtcagcgtcgctgccggtctccggcggagacggactctggagtttgggcggcccgggcggccactaggtactctgatattccgtactaaacacgtctgcaagtcaagatgtcgcacccgtccccccaagccaagccctccaaccccagtaaccctcgagtcttctttgacgtggacatcggaggggagcgagttggtcgaattgtcttagaattgtttgcagatatcgtacccaaaactgcggaaaattttcgtgcactgtgtacaggagaaaaaggcattggacacacgactgggaaacctctccatttcaaaggatgcccttttcatcgaattattaagaaatttatgattcagggtggagacttctcaaatcagaatgggacaggtggagaaagtatttatggtgaaaaatttgaagatgaaaatttccattacaagcatgatcgggagggtttactgagcatggcaaatgcaggccgcaacacaaacggttctcagttttttatcacaacagttccaactcctcatttggatgggaaacatgtggtgtttggccaagtaattaaaggaataggagtggcaaggatattggaaaatgtggaagtgaaaggtgaaaaacctgctaaattgtgcgttattgcagaatgtggagaattgaaggaaggagatgacgggggaatattcccaaaagatggctctggcgacagtcatccagatttccctgaggatgcggatatagatttaaaagatgtagataaaattttattaataacagaagacttaaaaaacattggaaatacttttttcaaatcccagaactgggagatggctattaaaaaatatgcagaagttttaagatacgtggacagttcaaaggctgttattgagacagcagatagagccaagctgcaacctatagctttaagctgtgtactgaatattggtgcttgtaaactgaagatgtcaaattggcagggagcaattgacagttgtttagaggctcttgaactagacccatcaaataccaaagcattgtaccgcagagctcaaggatggcaaggattaaaagaatatgatcaagcattggctgatcttaagaaagctcaggggatagcaccagaagataaagctatccaggcagaattgctgaaagtcaaacaaaagataaaggcacagaaagataaagagaaggcagtatatgcaaaaatgtttgcttagaaaggattcagttttgcttattgtgtgttgattgtataaatgcaataagaaaatgtaaaggtttttgtctatgaatatgatccctaatgtgtttcttttgacaccttagttccttactgtttacagtttaggagtactgataggggttcatgcttaataaacatgtcacaatacagtaagtaaagtggttttgtttgtttctttgagatggagtcttgctctgtcacccaggctggagtgcggtggcgcaatctcggctcactgcatcctctgcctcccgggttcaagcaattctcctgcctcagcttcccaagtagctgggattacaggcacgtgccaccacgcccagctaatttttgtatttttagtagagatggggtttcaccatattggtcacgtcacgttggtcttgaactcctgaccttgtgatccaccccgccttggcctcccaaagtgctgggattacaggtgtgagccaccgtgcccggccaagtaaaatgttttttaaaatggttatgtgcattattcataaaaaataatggtgtccagtctttttaaacttgtaaagacacatcttattgaataaagagatgagagcttaa

SEQ ID NO: 21865 - DNA, 2190 bp, Homo sapiens
tctgggcgcgcgcgacgtcagtttgagttctgtgttctccccgcccgtgtcccgcccgacccgcgcccgcgatgctggcgctgcgctgcggctcccgctggctcggcctgctctccgtcccgcgctccgtgccgctgcgcctccccgcggcccgcgcctgcagcaagggctccggcgacccgtcctcttcctcctcctccgggaacccgctcgtgtacctggacgtggacgccaacgggaagccgctcggccgcgtggtgctggagctgaaggcagatgtcgtcccaaagacagctgagaacttcagagccctgtgcactggtgagaagggcttcggctacaaaggctccaccttccacagggtgatcccttccttcatgtgccaggcgggcgacttcaccaaccacaatggcacaggcgggaagtccatctacggaagccgctttcctgacgagaactttacactgaagcacgtggggccaggtgtcctgtccatggctaatgctggtcctaacaccaacggctcccagttcttcatctgcaccataaagacagactggttggatggcaagcatgttgtgttcggtcacgtcaaagagggcatggacgtcgtgaagaaaatagaatctttcggctctaagagtgggaggacatccaagaagattgtcatcacagactgtggccagttgagctaatctgtggccagggtgctggcatggtggcagctgcaaatgtccatgcacccaggtggccgcgttgggctgtcagccaaggtgcctgaaacgatacgtgtgcccactccactgtcacagtgtgcctgaggaaggctgctagggatgttagacctcggccaggacccaccacattgcttcctaatacccacccttcctcacgacctcatttctgggcatctttgtggacatgatgtcacccaccccttgtcaagcattgcctgtgattgcccagcccagattcatctgtgccttggacatggtgatggtgatgggttgccatccaagtgaaagtcttttccttgaccaagggggacagtcagttttgcaaaaggactctaatacctgtttaatattgtcttcctaattgggataatttaattaacaagattgactagaagtgaaactgcaacactaacttccccgtgctgtggtgtgacctgagttggtgacacaggccacagaccccagagcttggcttttgaaacacaactcagggcttttgtgaaggttcccccgctgagatctttcctcctggttactgtgaagcctgttggtttgctgctgtcgtttttgaggagggcccatgggggtaggagcagttgaacctgggaacaaacctcacttgagctgtgcctagacaatgtgaattcctgtgttgctaacagaagtggcctgtaagctcctgtgctccggagggaagcatttcctggtaggctttgatttttctgtgtgttaaagaaattcaatctactcatgatgtgttatgcataaaacatttctggaacatggatttgtgttcaccttaaatgtgaaaataaatcctattttctatggaagactggtacctggtttctggaagaggggtctgtgacttggagctgatctttactgagctcgccgtggcagatgccatgctcaggacgttcatgtggatggtttcatgtcatcgtgctggcaacttgtcctccctgccttagagatgaggctcagacaaacgaccttagcacccatagcctatgccatgagcactggctccaccctgaatcccagctcctccccttagtgaccccaagtctgtttccctcagctgcataaggaggcgatatagtttgaatatttgtccccagccaaatctcatgttgaactgtaatccccagtgctggaggtggggcctgctacgaggtgtttggatcatggggacgggtatttcatggcttggtgctgttttcttgatggtgaattattgcaagatacggtcatttaaaattgtgtggcacctccccctgcccccttcttgctcctgctttcaccatgtgacatgcctgatcccccttcaccttttgccatggtcataagcttcctgaggcctccctggaagctgagcagatgccagcaccatgcttcctgtacatcctgcagaaccataagccaattaaacctttttaataataaatta

SEQ ID NO: 21866 - DNA, 1258 bp, Homo sapiens
tcggccttctgggcgcgcgcgacgtcagtttgagttctgtgttctccccgcccgtgtcccgcccgacccgcgcccgcgatgctggcgctgcgctgcggctcccgctggctcggcctgctctccgtcccgcgctccgtgccgctgcgcctccccgcggcccgcgcctgcagcaagggctccggcgacccgtcctcttcctcctcctccgggaacccgctcgtgtacctggacgtggacgccaacgggaagccgctcggccgcgtggtgctggagctgaaggcagatgtcgtcccaaagacagctgagaacttcagagccctgtgcactggtgagaagggcttcggctacaaaggctccaccttccacagggtgatcccttccttcatgtgccaggcgggcgacttcaccaaccacaatggcacaggcgggaagtccatctacggaagccgctttcctgacgagaactttacactgaagcacgtggggccaggttggatggcaagcatgttgtgttcggtcacgtcaaagagggcatggacgtcgtgaagaaaatagaatctttcggctctaagagtgggaggacatccaagaagattgtcatcacagactgtggccagttgagctaatctgtggccagggtgctggcatggtggcagctgcaaatgtccatgcacccaggtggccgcgttgggctgtcagccaaggtgcctgaaacgatacgtgtgcccactccactgtcacagtgtgcctgaggaaggctgctagggatgttagacctcggccaggacccaccacattgcttcctaatacccacccttcctcacgacctcatttctgggcatctttgtggacatgatgtcacccaccccttgtcaagcattgcctgtgattgcccagcccagattcatctgtgccttggacatggtgatggtgatgggttgccatccaagtgaaagtcttttccttgaccaagggggacagtcagttttgcaaaaggactctaatacctgtttaatattgtcttcctaattgggataatttaattaacaagattgactagaagtgaaactgcaacactaacttccccgtgctgtggtgtgacctgagttggtgacacaggccacagaccccagagcttggcttttgaaacacaactcagggcttttgtgaaggttcccccgctgagatctttcctcctggttactgtgaagcctgttggtttgctgctgtcgtttttgaggagggcccatgggggtag

SEQ ID NO: 21867 - DNA, 821 bp, Homo sapiens
cgtcctcttcctcctcctccgggaacccgctcgtgtacctggacgtggacgccaacgggaagccgctcggccgcgtggtgctggagctgaaggcagatgtcgtcccaaagacagctgagaacttcagagccctgtgcactggtgagaagggcttcggctacaaaggctccaccttccacagggtgatcccttccttcatgtgccaggcgggcgacttcaccaaccacaatggcacaggcgggaagtccatctacggaagccgctttcctgacgagaactttacactgaagcacgtggggccaggtgtcctgtccatggctaatgctggtcctaacaccaacggctcccagttcttcatctgcaccataaagacagactggtccatggcattggatgacattgcgctacactgttgctcacccgggtcacccgtcctcacaggttggatggcaagcatgttgtgttcggtcacgtcaaagagggcatggacgtcgtgaagaaaatagaatctttcggctctaagagtgggaggacatccaagaagattgtcatcacagactgtggccagttgagctaatctgtggccagggtgctggcatggtggcagctgcaaatgtccatgcacccaggtggccgcgttgggctgtcagccaaggtgcctgaaacgatacgtgtgcccactccactgtcacagtgtgcctgaggaaggctgctagggatgttagacctcggccaggacccaccacattgcttcctaatacccacccttcctcacgacctcatttctgggcatctttgtggacatgatgtcacccacccct

SEQ ID NO: 21868 - DNA, 6368 bp, Homo sapiens
gcgcttccggtgcgacgctgtctctccatgccaggactgagttgtgggggagggaggcggttagcgggctttagcgccttttctggcggcggtagatttgaagcgcttcaaaggaccggacccagagaagaggaaaactctaccggtgcaggagcacagggatcagttgtccttgtttttttttggtcttttcttcatttgaagattaagtattggagccatgggaataaaggttcaacgtcctcgatgtttttttgacattgccattaacaatcaacctgctggaagagttgtctttgaattattttctgatgtgtgccccaaaacatgcgagaactttcgttgtctttgtacaggtgaaaaggggaccgggaaatcaactcagaaaccattacattataagagttgtctctttcacagagttgtcaaggattttatggttcaaggtggtgacttcagtgaaggaaatggacgaggaggggaatctatctatggaggattttttgaagacgagagtttcgctgttaaacacaacaaagaatttctcttgtcaatggccaacagagggaaggatacaaatggttcacagttcttcataacaacgaaaccaactcctcatttagatgggcatcatgttgtttttggacaagtaatctctggtcaagaagttgtaagagagattgaaaaccagaaaacagatgcagctagcaaaccgtttgcggaggtacggatactcagttgtggagagctgattcccaaatctaaagttaagaaagaagaaaagaaaaggcataaatcatcatcatcttcctcctcctcatctagtgactcagatagctcaagtgattctcagtcctcttctgattcctctgattccgaaagtgctactgaagagaaatcaaagaaaagaaaaaagaaacatcggaaaaattcccgaaaacacaagaaagaaaagaaaaagcgaaagaaaagcaagaagagtgcatctagtgagagtgaagctgaaaatcttgaagcacaaccccagtctactgtccgtccagaagagatccctcctatacctgaaaatagattcctaatgagaaaaagtcctcctaaagctgatgagaaggaaaggaaaaacagagagagagaaagggaaagagagtgtaatccacctaactcccagcctgcttcataccagagacgacttttagttactagatctggcaggaaaattaaaggaagaggaccaaggcgttatcgaactccttccagatccagatcaagggatcgtttcagacgtagtgagactcctccacattggaggcaagagatgcagagagctcaaagaatgagggtatcaagtggtgaaagatggatcaagggggataagagtgagttgaatgaaataaaagaaaatcagagaagtccagttagagtaaaagagagaaaaataacagatcacaggaatgtatctgagagtccaaacagaaaaaatgaaaaggagaagaaagttaaagaccataaatctaacagcaaagagagagacatcagaagaaattcagaaaaagatgacaagtataaaaacaaagtgaagaaaagggccaaatctaaaagtaggagtaagagcaaagagaaatcaaagagtaaagaaagagattcaaaacataatagaaatgaagaaaagaggatgaggtcaaggagtaaaggaagggatcatgaaaatgttaaagaaaaagaaaagcagtctgattctaaaggaaaagatcaggaaaggagtagaagtaaagagaagtctaaacagttagaatcaaagagtaatgagcatgatcacagtaaaagtaaggaaaaggatagacgcgcacaatccaggagtagagaatgtgatataactaaaggtaaacacagttataatagcagaacaagagaacgaagcagaagtagggacagaagcagaagagtgcgatcaagaacccatgacagagatcgcagcagaagcaaggagtaccatagatacagagaacaggaatacaggagaagaggacggtcacgaagccgagagagaagaacaccaccaggaagatcaagaagtaaagataggaggagaaggaggagagactcacggagctcagagagagaagaaagtcaaagcagaaacaaagacaaatacagaaaccaagagagtaagagctcacacagaaaagaaaattctgagagtgagaaaagaatgtactctaaaagtcgtgatcataatagctcaaataacagcagggaaaaaaaggctgatagagatcaaagtcccttctcaaaaataaaacaaagcagtcaggacaatgaattaaagtcctccatgttgaaaaataaggaggatgagaagatcagatcctcagtggaaaaagaaaaccaaaaatcaaaaggtcaagaaaatgaccatgtacatgaaaaaaataaaaaatttgatcatgaatcaagccctggaacagatgaagacaaaagcggatgagtgagttatataaacttacttccattctgtttcggattttaagtttgagagacttgctaatgaatctcctttatgttgttttccttttcattgtttttggattgttttatgtttgtccttttttttcttaatgtggatttcattgagttgattttttgataatctgcaatctggataatttgtactgctaaagttttaataaactcgacatgagaaaaacactttggtgtagtactgtgtgctgtgtttaactattttatgtatgcattactgtgttgcaacaattagccaatagcatcctaatttgtttagtcagccatttggaatggttgcaatgcattgttgcaaaagcttgtgtttctcatgattaaagtaactttagaagccactagaagacatcttgtatagattttctgattgcgttataaatagaggtttgcagcggtttcttttaattacacagaagcagggtcctaataacctgagatcttaaatcatcacttttgattttatagtaatttgtgctttaaaatagatgtatttatattgcacttcatactctattctttatagttcgagccatagcttgtttcctattaatgcttttcctgtctagttgtgttttacttaactgcctataaaaatcgtaagagtaatttttttcagttgatgtactgattgagcttgagttgctgttatacagcatttgacaggaactataccttggaaaatcagattgtgattctcagttctgtgttgcttttggtttgaagagttttgggaacgttttaattattaattacccttctctaaactttaaaaaaaaaaaagcttttctcattaaaacataccatttgtgcaggtccttaagctatacagattctaaaaattgttagtattgagacattaacttctaagatttctcttttttggcctccaacctatatagaattgagtgttaactctgcatggattttgtttgttttaattgaactgacttctctaactctcatagctgtgagttccaaatggcaagaaaatgcatcttttctatatatgtatcacgataggctatagcatgtttatgactctggtttctttctcttcaggtggttttataccattactgttaatgttattttaacttggcatgtataacattgccatatagagtagagtagaaagttgcaaattttgatagtttacagagttaaacactaaacatatccaaagtccatttagagttttgggtgttgtattttgccatttttgtgatgtgtggccttttattctgtaatctcttctaaataaaacattgaacatccagcaaacataaaacctgcctcatttgaaaaggaatttcaaaattccaattaataggattctctagagagttttgtactttaatatttgtcagtgtagtgtcaactctgttaccaaggtagcttcttggtaaatccagtagctactcaatgctatttgtactgaataaagcaattattaacatgatacttcccactattgattaatgcaatattgatatatttggcgttgtggtagctgttgcagaatgaatagtgtaatgaccataagattgcttggaaaattgtaatacagatatccacaatgaattctttccaaaatttttttttccgatgataaaagtagtagatgtttattataaaatccaaggtgattgattccttagagactgaccacaaacccacattagggataattgagtctgagtgcccaagctatataacgttatgtagtttaagcaagttattgtttgtcttaatttcagttaactgcattttaaaattgttgttataaactatttgagctttaagaaaggtgctatttaagaaaggatttctaataacagttaaatattttttttaagtccatgctaagtaaaaattcttacatgttgtctgatcccagagctttatctactaaaaattatacataaggatttccaaatcttagagtttcaaaaagtaaccatagggaaaaaaattgtagtaatttctataggcaatattctgtttgggttatcaaaagagcaactccatgctccgcattatttatagtccttattttaaagttttattagctctctttacagaacagatgtgaaggagttgagaggacaatcaactagattttatttttagaatataaagaacatttttaaaatgattaaacagcattaactgtacctcaggatctgcgcatgcatctgaatagcacacggctcaaatggtcctttccttttgttacatttagtagttgtgccatctttagtttttgctttgaacattgttttcctaaaagtcaactattactttcccatcaagttggttttatagttatgtctaaatttatggttcatgtcaaagtatttttgacttaatatccttttaaaaatatttaaactgatttattgctcaattggtgatagctgagaaaattttttcaatatgtagaattttcatggttattttgtatgaattatttttctgggtaagccatctgccacagaaattgacactatggtgagattaatgttaatgaaatgagcagtagagaagctactggattgctttaaaacattctttgattaaattactacatagttggtaagttcatagttttaagttacttaattgaagccctcagaagttgcaaagaatttatctgataaatctgcctttgcacaaatgtgatactgatgcatggacggctttgcggaatgacctttgatatttgtgcctagtggaaggtatggagctaaacaattaaagaactcttcattatggataggcacatattggatctctggtattttgggtagtggtattaacttgacaattctaatttattttagttagtatatgtagcaagttagtatgtttgttagtagtttattgtacttcattccagttggtaatatagttttcatcacactaaactttttatactaaatttctgtagaagcttgttgggtttgccttcaccagaaggtactttaaatacctaccatagctgatttgttataaagaaacaaaatgggtgttcttctgtttccttttgattatgtttactgtaattatttcattttggatttatacatttacaattgaataaggattataggttgataagctgtttattgtgaaaagatgtgttttgttacaaatacttgttttaaaaattaataagcccccaggaagtacagcattgactggcacaactgcccatagtgagcttcccaactaactgccttcagtggattcgggcaagtgcaaagtctttggcctattgtgtgacaaagaggtatatattaaaggaaaagaaaaatgacatgaataagaaaattccgtcaacaaggttggagtagggagttgttgaggggtttagtttgttttaaaaggtatgtgagggagtggtggggtggatttgtgtttctgactttttttctttaagcaaattccatatgttaccaaaagcacatgctgtatattttcttccccttttgtgtgtatatagtattttgaaagataaatgaattgggtatttgtatgtgggatgtacaaaattgtggccgctctctttgtggaaggaaaaaacataaatgaagttaatgcacttcttttcctagcccaaaagtcactgtgattatatttttttaatgaagtttagaaaaaaagctgttgtcttctcaattgtaaaattagtttcaaaatgctgcttctcttatcattagtctagtaattgttgaacttttctgcaaactgcattttacaaaattgaaacttggaagctgtattaacttttatagttaaacattgtattaaataaactatactataataaa

SEQ ID NO: 21869 - DNA, 1062 bp, Homo sapiens
gaggaagtccctgaggaccgcagcagtgcctttgccgctgttgcagaaggagaaggcttgcagtcgagccccggggcctggggacggtccttcctctgccagcccccgccctccccactcaggcgcacacctccctcactgacgcattttgccgcacaagctgtaacatggcggcagcgactgcggcctgaactctagggagccgggttgatttttaaagcttcaaaatcctaagactcagcactgttgcggggagcacagggatcagttgtccttgtttttttttggtcttttcttcatttgaagattaagtattggagccatgggaataaaggttcaacgtcctcgatgtttttttgacattgccattaacaatcaacctgctggaagagttgtctttgaattattttctgatgtgtgccccaaaacatgcgagaactttcgttgtctttgtacaggtgaaaaggggaccgggaaatcaactcagaaaccattacattataagagttgtctctttcacagagttgtcaaggattttatggttcaaggtggtgacttcagtgaaggaaatggacgaggaggggaatctatctatggaggattttttgaagacgagagtttcgctgttaaacacaacaaagaatttctcttgtcaatggccaacagagggaaggatacaaatggttcacagttcttcataacaacgaaaccaactcctcatttagatgggcatcatgttgtttttggacaagtaatctctggtcaagaagttgtaagagagattgaaaaccagaaaacagatgcagctagcaaaccgtttgcggaggtacggatactcagttgtggagagctgattcccaaatctaaagttaagaaagaagaaaagaaaaggcataaatcatcatcatcttcctcctcctcatctagtgactcagatagctcaagtgattctcagtcctcttctgattcctctgattccgaaagtgctactgaagagaaatcaaagaaaagaaaaaagaaacatcggaaaaattcccgaaaacacaagaaagaaaagaaaaa

SEQ ID NO: 21870 - DNA, 525 bp, Homo sapiens
gaagaggggcggagccggcgcggctgaccgggttgggtttaccgtctttccctcgaggtatcggggctgcttgggcccagaggaagtccctgaggaccgcagcagtgcctttgccgctgttgcagaaggagaaggcttgcagtcgagccccggggcctggggacggtccttcctctgccagcccccgccctccccactcaggcgcacacctccctcactgacgcattttgccgcacaagctgtaacatggcggcagcgactgcggcctgaactctagggagccgggttgatttttaaagcttcaaaatcctaagactcagcactgttgcgggattaagtattggagccatgggaataaaggttcaacgtcctcgatgtttttttgacattgccattaacaatcaacctgctggaagagttgtctttgaattattttctgatgtgtgccccaaaacatgcgagaactttcgttgtctttgtacaggtgaaaaggggaccgggaaatcaactcagaaaccattacat

SEQ ID NO: 21871 - DNA, 2498 bp, Homo sapiens
tagatttgaagcgcttcaaaggaccggacccagagaagaggaaaactctaccggtgcaggtaagtggagcacagggatcagttgtccttgtttttttttggtcttttcttcatttgaagattaagtattggagccatgggaataaaggttcaacgtcctcgatgtttttttgacattgccattaacaatcaacctgctggaagagttgtctttgaattattttctgatgtgtgccccaaaacatgcgagaactttcgttgtctttgtacaggtgaaaaggggaccgggaaatcaactcagaaaccattacattataagagttgtctctttcacagagttgtcaaggattttatggttcaaggtggtgacttcagtgaaggaaatggacgaggaggggaatctatctatggaggattttttgaagacgagagtttcgctgttaaacacaacaaagaatttctcttgtcaatggccaacagagggaaggatacaaatggttcacagttcttcataacaacgaaaccaactcctcatttagatgggcatcatgttgtttttggacaagtaatctctggtcaagaagttgtaagagagattgaaaaccagaaaacagatgcagctagcaaaccgtttgcggaggtacggatactcagttgtggagagctgattcccaaatctaaagttaagaaagaagaaaagaaaaggcataaatcatcatcatcttcctcctcctcatctagtgactcagatagctcaagtgattctcagtcctcttctgattcctctgattccgaaagtgctactgaagagaaatcaaagaaaagaaaaaagaaacatcggaaaaattcccgaaaacacaagaaagaaaagaaaaagcgaaagaaaagcaagaagagtgcatctagtgagagtgaagctgaaaatcttgaagcacaaccccagtctactgtccgtccagaagagatccctcctatacctgaaaatagattcctaatgagaaaaagtcctcctaaagctgatgagaaggaaaggaaaaacagagagagagaaagggaaagagagtgtaatccacctaactcccagcctgcttcataccagagacgacttttagttactagatctggcaggaaaattaaaggaagaggaccaaggcgttatcgaactccttccagatccagatcaagggatcgtttcagacgtagtgagactcctccacattggaggcaagagatgcagagagctcaaagaatgagggtatcaagtggtgaaagatggatcaagggggataagagtgagttgaatgaaataaaagaaaatcagagaagtccagttagagtaaaagagagaaaaataacagatcacaggaatgtatctgagagtccaaacagaaaaaatgaaaaggagaagaaagttaaagaccataaatctaacagcaaagagagagacatcagaagaaattcagaaaaagatgacaagtataaaaacaaagtgaagaaaagggccaaatctaaaagtaggagtaagagcaaagagaaatcaaagagtaaagaaagagattcaaaacataatagaaatgaagaaaagaggatgaggtcaaggagtaaaggaagggatcatgaaaatgttaaagaaaaagaaaagcagtctgattctaaaggaaaagatcaggaaaggagtagaagtaaagagaagtctaaacagttagaatcaaagagtaatgagcatgatcacagtaaaagtaaggaaaaggatagacgcgcacaatccaggagtagagaatgtgatataactaaaggtaaacacagttataatagcagaacaagagaacgaagcagaagtagggacagaagcagaagagtgcgatcaagaacccatgacagagatcgcagcagaagcaaggagtaccatagatacagagaacaggaatacaggagaagaggacggtcacgaagccgagagagaagaacaccaccaggaagatcaagaagtaaagataggaggagaaggaggagagactcacggagctcagagagagaagaaagtcaaagcagaaacaaagacaaatacagaaaccaagagagtaagagctcacacagaaaagaaaattctgagagtgagaaaagaatgtactctaaaagtcgtgatcataatagctcaaataacagcagggaaaaaaaggctgatagagatcaaagtcccttctcaaaaataaaacaaagcagtcaggacaatgaattaaagtcctccatgttgaaaaataaggaggatgagaagatcagatcctcagtggaaaaagaaaaccaaaaatcaaaaggtcaagaaaatgaccatgtacatgaaaaaaataaaaaatttgatcatgaatcaagccctggaacagatgaagacaaaagcggatgagtgagttatataaacttacttccattctgtttcggattttaagtttgagagacttgctaatgaatctcctttatgttgttttccttttcattgttttt

SEQ ID NO: 21872 - DNA, 1564 bp, Homo sapiens
gcgcttccggtgcgacgctgtctctccatgccaggactgagttgtgggggagggaggcggttagcgggctttagcgccttttctggcggcggtagatttgaagcgcttcaaaggaccggacccagagaagaggaaaactctaccggtgcaggagcacagggatcagttgtccttgtttttttttggtcttttcttcatttgaagattaagtattggagccatgggaataaaggttcaacgtcctcgatgtttttttgacattgccattaacaatcaacctgctggaagagttgtctttgaattattttctgatgtgtgccccaaaacatgcgagaactttcgttgtctttgtacaggtgaaaaggggaccgggaaatcaactcagaaaccattacattataagagttgtctctttcacagagttgtcaaggattttatggttcaaggtggtgacttcagtgaaggaaatggacgaggaggggaatctatctatggaggattttttgaagacgagagtttcgctgttaaacacaacaaagaatttctcttgtcaatggccaacagagggaaggatacaaatggttcacagttcttcataacaacgaaaccaactcctcatttagatgggcatcatgttgtttttggacaagtaatctctggtcaagaagttgtaagagagattgaaaaccagaaaacagatgcagctagcaaaccgtttgcggaggtacggatactcagttgtggagagctgattcccaaatctaaagttaagaaagaagaaaagaaaaggcataaatcatcatcatcttcctcctcctcatctagtgactcagatagctcaagtgattctcagtcctcttctgattcctctgattccgaaagtgctactgaagagaaatcaaagaaaagaaaaaagaaacatcggaaaaattcccgaaaacacaagaaagaaaagaaaaagcgaaagaaaagcaagaagagtgcatctagtgagagtgaagctgaaaatcttgaagcacaaccccagtctactgtccgtccagaagagatccctcctatacctgaaaatagattcctaatgagaaaaagtcctcctaaagctgatgagaaggaaaggaaaaacagagagagagaaagggaaagagagtgtaatccacctaactcccagcctgcttcataccagagacgacttttagttactagatctggcaggaaaattaaaggaagaggaccaaggcgttatcgaactccttccagatccagatcaagggatcgtttcagacgtagtgagactcctccacattggaggcaagagatgcagagagctcaaagaatgagggtatcaagtggtgaaagatggatcaagggggataagagtgagttgaatgaaataaaagaaaatcagagaagtccagttagagtaaaagagagaaaaataacagatcacaggaatgtatctgagagtccaaacagaaaaaatgaaaaggagaagaaagttaaagaccataaatctaacagcaaagagagagacatcagaagaaaaaaaaaaaaaaaaaaaaaaaaa

SEQ ID NO: 21873 - DNA, 752 bp, Homo sapiens
cttctgcttccgggtcggagccatggcggtggcaaattcaagtcctgttaaccccgtggtgttctttgatgtcagtattggcggtcaggaagttggccgcatgaagatcgagctctttgcagacgttgtgcctaagacggccgagaactttaggcagttctgcaccggagaattcaggaaagatggggttccaataggatacaaaggaagcaccttccacagggtcataaaggatttcatgattcagggtggagattttgttaatggagatggtactggagtcgccagtatttaccgggggccatttgcagatgaaaattttaaacttagacactcagctccaggcctgctttccatggcgaacagtggtccaagtacaaatggctgtcagttctttatcacctgctctaagtgcgattggctggatgggaagcatgtggtgtttggaaaaatcatcgatggacttctagtgatgagaaagattgagaatgttcccacaggccccaacaataagcccaagctacctgtggtgatctcgcagtgtggggagatgtagtccagacaaagactgaatcaggccttcccttcttcttggtggtgttcttgagtaagataatctggactggcccccgtctttgcttccctgcctgctgctgccccatttgatcaagagaccatggaagtgtcagagattcagaatccaagattgtctttaagttttcaactgtaaataaagtttttttgtatgcgta

SEQ ID NO: 21874 - DNA, 327 bp, Homo sapiens
actagggaggcggaggtgggagataccgagcggcagggtggtgggtcagcccatcatgccccctgctccgtgaagccctcatggtcttggactgggccttctgacactctcccgctgattgcaggaagttggccgcatgaagatcgagctctttgcagacgttgtgcctaagacggccgagaactttaggcagttctgcaccggagaattcaggtcagtttcagatgtgtttgacttctttgcctgctccagaggggtgttctggggctgcagtgagggtatcggtgaaccacctgctggccttgaatgattgctggtgacagtgat

SEQ ID NO: 21875 - DNA, 665 bp, Homo sapiens
gcaaattcaagtcctgttaaccccgtggtgttctttgatgtcagtattggcggtcaggaagttggccgcatgaagatcgagctctttgcagacgttgtgcctaagacggccgagaactttaggcagttctgcaccggagaattcaggtcagtttcagatgtgtttgacttctttgcctgctccagaggggtgttctggggctgcagtgagggtatcggtgaaccacctgctggccttgaatgattgctggtgacagtgatagaaggaaagatggggttccaataggatacaaaggaagcaccttccacagggtcataaaggatttcatgattcagggtggagattttgttaatggagatggtactggagtcgccagtatttaccgggggccatttgcagatgaaaattttaaacttagacactcagctccaggcctgctttccatggcgaacagtggtccaagtacaaatggctgtcagttctttatcacctgctctaagtgcgattggctggatgggaagcatgtggtgtttggaaaaatcatcgatggacttctagtgatgagaaagattgagaatgttcccacaggccccaacaataagcccaagctacctgtggtgatctcgcagtgtggggagatgtagtccagacaaagactgaatcag

SEQ ID NO: 21876 - DNA, 416 bp, Homo sapiens
aattcaggtcagtttcagatgtgtttgacttctttgcctgctccagaggggtgttctggggctgcagtgagggtatcggtgaaccacctgctggccttgaatgattgctggtgacagtgatagaaggtaatgccccaagggtctgtccctagtttatttgccttctttatgtctgtcaaccatctttaggagagtccttttggctccagtgcatggtaaactggaaaggccttgtgctacctgctgtcactccaagtctctttcttttcggttataggaaagatggggttccaataggatacaaaggaagcaccttccacagggtcataaaggatttcatgattcagggtggagattttgttaatgtaagtactattcctttcctatcaaagacccgtagttttagtttttgttgt

SEQ ID NO: 21877 - DNA, 669 bp, Homo sapiens
ggtgagatccaggaggctgcccacacctgcgccgaagggaaactgctcggggctaggcaggcagaactcacccagagagagcggactcgggaagccagccagaaagtgaaattgcacccgaacctaccgacctgccgggcggggggaaaggaggaggaggagtctccccaatcctagcgccccgcttctggaggaactgggcggttagactagggaggcggaggaagttggccgcatgaagatcgagctctttgcagacgttgtgcctaagacggccgagaactttaggcagttctgcaccggagaattcaggaaagatggggttccaataggatacaaaggaagcaccttccacagggtcataaaggatttcatgattcagggtggagattttgttaatggagatggtactggagtcgccagtatttaccgggggccatttgcagatgaaaattttaaacttagacactcagctccaggcctgctttccatggcgaacagtggtccaagtacaaatggctgtcagttctttatcacctgctctaagtgcgattggctggatgggaagcatgtggtgtttggaaaaatcatcgatggacttctagtgatgagaaagattgagaatgttcccacaggccccaacaataagcccaagctacctgtggtgat

SEQ ID NO: 21878 - DNA, 1311 bp, Homo sapiens
gtgctccagctccgctggattagctgaggcagaagtcgggctccagtcagccgcctgaaatagcctgtctacctctgtccgtccgctcactgctcttgagacctgattcctccatgcattgctctgtctggttgccgtttggattgttcccgtgttaatttacgttgttagtctgtgtgactgcgtgtctggacgtctggctggccgattggtggacttgctggctccagtgtttattctttcccgtatttagaggcgctcacgactgtgacatcatagtgattgaatcattcattttttgtccctttcaggcagttctgcaccggagaattcaggtcagtttcagatgtgtttgacttctttgcctgctccagaggggtgttctggggctgcagtgagggtatcggtgaaccacctgctggccttgaatgattgctggtgacagtgatagaaggaaagatggggttccaataggatacaaaggaagcaccttccacagggtcataaaggatttcatgattcagggtggagattttgttaatggagatggtactggagtcgccagtatttaccgggggccatttgcagatgaaaattttaaacttagacactcagctccaggcctgctttccatggcgaacagtggtccaagtacaaatggctgtcagttctttatcacctgctctaagtgcgattggctggatgggaagcatgtggtgtttggaaaaatcatcgatggacttctagtgatgagaaagattgagaatgttcccacaggccccaacaataagcccaagctacctgtggtgatctcgcagtgtggggagatgtagtccagacaaagactgaatcaggtaagtgtgtctttctcctattaggttaggaatcagacctcagagaaggcagcatggtctagtggaaagaactttagtcttgaagacatgagattgagcccagttcctccgtgtatggccttggagtagtcactttccttctctgagcacatttcctcatctgtcaaatggaaatactgtaatacctatctctcagagtcactgtaaaaataaaaagagaaagggttgtaggagcactttacttttctatcactttgtaatgtacaaagtatcaatgtgaaaactactcaggcagtttgtaacagcactctcagactacagttccattcagtagtccccctagaaagacctggctccaggcctgagtaactctctgctgggaccaggccaggcagccaggagacacacctgtcatgcctctcatcagaactgatactgcaattccaggcctcgactt

SEQ ID NO: 21879 - DNA, 901 bp, Homo sapiens
atacgttcctccctcctttcggcgagctcggttgatcctcgcgggatttcagttaggctcttagtgcgggccctgtgggtgtggcaagaggaagaatgactgctcgctttgtgattcttgatccggaacttgtcacccaggaaccccggaagaggtagctcacgcgatagaaacgtgttcgctgcccagaagaagggaaggcgcgagtgaggaaaggaggtactgtagatgccctccaaatccttggttatggaatatttggctcatcccagtacactcggcttggctgttggagttgcttgtggcatgtgcctgggctggagccttcgagtatgctttgggatgctccccaaaagcaagacgagcaagacacacacagatactgaaagtgaagcaagcatcttgggagacagcggggagtacaagatgattcttgtggttcgaaatgacttaaagatgggaaaagggaaagtggctgcccagtgctctcatgctgctgtttcagcctacaagcagattcaaagaagaaatcctgaaatgctcaaacaatgggaatactgtggccagcccaaggtggtggtcaaagctcctgatgaagaaaccctgattgcattattggcccatgcaaaaatgctgggactgactgtaagtttaattcaagatgctggacgtactcagattgcaccaggctctcaaactgtcctagggattgggccaggaccagcagacctaattgacaaagtcactggtcacctaaaactttactaggtggactttgatatgacaacaacccctccatcacaagtgtttgaagcctgtcagattctaacaacaaaagctgaatttcttcacccaacttaaatgttcttgagatgaaaataaaacctattcccatgttcta

SEQ ID NO: 21880 - DNA, 1993 bp, Homo sapiens
tagctacacttctggaaaattcagtatggacagtctccgacttaggatttttcaactttaggatggtgtgaaagagacacccattcagtagaaactgtacttcgagttttgcattttgatcttttcctggcctagtgataatgtggtacagtacactcttgtgatgctgggcagcggcagcgagccacagctcccagtcacccatgtgatcacgggaatcaacaacccatcctctaccgtgtactgtgttgtcagcttttttggatattgtgttttgtgttttcacattccatcatgtctacaaaatgtccatcagtgtctcctgtttctggtgagatgaagaagaggaaggcaattactcttgaaatgaaactcaagataattgcccagcatgaaggtggcaagccagtaatggccattgcacgtgagttaggactttggcaatccacgatttcaaccatcttaagggataagaagcaaatcagtgatgcagcgaaatcgtcagcatcagttaaatccactgtcatcacaaagaaaagggctggaccaattgatgatatggaaaaattacttgttatgtggatggaagaccagatacagaagcgtataccacttagcctactgatgatccaggctaaggcaagaagtctttttaatatgctaaaagaccgtgccagtgatcctacatatacacaaatgtttaaagcaagtcatggatggttccagcgcttcaaaaggcgtcataattttcacaatgtaaagatcactggtgaggcagcacgtgctggtaatgaaggtgccatagcttttaaggaacagctgcataggataattatggctaaagatctttgcaataaggagctgattgcactggaggaagaaagaggtaaaggcgttgaggcagtggaagaagttacacccacggcacctagaaagttcacagcaaagaaactggcagaggcatttgctgctatcagcagtggcctacacgttagaagaaatggacgtcaattacgagagattcgccacagttgacaggcgcagatacaggatgctcttgcttgctacagagaaatatatagtgaaaagaagaaacaagctgtacggtcaaaacttggtatcttcctgaagaacaacactatgcttgctaaaccatcaactagtgttgatgtcccaatgccttctaccacctattctcgatgttcatcagaagagagagaaattgaggaccctgttgcatccccatcatccagcaattaattctatttcagtgcttcaaacatttttcaggaccactgtgctttcagctgtgtaaattaatgatgccctccaaatccttggttatggaatatttggctcatcccagtacactcggcttggctgttggagttgcttgtggcatgtgcctgggctggagccttcgagtatgctttgggatgctccccaaaagcaagacgagcaagacacacacagatactgaaagtgaagcaagcatcttgggagacagcggggagtacaagatgattcttgtggttcgaaatgacttaaagatgggaaaagggaaagtggctgcccagtgctctcatgctgctgtttcagcctacaagcagattcaaagaagaaatcctgaaatgctcaaacaatgggaatactgtggccagcccaaggtggtggtcaaagctcctgatgaagaaaccctgattgcattattggcccatgcaaaaatgctgggactgactgtaagtttaattcaagatgctggacgtactcagattgcaccaggctctcaaactgtcctagggattgggccaggaccagcagacctaattgacaaagtcactggtcacctaaaactttactaggtggactttgatatgacaacaacccctccatcacaagtgtttgaagcctgtcagattctaacaacaaaagctgaatttcttcacccaacttaaatgttcttgagatgaaaataaaacctattcccatgttc

SEQ ID NO: 21881 - DNA, 2049 bp, Homo sapiens
gaaacgtgttcgctgcccagaagaagggaaggcgcgagtgaggaaaggaggtactgtagctacacttctggaaaattcagtatggacagtctccgacttaggatttttcaactttaggatggtgtgaaagagacacccattcagtagaaactgtacttcgagttttgcattttgatcttttcctggcctagtgataatgtggtacagtacactcttgtgatgctgggcagcggcagcgagccacagctcccagtcacccatgtgatcacgggaatcaacaacccatcctctaccgtgtactgtgttgtcagcttttttggatattgtgttttgtgttttcacattccatcatgtctacaaaatgtccatcagtgtctcctgtttctggtgagatgaagaagaggaaggcaattactcttgaaatgaaactcaagataattgcccagcatgaaggtggcaagccagtaatggccattgcacgtgagttaggactttggcaatccacgatttcaaccatcttaagggataagaagcaaatcagtgatgcagcgaaatcgtcagcatcagttaaatccactgtcatcacaaagaaaagggctggaccaattgatgatatggaaaaattacttgttatgtggatggaagaccagatacagaagcgtataccacttagcctactgatgatccaggctaaggcaagaagtctttttaatatgctaaaagaccgtgccagtgatcctacatatacacaaatgtttaaagcaagtcatggatggttccagcgcttcaaaaggcgtcataattttcacaatgtaaagatcactggtgaggcagcacgtgctggtaatgaaggtgccatagcttttaaggaacagctgcataggataattatggctaaagatctttgcaataaggagctgattgcactggaggaagaaagaggtaaaggcgttgaggcagtggaagaagttacacccacggcacctagaaagttcacagcaaagaaactggcagaggcatttgctgctatcagcagtggcctacacgttagaagaaatggacgtcaattacgagagattcgccacagttgacaggcgcagatacaggatgctcttgcttgctacagagaaatatatagtgaaaagaagaaacaagctgtacggtcaaaacttggtatcttcctgaagaacaacactatgcttgctaaaccatcaactagtgttgatgtcccaatgccttctaccacctattctcgatgttcatcagaagagagagaaattgaggaccctgttgcatccccatcatccagcaattaattctatttcagtgcttcaaacatttttcaggaccactgtgctttcagctgtgtaaattaatgatgccctccaaatccttggttatggaatatttggctcatcccagtacactcggcttggctgttggagttgcttgtggcatgtgcctgggctggagccttcgagtatgctttgggatgctccccaaaagcaagacgagcaagacacacacagatactgaaagtgaagcaagcatcttgggagacagcggggagtacaagatgattcttgtggttcgaaatgacttaaagatgggaaaagggaaagtggctgcccagtgctctcatgctgctgtttcagcctacaagcagattcaaagaagaaatcctgaaatgctcaaacaatgggaatactgtggccagcccaaggtggtggtcaaagctcctgatgaagaaaccctgattgcattattggcccatgcaaaaatgctgggactgactgtaagtttaattcaagatgctggacgtactcagattgcaccaggctctcaaactgtcctagggattgggccaggaccagcagacctaattgacaaagtcactggtcacctaaaactttactaggtggactttgatatgacaacaacccctccatcacaagtgtttgaagcctgtcagattctaacaacaaaagctgaatttcttcacccaacttaaatgttcttgagatgaaaataaaacctattcccatgttc

SEQ ID NO: 21882 - DNA, 2507 bp, Homo sapiens
gaagtgatgtgagtggtggctggtgcaaggagccacagtgggctgcctggggggctgatgccaccattccaggagcctcggtgaagagaggatatccatctgtgtagccgcttctctatacgggattccagctccatggcagcccgtctgctcctcctgggcatccttctcctgctgctgcccctgcccgtccctgccccgtgccacacagccgcacgctcagagtgcaagcgcagccacaagttcgtgcctggtgcatggctggccggggagggtgtggacgtgaccagcctccgccgctcgggctccttcccagtggacacacaaaggttcctgcggcccgacggcacctgcaccctctgtgaaaatgccctacaggagggcaccctccagcgcctgcctctggcgctcaccaactggcgggcccagggctctggctgccagcgccatgtaaccagggccaaagtcagctccactgaagctgtggcccgggatgcggctcgtagcatccgcaacgactggaaggtcgggctggacgtgactcctaagcccaccagcaatgtgcatgtgtctgtggccggctcacactcacaggcagccaactttgcagcccagaagacccaccaggaccagtacagcttcagcactgacacggtggagtgccgcttctacagtttccatgtggtacacactcccccgctgcaccctgacttcaagagggccctcggggacctgccccaccacttcaacgcctccacccagcccgcctacctcaggcttatctccaactacggcacccacttcatccgggctgtggagctgggtggccgcatatcggccctcactgccctgcgcacctgcgagctggccctggaagggctcacggacaacgaggtggaggactgcctgactgtcgaggcccaggtcaacataggcatccacggcagcatctctgccgaagccaaggcctgtgaggagaagaagaagaagcacaagatgacggcctccttccaccaaacctaccgggagcgccactcggaagtggttggcggccatcacacctccattaacgacctgctgttcgggatccaggccgggcccgagcagtactcagcctgggtaaactcgctgcccggcagccctggcctggtggactacaccctggaacccctgcacgtgctgctggacagccaggacccgcggcgggaggcactgaggagggccctgagtcagtacctgacggacagggctcgctggagggactgcagccggccgtgcccaccagggcggcagaagagcccccgagacccatgccagtgtgtgtgccatggctcagcggtcaccacccaggactgctgccctcggcagaggggcctggcccagctggaggtgaccttcatccaagcatggggcctgtggggggactggttcactgccacggatgcctatgtgaagctcttctttggtggccaggagctgaggacgagcaccgtgtgggacaataacaaccccatctggtcagtgcggctggattttggggatgtgctcctggccacaggggggcccctgaggttgcaggtctgggatcaggactctggcagggacgatgacctccttggcacctgtgatcaggctcccaagtctggttcccatgaggtgagatgcaacctgaatcatggccacctaaaattccgctatcatgccaggtgcttgccccacctgggaggaggcacctgcctggactatgtcccccaaatgcttctgggggagcctccaggaaaccggagtggggccgtgtggtgagaacagtgagcttggaaaggaccagtatgcttggactgaaggggttctcacagtgggagccagggctgtcttcgtattcccattagaccaagcttgtccaacccgaggcccgcatgcggcccaggatggctttgaatgcggcccaacgcaaattcgcaaactttcttaaaacattatgagtttctttttgctattttttttttttttttagctcatcggctatcgttagtgctagtggattttacatgtggcccaacacaattcttcttccaacgtggcccagagaagccaaaagattggatacgcatcagacagatggaaaagggagattcagactgtttttcagggaggtggctgggtttacacgctaatcccgattcaccctgtccaaactgcctaagccctccgccattctcaagccctgcagtcacagctacacagatcacagcttcagccaggagctgggcagaaggccaagaggctgttcccaccaggctgctcagggctggtcttttaggacccttcccttgagccctctatggtgtggcaaagccttcattgccttaactggagccccatcagctccagctgctctgtcttctttgcccacaatgctttgcccctgagacaaatggaggcctgtcctgacctgtctcaccatgtacatagcttgataaagggccaataaatatgatgttatggtg

SEQ ID NO: 21883 - DNA, 2488 bp, Homo sapiens
tggctggtgcaaggagccacagtgggctgcctggggggctgatgccaccattccaggagcctcggtgaagagaggatatccatctgtgtagccgcttctctatacgggattccagatggcagcccgtctgctcctcctgggcatccttctcctgctgctgcccctgcccgtccctgccccgtgccacacagccgcacgctcagagtgcaagcgcagccacaagttcgtgcctggtgcatggctggccggggagggtgtggacgtgaccagcctccgccgctcgggctccttcccagtggacacacaaaggttcctgcggcccgacggcacctgcaccctctgtgaaaatgccctacaggagggcaccctccagcgcctgcctctggcgctcaccaactggcgggcccagggctctggctgccagcgccatgtaaccagggccaaagtcagctccactgaagctgtggcccgggatgcggctcgtagcatccgcaacgactggaaggtcgggctggacgtgactcctaagcccaccagcaatgtgcatgtgtctgtggccggctcacactcacaggcagccaactttgcagcccagaagacccaccaggaccagtacagcttcagcactgacacggtggagtgccgcttctacagtttccatgtggtacacactcccccgctgcaccctgacttcaagagggccctcggggacctgccccaccacttcaacgcctccacccagcccgcctacctcaggcttatctccaactacggcacccacttcatccgggctgtggagctgggtggccgcatatcggccctcactgccctgcgcacctgcgagctggccctggaagggctcacggacaacgaggtggaggactgcctgactgtcgaggcccaggtcaacataggcatccacggcagcatctctgccgaagccaaggcctgtgaggagaagaagaagaagcacaagatgacggcctccttccaccaaacctaccgggagcgccactcggaagtggttggcggccatcacacctccattaacgacctgctgttcgggatccaggccgggcccgagcagtactcagcctgggtaaactcgctgcccggcagccctggcctggtggactacaccctggaacccctgcacgtgctgctggacagccaggacccgcggcgggaggcactgaggagggccctgagtcagtacctgacggacagggctcgctggagggactgcagccggccgtgcccaccagggcggcagaagagcccccgagacccatgccagtgtgtgtgccatggctcagcggtcaccacccaggactgctgccctcggcagaggggcctggcccagctggaggtgaccttcatccaagcatggggcctgtggggggactggttcactgccacggatgcctatgtgaagctcttctttggtggccaggagctgaggacgagcaccgtgtgggacaataacaaccccatctggtcagtgcggctggattttggggatgtgctcctggccacaggggggcccctgaggttgcaggtctgggatcaggactctggcagggacgatgacctccttggcacctgtgatcaggctcccaagtctggttcccatgaggtgagatgcaacctgaatcatggccacctaaaattccgctatcatgccaggtgcttgccccacctgggaggaggcacctgcctggactatgtcccccaaatgcttctgggggagcctccaggaaaccggagtggggccgtgtggtgagaacagtgagcttggaaaggaccagtatgcttggactgaaggggttctcacagtgggagccagggctgtcttcgtattcccattagaccaagcttgtccaacccgaggcccgcatgcggcccaggatggctttgaatgcggcccaacgcaaattcgcaaactttcttaaaacattatgagtttctttttgctattttttttttttttttagctcatcggctatcgttagtgctagtggattttacatgtggcccaacacaattcttcttccaacgtggcccagagaagccaaaagattggatacgcatcagacagatggaaaagggagattcagactgtttttcagggaggtggctgggtttacacgctaatcccgattcaccctgtccaaactgcctaagccctccgccattctcaagccctgcagtcacagctacacagatcacagcttcagccaggagctgggcagaaggccaagaggctgttcccaccaggctgctcagggctggtcttttaggacccttcccttgagccctctatggtgtggcaaagccttcattgccttaactggagccccatcagctccagctgctctgtcttctttgcccacaatgctttgcccctgagacaaatggaggcctgtcctgacctgtctcaccatgtacatagcttgataaagggccaataaatatgatgttatggtga

SEQ ID NO: 21884 - DNA, 2533 bp, Homo sapiens
gaagtgatgtgagtggtggctggtgcaaggagccacagtgggctgcctggggggctgatgccaccattccaggagcctcggtgaagagaggatatccatctgtgtagccgcttctctatacgggattccagagcccaagtgccccctgtctctgcagctccatggcagcccgtctgctcctcctgggcatccttctcctgctgctgcccctgcccgtccctgccccgtgccacacagccgcacgctcagagtgcaagcgcagccacaagttcgtgcctggtgcatggctggccggggagggtgtggacgtgaccagcctccgccgctcgggctccttcccagtggacacacaaaggttcctgcggcccgacggcacctgcaccctctgtgaaaatgccctacaggagggcaccctccagcgcctgcctctggcgctcaccaactggcgggcccagggctctggctgccagcgccatgtaaccagggccaaagtcagctccactgaagctgtggcccgggatgcggctcgtagcatccgcaacgactggaaggtcgggctggacgtgactcctaagcccaccagcaatgtgcatgtgtctgtggccggctcacactcacaggcagccaactttgcagcccagaagacccaccaggaccagtacagcttcagcactgacacggtggagtgccgcttctacagtttccatgtggtacacactcccccgctgcaccctgacttcaagagggccctcggggacctgccccaccacttcaacgcctccacccagcccgcctacctcaggcttatctccaactacggcacccacttcatccgggctgtggagctgggtggccgcatatcggccctcactgccctgcgcacctgcgagctggccctggaagggctcacggacaacgaggtggaggactgcctgactgtcgaggcccaggtcaacataggcatccacggcagcatctctgccgaagccaaggcctgtgaggagaagaagaagaagcacaagatgacggcctccttccaccaaacctaccgggagcgccactcggaagtggttggcggccatcacacctccattaacgacctgctgttcgggatccaggccgggcccgagcagtactcagcctgggtaaactcgctgcccggcagccctggcctggtggactacaccctggaacccctgcacgtgctgctggacagccaggacccgcggcgggaggcactgaggagggccctgagtcagtacctgacggacagggctcgctggagggactgcagccggccgtgcccaccagggcggcagaagagcccccgagacccatgccagtgtgtgtgccatggctcagcggtcaccacccaggactgctgccctcggcagaggggcctggcccagctggaggtgaccttcatccaagcatggggcctgtggggggactggttcactgccacggatgcctatgtgaagctcttctttggtggccaggagctgaggacgagcaccgtgtgggacaataacaaccccatctggtcagtgcggctggattttggggatgtgctcctggccacaggggggcccctgaggttgcaggtctgggatcaggactctggcagggacgatgacctccttggcacctgtgatcaggctcccaagtctggttcccatgaggtgagatgcaacctgaatcatggccacctaaaattccgctatcatgccaggtgcttgccccacctgggaggaggcacctgcctggactatgtcccccaaatgcttctgggggagcctccaggaaaccggagtggggccgtgtggtgagaacagtgagcttggaaaggaccagtatgcttggactgaaggggttctcacagtgggagccagggctgtcttcgtattcccattagaccaagcttgtccaacccgaggcccgcatgcggcccaggatggctttgaatgcggcccaacgcaaattcgcaaactttcttaaaacattatgagtttctttttgctattttttttttttttttagctcatcggctatcgttagtgctagtggattttacatgtggcccaacacaattcttcttccaacgtggcccagagaagccaaaagattggatacgcatcagacagatggaaaagggagattcagactgtttttcagggaggtggctgggtttacacgctaatcccgattcaccctgtccaaactgcctaagccctccgccattctcaagccctgcagtcacagctacacagatcacagcttcagccaggagctgggcagaaggccaagaggctgttcccaccaggctgctcagggctggtcttttaggacccttcccttgagccctctatggtgtggcaaagccttcattgccttaactggagccccatcagctccagctgctctgtcttctttgcccacaatgctttgcccctgagacaaatggaggcctgtcctgacctgtctcaccatgtacatagcttgataaagggccaataaatatgatgttatggtg

SEQ ID NO: 21885 - DNA, 5505 bp, Homo sapiens
gctctcgaggtgtctggaggctcagcgagcgccggacccaggaggcccaaggagctggaggtgaccctcaggcagcaagaaccccacggaagggcgtgagccctgcagacagctgtgcggcacctcgggctgggctcctgttaggaggaagtgcctgcacccaggcagcggctcagaggcagctgctccatgcagaactgaagctggttctgcagcagaaaggggagaggacacaggagcctggggtgcaggtgcctcccagcaacgccatggaggccaggagccggagtgccgaggagctgaggcgggcggagttggtggaaattatcgtggagacggaggcgcagaccggggtcagcggcatcaacgtagcgggcggcggcaaagagggaatcttcgttcgggagctgcgcgaggactcacccgccgccaggagcctcagcctgcaggaaggggaccagctgctgagtgcccgagtgttcttcgagaacttcaagtacgaggacgcactacgcctgctgcaatgcgccgagccttacaaagtctccttctgcctgaagcgcactgtgcccaccggggacctggctctgcggcccgggaccgtgtctggctacgagatcaagggcccgcgggccaaggtggccaagctggtacgcgtgcttagcccggccccggccctggactgccccagcgatccggtctctgcgccgtgagccccattccccgccatcgtgggccagccttgccctctgtcttgtcactaacccaagctaattccaccctctgccccttcctctctgccccaaactcttccccgggaagggggacagacccaccccagcccagggccctcacccacctcggagaggcgtccccaccatcggatccaggcttgctaggggtcctgaaccaggctacttcgaaccaggaaagccagattccagcctgagtgctggcccaattactgctgagtggccctggacaaagttgtttctctccctgggcctcagtttccccatctctagaatgaggatgttggggaaaatcccggatcaggatctagaagtcttgggtccccgtccctacactcctgttgactcatttggagatcctagatggctgcctgctttcctgggcactcatggtgaaatgacaggcaagaagtggggatgatgtttggggaacaagatacttgacccagcacatcccccgcctggtccaataccaggtggggctcttcctgtccactcccagcctcccactgtcccaccgcctcctgcctctctcctctctccccagaacatccagagtctgtcccctgtgaagaagaagaagatggtgcctggggctctgggggtccccgctgacctggcccctgttgacgtcgagttctcctttcccaagttctcccgcctgcgtcggggcctcaaagccgaggctgtcaagggtcctgtcccggctgcccctgcccgccggcgcctccagctgcctcggctgcgtgtacgagaagtggccgaagaggctcaggcagcccggctggccgccgccgctcctccccccaggaaagccaaggtggaggctgaggtggctgcaggagctcgtttcacagcccctcaggtggagctggttgggccgcggctgccaggggcggaggtgggtgtcccccaggtctcagcccccaaggctgccccctcagcagaggcagctggtggctttgccctccacctgccaacccttgggctcggagccccggctccgcctgctgtggaggccccagccgtgggaatccaggtcccccaggtggagctgcctgccttgccctcactgcccactctgcccacacttccctgcctagagacccgggaaggggctgtgtcggtagtggtgcccaccctggatgtggcagcaccgactgtgggggtggacctggccttgccgggtgcagaggtggaggcccggggagaggcacctgaggtggccctgaagatgccccgccttagttttccccgatttggggctcgagcaaaggaagttgctgaggccaaggtagccaaggtcagccctgaggccagggtgaaaggtcccagacttcgaatgcccacctttgggctttccctcttggagccccggcccgctgctcctgaagttgtagagagcaagctgaagctgcccaccatcaagatgccctcccttggcatcggagtgtcagggcccgaggtcaaggtgcccaagggacctgaagtgaagctccccaaggctcctgaggtcaagcttccaaaagtgcccgaggcagcccttccagaggttcgactcccagaggtggagctccccaaggtgtcagagatgaaactcccaaaggtgccagagatggctgtgccggaggtgcggcttccagaggtagagctgcccaaagtgtcagagatgaaactcccaaaggtgccagagatggctgtgccggaggtgcggcttccagaggtacagctgctgaaagtgtcggagatgaaactcccaaaggtgccagagatggctgtgccggaggtgcggcttccagaggtacagctgccgaaagtgtcagagatgaaactcccagaggtgtcagaggtggctgtgccagaggtgcggcttccagaggtgcagctgccgaaagtgccagagatgaaagtccctgagatgaagcttccaaaggtgcctgagatgaaacttcctgagatgaaactccctgaagtgcaactcccgaaggtgcccgagatggccgtgcccgatgtgcacctcccagaagtgcagcttccaaaagtcccagagatgaagctccctgagatgaaactccctgaggtgaaactcccgaaggtgcccgagatggctgtgcccgatgtgcacctcccggaagtgcagctcccgaaagtcccagagatgaaactccctaaaatgcctgagatggctgtgccagaggttcgactccccgaggtgcagctgccaaaagtctcagagatgaaactccccaaggtgcctgaaatggccgtgcccgatgtgcacctcccagaggtgcagctgcccaaagtctgtgaaatgaaagtccctgacatgaagctcccagagataaaactccccaaggtgcctgagatggctgtgcccgatgtgcacctccccgaggtgcagctgccgaaagtgtcagagattcggctgccggaaatgcaagtgccgaaggttcccgacgtgcatcttccgaaggcaccagaggtgaagctgcccagggctccggaggtgcagctaaaggccaccaaggcagaacaggcagaagggatggaatttggcttcaagatgcccaagatgaccatgcccaagctagggagggcagagtccccatcacgtggcaagccaggcgaggcgggtgctgaggtctcagggaagctggtaacacttccctgtctgcagccagaggtggatggtgaggctcatgtgggtgtcccctctctcactctgccttcagtggagctagacctgccaggagcacttggcctgcaggggcaggtcccagccgctaaaatgggcaagggagagcgggtggagggccctgaggtggcagcaggggtcagggaagtgggcttccgagtgccctctgttgaaattgtcaccccacagctgcccgccgtggaaattgaggaagggcggctggagatgatagagacaaaagtcaagccctcttccaagttctccttacctaagtttggactctcggggccaaaggtggctaaggcagaggctgagggggctgggcgagctaccaagctgaaggtatccaaatttgccatctcactccccaaggctcgggtgggggctgaggctgaggccaaaggggctggggaggcaggcctgctgcctgccctcgatctgtccatcccacagctcagcctggatgcccacctgccctcaggcaaggtagaggtggcaggggccgacctcaagttcaaggggcccaggtttgctctccccaagtttggggtcagaggccgggacactgaggcagcagaactagtgccaggggtggctgagttggagggcaagggctggggctgggatgggagggtgaagatgcccaagctgaagatgccttcctttgggctggctcgagggaaggaagcagaagttcaaggtgatcgtgccagcccgggggaaaaggctgagtccaccgctgtgcagcttaagatccccgaggtggagctggtcacgctgggcgcccaggaggaagggagggcagagggggctgtggccgtcagtggaatgcagctgtcaggcctgaaggtgtccacagccgggcaggtggtcactgagggccatgacgcggggctgaggatgcctccgctgggcatctccctgccacaggtggagctgaccggctttggggaggcaggtaccccagggcagcaggctcagagtacagtcccttcagcagagggcacagcaggctacagggttcaggtgccccaggtgaccctgtctctgcctggagcccaggttgcaggtggtgagctgctggtgggtgagggtgtctttaagatgcccaccgtgacagtgccccagcttgagctggacgtggggctaagccgagaggcacaggcgggcgaggcggccacaggcgagggtgggctgaggctgaagttgcccacactgggggccagagctagggtggggggcgagggtgctgaggagcagcccccaggggccgagcgtaccttctgcctctcactgcccgacgtggagctctcgccatccgggggcaaccatgccgagtaccaggtggcagagggggagggagaggccggacacaagctcaaggtacggctgccccggtttggcctggtgcgggccaaggagggggccgaggagggtgagaaggccaagagccccaaactcaggctgccccgagtgggcttcagccaaagtgagatggtcactggggaagggtcccccagccccgaggaggaggaggaggaggaggaagagggcagtggggaaggggcctcgggtcgccggggccgggtccgggtccgcttgccacgtgtaggcctggcggccccttctaaagcctctcgggggcaggagggcgatgcagcccccaagtcccccgtcagagagaagtcacccaagttccgcttccccagggtgtccctaagccccaaggcccggagtgggagtggggaccaggaagagggtggattgcgggtgcggctgcccagcgtggggttttcagagacaggggctccaggcccggccaggatggagggggctcaggctgcggctgtctgaagcccctagtcagatggggatcccttcttgccttcctttctctaccccctcgctgttgtgtgtgtgataactagcactaaccctaagagggccgggaggtgggtgactgaccagggctggcagggaggcctgctcctgtctctctggcaggagtgcctgtaccccaccaagccatgtgaataaaataatctggaagtagcc

SEQ ID NO: 21886 - DNA, 4856 bp, Homo sapiens
gctctcgaggtgtctggaggctcagcgagcgccggacccaggaggcccaaggagctggaggtgaccctcaggcagcaagaaccccacggaagggcgtgagccctgcagacagctgtgcggcacctcgggctgggctcctgttaggaggaagtgcctgcacccaggcagcggctcagaggcagctgctccatgcagaactgaagctggttctgcagcagaaaggggagaggacacaggagcctggggtgcaggtgcctcccagcaacgccatggaggccaggagccggagtgccgaggagctgaggcgggcggagttggtggaaattatcgtggagacggaggcgcagaccggggtcagcggcatcaacgtagcgggcggcggcaaagagggaatcttcgttcgggagctgcgcgaggactcacccgccgccaggagcctcagcctgcaggaaggggaccagctgctgagtgcccgagtgttcttcgagaacttcaagtacgaggacgcactacgcctgctgcaatgcgccgagccttacaaagtctccttctgcctgaagcgcactgtgcccaccggggacctggctctgcggcccgggaccgtgtctggctacgagatcaagggcccgcgggccaaggtggccaagctgaacatccagagtctgtcccctgtgaagaagaagaagatggtgcctggggctctgggggtccccgctgacctggcccctgttgacgtcgagttctcctttcccaagttctcccgcctgcgtcggggcctcaaagccgaggctgtcaagggtcctgtcccggctgcccctgcccgccggcgcctccagctgcctcggctgcgtgtacgagaagtggccgaagaggctcaggcagcccggctggccgccgccgctcctccccccaggaaagccaaggtggaggctgaggtggctgcaggagctcgtttcacagcccctcaggtggagctggttgggccgcggctgccaggggcggaggtgggtgtcccccaggtctcagcccccaaggctgccccctcagcagaggcagctggtggctttgccctccacctgccaacccttgggctcggagccccggctccgcctgctgtggaggccccagccgtgggaatccaggtcccccaggtggagctgcctgccttgccctcactgcccactctgcccacacttccctgcctagagacccgggaaggggctgtgtcggtagtggtgcccaccctggatgtggcagcaccgactgtgggggtggacctggccttgccgggtgcagaggtggaggcccggggagaggcacctgaggtggccctgaagatgccccgccttagttttccccgatttggggctcgagcaaaggaagttgctgaggccaaggtagccaaggtcagccctgaggccagggtgaaaggtcccagacttcgaatgcccacctttgggctttccctcttggagccccggcccgctgctcctgaagttgtagagagcaagctgaagctgcccaccatcaagatgccctcccttggcatcggagtgtcagggcccgaggtcaaggtgcccaagggacctgaagtgaagctccccaaggctcctgaggtcaagcttccaaaagtgcccgaggcagcccttccagaggttcgactcccagaggtggagctccccaaggtgtcagagatgaaactcccaaaggtgccagagatggctgtgccggaggtgcggcttccagaggtagagctgcccaaagtgtcagagatgaaactcccaaaggtgccagagatggctgtgccggaggtgcggcttccagaggtacagctgctgaaagtgtcggagatgaaactcccaaaggtgccagagatggctgtgccggaggtgcggcttccagaggtacagctgccgaaagtgtcagagatgaaactcccagaggtgtcagaggtggctgtgccagaggtgcggcttccagaggtgcagctgccgaaagtgccagagatgaaagtccctgagatgaagcttccaaaggtgcctgagatgaaacttcctgagatgaaactccctgaagtgcaactcccgaaggtgcccgagatggccgtgcccgatgtgcacctcccagaagtgcagcttccaaaagtcccagagatgaagctccctgagatgaaactccctgaggtgaaactcccgaaggtgcccgagatggctgtgcccgatgtgcacctcccggaagtgcagctcccgaaagtcccagagatgaaactccctaaaatgcctgagatggctgtgccagaggttcgactccccgaggtgcagctgccaaaagtctcagagatgaaactccccaaggtgcctgaaatggccgtgcccgatgtgcacctcccagaggtgcagctgcccaaagtctgtgaaatgaaagtccctgacatgaagctcccagagataaaactccccaaggtgcctgagatggctgtgcccgatgtgcacctccccgaggtgcagctgccgaaagtgtcagagattcggctgccggaaatgcaagtgccgaaggttcccgacgtgcatcttccgaaggcaccagaggtgaagctgcccagggctccggaggtgcagctaaaggccaccaaggcagaacaggcagaagggatggaatttggcttcaagatgcccaagatgaccatgcccaagctagggagggcagagtccccatcacgtggcaagccaggcgaggcgggtgctgaggtctcagggaagctggtaacacttccctgtctgcagccagaggtggatggtgaggctcatgtgggtgtcccctctctcactctgccttcagtggagctagacctgccaggagcacttggcctgcaggggcaggtcccagccgctaaaatgggcaagggagagcgggtggagggccctgaggtggcagcaggggtcagggaagtgggcttccgagtgccctctgttgaaattgtcaccccacagctgcccgccgtggaaattgaggaagggcggctggagatgatagagacaaaagtcaagccctcttccaagttctccttacctaagtttggactctcggggccaaaggtggctaaggcagaggctgagggggctgggcgagctaccaagctgaaggtatccaaatttgccatctcactccccaaggctcgggtgggggctgaggctgaggccaaaggggctggggaggcaggcctgctgcctgccctcgatctgtccatcccacagctcagcctggatgcccacctgccctcaggcaaggtagaggtggcaggggccgacctcaagttcaaggggcccaggtttgctctccccaagtttggggtcagaggccgggacactgaggcagcagaactagtgccaggggtggctgagttggagggcaagggctggggctgggatgggagggtgaagatgcccaagctgaagatgccttcctttgggctggctcgagggaaggaagcagaagttcaaggtgatcgtgccagcccgggggaaaaggctgagtccaccgctgtgcagcttaagatccccgaggtggagctggtcacgctgggcgcccaggaggaagggagggcagagggggctgtggccgtcagtggaatgcagctgtcaggcctgaaggtgtccacagccgggcaggtggtcactgagggccatgacgcggggctgaggatgcctccgctgggcatctccctgccacaggtggagctgaccggctttggggaggcaggtaccccagggcagcaggctcagagtacagtcccttcagcagagggcacagcaggctacagggttcaggtgccccaggtgaccctgtctctgcctggagcccaggttgcaggtggtgagctgctggtgggtgagggtgtctttaagatgcccaccgtgacagtgccccagcttgagctggacgtggggctaagccgagaggcacaggcgggcgaggcggccacaggcgagggtgggctgaggctgaagttgcccacactgggggccagagctagggtggggggcgagggtgctgaggagcagcccccaggggccgagcgtaccttctgcctctcactgcccgacgtggagctctcgccatccgggggcaaccatgccgagtaccaggtggcagagggggagggagaggccggacacaagctcaaggtacggctgccccggtttggcctggtgcgggccaaggagggggccgaggagggtgagaaggccaagagccccaaactcaggctgccccgagtgggcttcagccaaagtgagatggtcactggggaagggtcccccagccccgaggaggaggaggaggaggaggaagagggcagtggggaaggggcctcgggtcgccggggccgggtccgggtccgcttgccacgtgtaggcctggcggccccttctaaagcctctcgggggcaggagggcgatgcagcccccaagtcccccgtcagagagaagtcacccaagttccgcttccccagggtgtccctaagccccaaggcccggagtgggagtggggaccaggaagagggtggattgcgggtgcggctgcccagcgtggggttttcagagacaggggctccaggcccggccaggatggagggggctcaggctgcggctgtctgaagcccctagtcagatggggatcccttcttgccttcctttctctaccccctcgctgttgtgtgtgtgataactagcactaaccctaagagggccgggaggtgggtgactgaccagggctggcagggaggcctgctcctgtctctctggcaggagtgcctgtaccccaccaagccatgtgaataaaataatctggaagtagcc

SEQ ID NO: 21887 - DNA, 4462 bp, Homo sapiens
gagctctcgaggtgtctggaggctcagcgagcgccggacccaggaggcccaaggagctggaggtgaccctcaggcagcaagaaccccacggaagggcgtgagccctgcagacagctgtgcggcacctcgggctgggctcctgttaggaggaagtgcctgcacccaggcagcggctcagaggcagctgctccatgcagaactgaagctggttctgcagcagaaaggggagaggacacaggagcctggggtgcaggtgcctcccagcaacgccatggaggccaggagccggagtgccgaggagctgaggcgggcggagttggtggaaattatcgtggagacggaggcgcagaccggggtcagcggcatcaacgtagcgggcggcggcaaagagggaatcttcgttcgggagctgcgcgaggactcacccgccgccaggagcctcagcctgcaggaaggggaccagctgctgagtgcccgagtgttcttcgagaacttcaagtacgaggacgcactacgcctgctgcaatgcgccgagccttacaaagtctccttctgcctgaagcgcactgtgcccaccggggacctggctctgcggcccgggaccgtgtctggctacgagatcaagggcccgcgggccaaggtggccaagctgaacatccagagtctgtcccctgtgaagaagaagaagatggtgcctggggctctgggggtccccgctgacctggcccctgttgacgtcgagttctcctttcccaagttctcccgcctgcgtcggggcctcaaagccgaggctgtcaagggtcctgtcccggctgcccctgcccgccggcgcctccagctgcctcggctgcgtgtacgagaagtggccgaagaggctcaggcagcccggctggccgccgccgctcctccccccaggaaagccaaggtggaggctgaggtggctgcaggagctcgtttcacagcccctcaggtggagctggttgggccgcggctgccaggggcggaggtgggtgtcccccaggtctcagcccccaaggctgccccctcagcagaggcagctggtggctttgccctccacctgccaacccttgggctcggagccccggctccgcctgctgtggaggccccagccgtgggaatccaggtcccccaggtggagctgcctgccttgccctcactgcccactctgcccacacttccctgcctagagacccgggaaggggctgtgtcggtagtggtgcccaccctggatgtggcagcaccgactgtgggggtggacctggccttgccgggtgcagaggtggaggcccggggagaggcacctgaggtggccctgaagatgccccgccttagttttccccgatttggggctcgagcaaaggaagttgctgaggccaaggtagccaaggtcagccctgaggccagggtgaaaggtcccagacttcgaatgcccacctttgggctttccctcttggagccccggcccgctgctcctgaagttgtagagagcaagctgaagctgcccaccatcaagatgccctcccttggcatcggagtgtcagggcccgaggtcaaggtgcccaagggacctgaagtgaagctccccaaggctcctgaggtcaagcttccaaaagtgcccgaggcagcccttccagaggttcgactcccagaggtggagctccccaaggtgtcagagatgaaactcccaaaggtgccagagatggctgtgccggaggtgcggcttccagaggtagagctgcccaaagtgtcagagatgaaactcccaaaggtgccagagatggctgtgccggaggtgcggcttccagaggtacagctgctgaaagtgtcggagatgaaactcccaaaggtgccagagatggctgtgccggaggtgcggcttccagaggtacagctgccgaaagtgtcagagatgaaactcccagaggtgtcagaggtggctgtgccagaggtgcggcttccagaggtgcagctgccgaaagtgccagagatgaaagtccctgagatgaagcttccaaaggtgcctgagatgaaacttcctgagatgaaactccctgaagtgcaactcccgaaggtgcccgagatggccgtgcccgatgtgcacctcccagaagtgcagcttccaaaagtcccagagatgaagctccctgagatgaaactccctgaggtgaaactcccgaaggtgcccgagatggctgtgcccgatgtgcacctcccggaagtgcagctcccgaaagtcccagagatgaaactccctaaaatgcctgagatggctgtgccagaggttcgactccccgaggtgcagctgccaaaagtctcagagatgaaactccccaaggtgcctgaaatggccgtgcccgatgtgcacctcccagaggtgcagctgcccaaagtctgtgaaatgaaagtccctgacatgaagctcccagagataaaactccccaaggtgcctgagatggctgtgcccgatgtgcacctccccgaggtgcagctgccgaaagtgtcagagattcggctgccggaaatgcaagtgccgaaggttcccgacgtgcatcttccgaaggcaccagaggtgaagctgcccagggctccggaggtgcagctaaaggccaccaaggcagaacaggcagaagggatggaatttggcttcaagatgcccaagatgaccatgcccaagctagggagggcagagtccccatcacgtggcaagccaggcgaggcgggtgctgaggtctcagggaagctggtaacacttccctgtctgcagccagaggtggatggtgaggctcatgtgggtgtcccctctctcactctgccttcagtggagctagacctgccaggagcacttggcctgcaggggcaggtcccagccgctaaaatgggcaagggagagcgggtggagggccctgaggtggcagcaggggtcagggaagtgggcttccgagtgccctctgttgaaattgtcaccccacagctgcccgccgtggaaattgaggaagggcggctggagatgatagagacaaaagtcaagccctcttccaagttctccttacctaagtttggactctcggggccaaaggtggctaaggcagaggctgagggggctgggcgagctaccaagctgaaggtatccaaatttgccatctcactccccaaggctcgggtgggggctgaggctgaggccaaaggggctggggaggcaggcctgctgcctgccctcgatctgtccatcccacagctcagcctggatgcccacctgccctcaggcaaggtagaggtggcaggggccgacctcaagttcaaggggcccaggtttgctctccccaagtttggggtcagaggccgggacactgaggcagcagaactagtgccaggggtggctgagttggagggcaagggctggggctgggatgggagggtgaagatgcccaagctgaaggtgtccacagccgggcaggtggtcactgagggccatgacgcggggctgaggatgcctccgctgggcatctccctgccacaggtggagctgaccggctttggggaggcaggtaccccagggcagcaggctcagagtacagtcccttcagcagagggcacagcaggctacagggttcaggtgccccaggtgaccctgtctctgcctggagcccaggttgcaggtggtgagctgctggtgggtgagggtgtctttaagatgcccaccgtgacagtgccccagcttgagctggacgtggggctaagccgagaggcacaggcgggcgaggcggccacaggcgagggtgggctgaggctgaagttgcccacactgggggccagagctagggtggggggcgagggtgctgaggagcagcccccaggggccgagcgtaccttctgcctctcactgcccgacgtggagctctcgccatccgggggcaaccatgccgagtaccaggtggcagagggggagggagaggccggacacaagctcaaggtacggctgccccggtttggcctggtgcgggccaaggagggggccgaggagggtgagaaggccaagagccccaaactcaggctgccccgagtgggcttcagccaaagtgagatggtcactggggaagggtcccccagccccgaggaggaggaggaggaggaggaagagggcagtggggaaggggcctcgggtcgccggggccgggtccgggtccgcttgccacgtgtaggcctggcggccccttctaaagcctctcgggggcaggagggcgatgcagcccccaagtcccccgtcagagagaagtcacccaagttccgcttccccagggtgtccctaagccccaaggcccggagtgggagtggggaccaggaagagggtggattgcgggtgcggctgcccagcgtggggttttcagagacaggggctccaggcccggccaggatggagggggctcaggctgcggctgtctga

SEQ ID NO: 21888 - DNA, 2296 bp, Homo sapiens
cgcgggggagggagtgtaaatagagcgaaggctgctctgtgtcagccccgtcaccgccgggcggcccgcgcggagtctgagggagatggaagttgagcaagagcagcggcgcagaaaggtggaggccgggaggacgaagcttgctcacttccgacagagaaaaacaaaaggtgacagttcgcattcggagaaaaagacggcgaagaggaagggctcggctgtcgatgcgtctgtccaggaggagagtccggtaaccaaggaggacagcgcactctgtggaggaggggacatttgcaaaagcacatcatgtgacgacacccctgatggggcaggaggggcctttgcagctcagccggaggactgtgatggagagaagagagaggacttggaacagctgcagcagaagcaagtcaatgaccatcctccagagcagtgtgggatgttcacagtcagtgaccacccaccagaacagcatgggatgttcacagtcggtgaccacccaccagaacagcgtgggatgttcacagtcagtgaccacccaccagaacagcgtgggatgttcacaatcagtgaccaccaaccggaacagcgtgggatgttcacagtcagtgaccacacaccagaacagcgtgggatcttcacaatcagtgaccacccagcagaacagcgtgggatgttcacaaaggagtgtgaacaagaatgtgaacttgccattactgacctggagagcggccgtgaagatgaggctggcctgcatcagagtcaggccgtgcatggccttgagctggaggcgctgcgcctgagtctgagcaacatgcacacggcgcagctggagctgacacaggccaacctccagaaggagaaggagacggcattgacggagctgcgggagatgctcaacagccggcgtgcccaggagctggccctgctacagagcaggcagcagcacgagctggagctcctcagggagcagcacgcacgggagaaggaggaggtggtgctcaggtgtggacaggaagcagctgagctgaaggagaagttacaatcagaaatggagaaaaacgcccagatagtaaagaccctgaaggaagattgggaatctgaaaaagatttatgtttagaaaatctacgcaaagaactgtctgcaaagcatcaatcagaaatggaggatttacaaaaccagtttcagaaagaattggcagaacagagagctgagttggagaagatttttcaagacaaaaaccaggctgaacgggcccttaggaacctggagagtcatcatcaagcagccattgagaagttacgtgaagacctgcagtccgagcacggccggtgtttagaagacttggagttcaagttcaaagagagcgagaaagaaaaacagctggagttagagaatcttcaagcatcatatgaagacctgaaggcacaatcacaagaagagatcaggcgcttgtggtcccagcttgattctgccaggaccagtagacaggaattgagtgagctacatgagcaactcctggcgcgcacctctcgtgtggaagatttagaacagctgaagcagcgagaaaaaacccagcatgagtccgaactggagcaactgaggatttattttgaaaagaagttaagggatgctgagaaaacttaccaagaagacctaaccctgttacagcagaggctgcagggggcgagggaagatgctcttctggactctgtggaagttgggttgtcctgtgtgggtttagaagagaaacctgagaaaggaagaaaagatcacgttgatgaactcgagcctgagcgacataaggagagcctgccacgcttccaggcggagttagaagaaagccacaggcaccagctggaagcgctggagtctcccctctgcatccagcacgaggggcatgtctcagacagatgctgcgtagagacttcagcattgggacacgagtggcgtctggaaccctctgaagggcacagccaagagcttccctgggtgcatctccagggtgtgcaggacggggacttggaggccgacacagagcgggcagccagagtcttgggtctggaaactgagcacaaggtgcaactttcgcttcttcagactgagctcaaagaagaaattgaactcctaaaaatagaaaatagaaatttgtatgggaagttgcagcatgaaactcgtctgaaggacgatttggagaaggtaaaacacaatctaattgaagaccaccagaaggaactaaataatgctaagcaaaagactgagctgatgaaacaggaattccaaagaaaagaaacg

SEQ ID NO: 21889 - DNA, 10560 bp, Homo sapiens
gcggggggagggcgagcccaagcgcgggggagggagtgtaaatagagcgaaggctgctctgtgtcagccccgtcaccgccgggcggcccgcgcggagtctgagggagatggaagttgagcaagagcagcggcgcagaaaggtggaggccgggaggacgaagcttgctcacttccgacagagaaaaacaaaaggtgacagttcgcattcggagaaaaagacggcgaagaggaagggctcggctgtcgatgcgtctgtccaggaggagagtccggtaaccaaggaggacagcgcactctgtggaggaggggacatttgcaaaagcacatcatgtgacgacacccctgatggggcaggaggggcctttgcagctcagccggaggactgtgatggagagaagagagaggacttggaacagctgcagcagaagcaagtcaatgaccatcctccagagcagtgtgggatgttcacagtcagtgaccacccaccagaacagcatgggatgttcacagtcggtgaccacccaccagaacagcgtgggatgttcacagtcagtgaccacccaccagaacagcatgggatgttcacagtcagtgaccacccaccagaacagcgtgggatgttcacaatcagtgaccaccaaccggaacagcgtgggatgttcacagtcagtgaccacacaccagaacagcgtgggatcttcacaatcagtgaccacccagcagaacagcgtgggatgttcacaaaggagtgtgaacaagaatgtgaacttgccattactgacctggagagcggccgtgaagatgaggctggcctgcatcagagtcaggccgtgcatggccttgagctggaggcgctgcgcctgagtctgagcaacatgcacacggcgcagctggagctgacacaggccaacctccagaaggagaaggagacggcattgacggagctgcgggagatgctcaacagccggcgtgcccaggagctggccctgctacagagcaggcagcagcacgagctggagctcctcagggagcagcacgcacgggagaaggaggaggtggtgctcaggtgtggacaggaagcagctgagctgaaggagaagttacaatcagaaatggagaaaaacgcccagatagtaaagaccctgaaggaagattgggaatctgaaaaagatttatgtttagaaaatctacgcaaagaactgtctgcaaagcatcaatcagaaatggaggatttacaaaaccagtttcagaaagaattggcagaacagagagctgagttggagaagatttttcaagacaaaaaccaggctgaacgggcccttaggaacctggagagtcatcatcaagcagccattgagaagttacgtgaagacctgcagtccgagcacggccggtgtttagaagacttggagttcaagttcaaagagagcgagaaagaaaaacagctggagttagagaatcttcaagcatcatatgaagacctgaaggcacaatcacaagaagagatcaggcgcttgtggtcccagcttgattctgccaggaccagtagacaggaattgagtgagctacatgagcaactcctggcgcgcacctctcgtgtggaagatttagaacagctgaagcagcgagaaaaaacccagcatgagtccgaactggagcaactgaggatttattttgaaaagaagttaagggatgctgagaaaacttaccaagaagacctaaccctgttacagcagaggctgcagggggcgagggaagatgctcttctggactctgtggaagttgggttgtcctgtgtgggtttagaagagaaacctgagaaaggaagaaaagatcacgttgatgaactcgagcctgagcgacataaggagagcctgccacgcttccaggcggagttagaagaaagccacaggcaccagctggaagcgctggagtctcccctctgcatccagcacgaggggcatgtctcagacagatgctgcgtagagacttcagcattgggacacgagtggcgtctggaaccctctgaagggcacagccaagagcttccctgggtgcatctccagggtgtgcaggacggggacttggaggccgacacagagcgggcagccagagtcttgggtctggaaactgagcacaaggtgcaactttcgcttcttcagactgagctcaaagaagaaattgaactcctaaaaatagaaaatagaaatttgtatgggaagttgcagcatgaaactcgtctgaaggacgatttggagaaggtaaaacacaatctaattgaagaccaccagaaggaactaaataatgctaagcaaaagactgagctgatgaaacaggaattccaaagaaaagaaacggactggaaagttatgaaggaggagctacagcgggaagctgaggagaagttaacattgatgctacttgaactgagagaaaaggctgaatccgagaaacagaccatcataaacaagtttgagcttcgagaagctgaaatgaggcagcttcaggaccaacaggcagcccagatcctggatctggagaggtccttgacggagcagcagggccgcctgcagcagctggaacaggacctcacttcagacgacgccctgcattgcagccagtgtgggcgggagccgcccacagcccaggacggggagcttgctgcgctccacgtgaaggaagactgcgccctgcagctgatgctggcccggagcaggtttttagaggaacgtaaagagatcaccgagaaattcagtgcggaacaagatgccttcctgcaggaggcccaggagcagcatgcccgtgagctgcagctcctccaggagagacaccagcagcagctcctgtcagtgacggcggagctcgaggccagacaccaggccgcgttgggcgagctgacagcctccttagagagcaagcagggggctctgctggctgcacgtgtggccgaactgcagacaaaacacgctgccgacctcggcgctctggagaccagacatctgtccagccttgattctttggaatcctgttacctctctgaatttcagaccatccgtgaggagcacaggcaggccctagagctcttacgagcagactttgaggaacaactgtggaaaaaggactctcttcaccaaacgattttgactcaagagttggagaaactgaagcggaaacacgaaggggagctacagtctgtgcgggaccacctgcgaaccgaagtgagcacagagctcgccggaaccgtggctcacgagctgcagggagtgcaccagggtgaatttggaagtgaaaagaaaactgctttgcatgaaaaagaggagacacttcggcttcagagtgcacaggcacagccttttcaccaagaggagaaagagtctttgtctctgcagcttcaaaagaagaatcaccaagtccagcagctgaaagaccaggttttatccttaagtcacgagatagaagagtgccgctccgagttggaggtgctgcagcagaggcgggagcgggagaaccgggaaggcgcaaacctcctctccatgctcaaggccgacgtcaacctgtcccacagcgaaagaggggccctccaggacgccctgcgcaggctgctgggtttgtttggagagacgctgagggcagccgtcaccctgaggagccggatcggggagcgcgtggggctctgcctggatgacgcgggcgcaggcctggccctgtcgacagctccggcgctggaggagacatggtctgatgtggccctcccggagttggacagaactttgtctgaatgtgcagagatgtcttccgtggctgaaattagcagccacatgcgtgaaagctttctcatgagcccagaaagtgtgcgggagtgtgagcagcccatccggagggtcttccagagcctcagcctggccgtggacggcctcatggagatggccctggactccagcaggcagctggaagaagcacgccaaattcattctcgttttgaaaaagaatttagttttaagaatgaggagacagcacaggttgtcaggaagcaccaggagctgctggagtgtttgaaggaggagagcgcagcaaaggcagagctggcgctggagctgcacaagactcagggtacccttgagggattcaaggtggagacagcagatctgaaggaggtgctggccgggaaggaggattccgagcaccgtctggtgctggagctggagagcctgagacggcagctgcagcaggcggcccaggagcaggcggcgctgagggaggagtgcacccgtctgtggagtcggggggaggccacagccacggacgccgaggccagagaagctgctctccggaaggaagtggaggatctgaccaaagaacagtcggagaccaggaagcaggctgagaaggaccgctcagccctgctctcccagatgaagattttggagtctgagttagaagaacagctgtctcagcatcgcgggtgtgccaagcaggcggaggccgtcactgccctggaacagcaggtggcatctctggacaagcatttgcgcaaccagcggcaattcatggatgagcaggcagccgagcgggagcacgagcgcgaggagttccagcaggagattcagaggctggaggggcagctccgccaggcggccaagccgcagccctggggccctcgcgacagccagcaggcgccgctggatggagaggttgagttgttacaacaaaagttgagagaaaagttggatgaatttaatgaattggctatacagaaagagtcggcagatagacaagtgttaatgcaggaagaagaaattaaacgtctggaggagatgaacatcaacatcaggaaaaaagtggcccagctccaggaagaagtggaaaaacagaaaaacatcgtgaaagggctggaacaggataaagaggtgttaaagaaacagcagatgagtagcttgcttctggcgtccacgttgcagtctacactagatgcaggcagatgtcccgagcctccttcgggcagccctcctgagggtccagaaatacagttagaggtgacacagagagcactcctgcggcgcgagagcgaggttttggacttaaaagaacagctagaaaagatgaaaggtgacttagaaagtaaaaatgaagaaatactacatctgaacttaaaattggacatgcagaacagccagactgctgtcagcctcagagaacttgaggaagagaacacgagcttgaaggtcatatataccagaagttctgagattgaagagctgaaagccactattgaaaatctgcaagagaatcagaaacgattacaaaaggagaaagcagaggaaattgaacaactccatgaagtcattgagaagctgcagcacgagctgtccctcatggggcctgtggtgcacgaagtcagcgacagtcaggctggcagtctgcagagcgagctgctctgctcccaggccgggggccctcgtgggcaggccctacagggcgagctcgaggctgcgctggaagccaaggaggccctgagccggctgctggctgaccaggagcgcaggcacagccaggccctggaggccctgcagcagcgcctccagggcgcagaggaggctgcggagctacagctggctgagctggagcgcaatgtagccctcagggaggctgaggtcgaagacatggcctcccggatccaggagttcgaagcggccctgaaagcaaaggaagcgacgattgccgagagaaatttagaaatcgacgctctgaaccagcggaaggcggcccactctgccgagctggaggccgtcctgttggccttggcccgcatccgccgcgccctggagcagcagcccctggcagccggggcggcgcctcccgagctgcagtggctccgagcgcagtgtgcccgcctcagccgccagctgcaggtgctgcaccagcggttcctgaggtgccaggtggagctggacaggcggcaggcccgcagagccacagctcacacacgggtgcccggggcccacccacagcctcgcatggatggtggcgccaaggcccaggtcaccggcgacgtggaggcctcccatgatgctgctttggagccggttgtccctgacccacagggtgatctgcagcctgtcctggtgacgttgaaggatgcacctctctgcaagcaagaaggcgtgatgtcagtgctcaccgtctgccagaggcagctgcagtcggagctgctcttggtgaaaaatgaaatgcgcctgagtctggaggacggcggcaagggtaaagaaaaagtactggaagattgtcagctgccgaaggtcgatctcgtagctcaggtgaaacagcttcaggaaaaactgaaccgtttgctgtattccatgaccttccagaatgtggatgctgccgacaccaaatctctgtggcccatggcctcagcacacctgttggagagcagctggagtgatgattcctgtgacggagaagagcctgacatatcaccccacatagacacatgtgatgccaatacagccacggggggtgtaactgatgttatcaaaaatcaggccatagacgcgtgtgatgccaatacaaccccagggggtgtaactgatgttatcaaaaattgggattccttgataccagatgaaatgccagattctcccattcaagaaaaatcagaatgtcaggacatgtctctttcttcaccgaccagcgtacttggtggctcccgccaccagagccacactgcagaggctgggccccggaagagcccggtcgggatgctggacctgtcttcctggagctcccctgaggtcctcaggaaggactggaccctggagccctggcccagcctccccgtgacaccccactcaggagccctgagcctgtgcagtgccgacacatccctgggggacagggcggacacctcgctgccacagacccaggggccggggctgctttgttccccaggcgtgtctgcagcagcgctggcactgcagtgggccgagtctccgccggctgacgaccaccatgtgcagaggacggctgtggagaaagatgtcgaagattttatcacaacatcctttgattctcaagaaacattaagttcacctcctcctggattagaaggaaaagctgatagaagtgagaaaagtgacggctcgggttttggagcaagactgagcccggggtcaggaggccctgaggctcaaactgctggtcctgtgacccctgcttccatctctggaaggtttcagccgctgccggaagccatgaaggagaaggaagtgcgtccgaagcacgtgaaggctttactgcagatggtgcgtgacgagagccaccagatcctggcgctgtcagaaggccttgcacccccaagcggcgagccacacccaccccggaaggaagacgagatacaggacatctcgctccatgggggaaagacgcaggaagtgcccaccgcgtgccccgattggagaggggaccttctgcaggttgtgcaagaggcctttgaaaaagagcaggagatgcagggggttgagctgcagccccgactcagtggctcagatctggggggtcacagctccctgctcgaaaggctggagaagatcatccgtgagcagggagacctgcaggaaaagtccctggagcatcttcgcttgccggaccggagcagcctgctgtccgagatccaggcgctgcgtgcccagctgcgcatgacgcacctgcagaaccaggagaagctgcagcacttgcgcacggcgctgacaagcgcagaggcgcgcgggagccagcaggagcaccagctgcgcaggcaggttgaactgctggcttataaagtagagcaggagaagtgcattgctggtgacttgcagaagacgctgagtgaagagcaagagaaggcaaacagcgtgcagaagctcctggcggcggagcagactgtagtgcgagatttgaagtccgacctctgtgagagcaggcagaagagcgaacagctgtcccggtccctctgcgaggtgcagcaggaggtcctccagctgagatccatgctgagcagtaaggagaacgagctgaaggccgcgcttcaggagctggagagtgagcaggggaaggggcgtgccctgcagagccagctggaggaggagcagctgcggcacctgcagagggagagccagagtgccaaggccctggaggagctgcgggcgtctttggagacacagcgtgctcagagcagtcgactctgcgtggcactgaaacacgagcagacggccaaggacaacctgcagaaggagctgcgtatcgagcactcacgctgcgaggccttgctggctcaggagcggagccagctctctgagctccagaaggaccttgcggctgagaagagccgcaccctggagctgtcagaggccttgcggcacgagcggctcctgaccgagcagctgagccagaggacacaggaggcttgcgtgcaccaggacacacaggcccatcacgctctgctgcagaagctgaaggaggagaagtcccgggtggtggacttgcaagcgatgcttgaaaaggtgcagcagcaagccctgcattctcagcagcagcttgaggctgaggctcagaagcactgtgaggcgctcaggagagagaaggaggtaagtgccacactgaagtcgacggtggaagccctgcacacccaaaaacgagagctgagatgctctctggagagagagagggagaaaccagcgtggttgcaggcagaattagagcagtcacacccacggttgaaagagcaagaaggacgcaaggctgcgaggaggagcgcggaggccaggcagagcccagcggctgcggagcagtggaggaagtggcagagagacaaggagaagctgcgagaattagaactgcagcgtcagcgtgacttgcataagatcaagcagcttcagcagacagtgagagacctggagtcgaaggacgaggtgcctggcagccgcctccacctaggttctgcccgcagggctgccggctcggatgcggaccacctccgggaacagcagcgagagctggaggcgatgaggcagcggctgctctctgccgcccggcttctcaccagcttcaccagccaggccgtggacaggacagttaatgattggacgtcatccaatgagaaagcagtgatgtctttactgcacacgttggaggagctgaagtctgacttgagcaggcccacctcctcccagaaaaaaatggcagcagagctgcagttccagtttgtggacgtcctgctgaaagacaatgtttccctcacaaaagcgctcagcacggtgacccaggagaagctggagctgagcagagccgtgtctaagcttgagaagttgctgaagcaccatctgcagaagggctgcagcccaagcaggtcggaaaggtctgcttggaagccagacgaaacggctccacagagttccctgaggcgcccagaccccggccggcttccaccagctgccagcgaggaagcacacaccagcaatgtcaagatggaaaaattgtacctgcattacttgagagcagagagctttagaaaagctctgatttatcaaaagaagtatcttttgctgttgattggtggattccaggattctgaacaagaaacactctccatgattgcccatttgggggtatttccttccaaagcagaacggaaaatcacatctcgtcctttcaccaggttccgcacggccgtcagggtggtcattgcaatattaagattacgttttttggttaagaaatggcaagaagtagatcggaaaggagctctggcacaaggcaaagcccctcgcccagggccccgagcacgacagccgcagtctccacccagaaccagagagtcccccccaacccgggatgtaccctctggccacaccagggaccctgccagaggccgcagactggcagcagcagcctccccacacagtgggggaagagccactccatccccaaattcaagattagaaagatccctgactgcttctcaagatccagaacattccttgacagagtatattcaccatttagaagtgatccagcaaagattgggaggggtactaccagattctacttcaaagaaatcctgccacccgatgattaaacagtgaataaaatgtcatggctctttcctgcgacaattctatttgaggaaaagatttgtttttcccttttcccaaggaagctcgtgggacagcatgggcactactcttcatgtgcggtgacaccagcccccagatgccttgaattaagtgtcctcacctttatgcatgactgcaaagccagctggagcattttctatggagcctccgtatgttttaggcccatgaccttcgtgaggtgacgggcactcactcccatgagccctggctgtgtgctgttgtgtgcctatcggcagatccatccttcctgcctccaaggaggatacacagagaatggcttcctgttgttttgtttattttcttaacgtgtacagatggaaacttcatttaaaaataaaaacaaaacaactcaaaaaggaataaaatttaatcactgttttgtttgtgaata

SEQ ID NO: 21890 - DNA, 6820 bp, Homo sapiens
tccggcgggtcacatgactccagtctagctcgcattgcggctcccgcccgggcgagttctcgcccccgcgcggccgttgccgaggagacggcgcatgtcccgccgcgcgttgccccctctgcagtacccccgcccctcttctcccaccacaatgagatcctaagatggcggtggctgcggcggttggcgctgcgtagctgaggtcgaaaaggcggccactggggccgaggcagccaggaaacgtgtgggcctctctgctgcggtctccgagggccgaccgctgccggcggcgggtcgtgggggctgactgtcgctctgcctttgacaggagaggctgcttcttgtagaggaaacagctttgaagtgtggagcgggaaaggagcagtttctgagctgcaaaaactagtttctaaacagagagttaattgttaaatccagtatggccacaggaggaggtccctttgaagatggcatgaatgatcaggatttaccaaactggagtaatgagaatgttgatgacaggctcaacaatatggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcagagaagcattggaagtgattcccaaggtagagcaacagctgctaacaacaaacgtcagcttagtgaaaaccgaaagcccttcaactttttgcctatgcagattaatactaacaagagcaaagatgcatctacaaaccccccaaacagagaaacgattggatcagcacagtgtaaagagttgtttgcttctgctttaagtaatgacctcttgcaaaactgtcaggtgtctgaagaagatgggaggggagaacctgcaatggagagcagccagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgccagagatcctcagcaggagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctgttgttgcagaaactgcaggtagcttatctggcgtcagtatcacatctgaactaaatgaagaattgaatgacttaattcagcgttttcataatcagcttcgtgattctcagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatcttaacaattcatcatcctctccacaaaggagtgtcgatcagagaagtacttcagctccctctgcttctgtaggcttggcaccggttgtcaatggagaatccaatagcctcacatcatctgttccttatcctactgcttctctagtatctcagaatgagagtgaaaacgaaggccacctcaatccatctgaaaaactccagaagttaaatgaagttcgaaagagattgaatgagctaagagaattagttcattattatgaacaaacgtcagacatgatgacagatgctgtgaatgaaaacaggaaagatgaagaaactgaagagtcagaatatgattctgagcatgaaaattccgagcctgttactaacattcgaaatccacaagtagcttccacttggaatgaagtaaatagtcatagtaatgcacagtgtgtttctaataatagagatgggcgaacagttaattctaattgtgaaattaacaacagatctgctgccaacataagggctctaaacatgcctccttctttagattgtcgatataatagagaaggggaacaggagattcatgttgcacaaggtgaagatgatgaggaggaggaggaagaagcagaagaggagggagtcagtggagcttcattatctagtcacaggagcagtctggttgatgagcatccagaagatgctgaatttgaacagaagatcaaccgacttatggctgcaaaacagaaacttagacagttacaagatcttgttgctatggtacaggatgatgatgcagctcaaggagttatctctgccagtgcatcaaatttggatgatttctacccagcagaagaagacaccaagcaaaattcaaataacactagaggaaatgccaataaaacacagaaagatactggagtaaatgaaaaggcaagagagaaattttatgaggctaaactacagcagcaacagagagagctaaaacaattgcaggaagaaagaaagaaactgattgacattcaggagaaaattcaagcattgcaaacggcatgccctgacttacagctgtcagctgctagtgtgggtaactgtcccaccaaaaaatatatgccagctgttacttcaaccccaactgttaatcaacacgagaccagtacaagcaaatctgtttttgagcctgaagattcttcaatagtagataatgagttgtggtcagaaatgagaagacatgaaatgttgagggaggagctgcgacagagaagaaagcagcttgaagctctgatggctgaacatcagaggaggcaaggtctagctgaaactgcatctccagtggctgtgtcattgagaagtgatggatctgagaacctatgtactcctcagcaaagtagaacagaaaaaacgatggcaacttggggagggtctacccagtgtgcactagatgaagaaggagatgaagacggttacctttctgaaggaattgttcggacagatgaagaggaggaagaagagcaagatgccagttccaatgataacttttctgtgtgtccttctaacagtgtgaatcataactcctacaatggaaaggaaactaaaaataggtggaagaacaattgccctttttcggcagatgaaaattatcgtcctttagccaagacaaggcaacagaatatcagcatgcaacggcaagaaaaccttcgttgggtgtcagagctctcttacgtagaagagaaagaacaatggcaagaacaaatcaatcagctaaagaaacagcttgattttagtgtcagtatttgtcagactttgatgcaagaccagcagactctatcttgtctgctacaaactcttctcacgggtccttacagtgttatgcccagcaatgttgcatctcctcaagtacacttcataatgcaccagttgaaccagtgctatactcagctaacatggcaacagaataatgttcagaggttgaaacaaatgctaaatgaacttatgcgccagcaaaatcagcatccagaaaaacctggaggcaaggaaagaggcagtagtgcatcgcaccctccttctcccagtttattttgtcctttcagctttccaacacagcctgtaaatctcttcaatatacctggatttactaacttttcatcatttgcaccaggtatgaatttcagccctttatttccttctaattttggagatttttctcagaatatctctacacccagtgaacagcagcaacccttagcccagaattcttcaggaaaaacagaatatatggcttttccaaaaccttttgaaagcagttcctctattggagcagagaaaccaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcaggtatgaaagtgccagtatgtctagcacatgtgaaccttgcaaaagtaggaacagacattcagcccagactgaagagcctgttcaagcaaaagtattcagcagaaagaatcatgagcaactggaaaaaataataaaatgtaataggtctacagaaatatcttcagaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgaaacttttgagaagaactttgaaagagaaacccataaaataagtgagcaaaatgatgctgataatgctagtgtcctgtctgtatcatcaaattttgagccttttgcaacagatgatctaggtaacaccgtgattcacttagatcaagcattagccagaatgagagaatatgagcgtatgaagactgaggctgaaagtaactcaaatatgagatgcacctgcaggattattgaggatggagatggtgctggtgcaggtactacagttaataatttagaagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggagcacatggatgaagtatgctcctcgcagcttctaacttcagtaaggcgcatggttttgacccttacccagcaaaatgatgagagcaaagagtttgtaaagttctttcataaacaacttggaagtatattacaggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggtcctacaacgtgactttaaaaagacagcagaaagcaaaaatgtcccattggaacgagaagccactagtaaaaatgaccaaaataactgtcctgtgaaaccctgttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatgaagcagaatctggtaatataagtcaaaagtctgatgaagaagattttgtaaaagttgaagatttaccactgaaactgacaatatattcagaggcagatctaagaaagaaaatggtagaagaagaacagaaaaaccatttatctggtgaaatatgtgaaatgcagaccgaagaattagctggaaattctgagacactaaaagaacctgaaacggtgggagcccagagtatatgagatgtcttcagaggctcatctaactctgtccttacatactcaatgcatatatgaaaacaatactaaataaacatctgatctgtataaaaatgtaaattagtttgacactgcttttttgataggtgtggtcatttctccccatggtagtttaaaacatcagaaactgaattctggacagatttaagccttgacacactgtgtttttttttttttcccccttcttttttgggtcttcatttttttccccattgtgatgtttggtaacgaatttaaaatgtagttttaaataaagtttggacttatcta

SEQ ID NO: 21891 - DNA, 8896 bp, Homo sapiens
ctccagtctagctcgcattgcggctcccgcccgggcgagttctcgcccccgcgcggccgttgccgaggagacggcgcatgtcccgccgcgcgttgccccctctgcagtacccccgcccctcttctcccaccacaatgagatcctaagatggcggtggctgcggcggttggcgctgcgtagctgaggtcgaaaaggcggccactggggccgaggcagccaggaaacgtgtgggcctctctgctgcggtctccgagggccgaccgctgccggcggcgggtcgtgggggctgactgtcgctctgcctttgacaggagaggctgcttcttgtagaggaaacagctttgaagtgtggagcgggaaaggagcagtttctgagctgcaaaaactagtttctaaacagagagttaattgttaaatccagtatggccacaggaggaggtccctttgaagatggcatgaatgatcaggatttaccaaactggagtaatgagaatgttgatgacaggctcaacaatatggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcagagaagcattggaagtgattcccaaggtagagcaacagctgctaacaacaaacgtcagcttagtgaaaaccgaaagcccttcaactttttgcctatgcagattaatactaacaagagcaaagatgcatctacaaaccccccaaacagagaaacgattggatcagcacagtgtaaagagttgtttgcttctgctttaagtaatgacctcttgcaaaactgtcaggtgtctgaagaagatgggaggggagaacctgcaatggagagcagccagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgctagagaaaatgaggaggaggatgttcggactatagattcagctgtgggatctggttctgtagctgagagcacatcgctaaacatagatgtgcagtctgaggcttcagataccacggccagagatcctcagcaggagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctgttgttgcagaaactgcaggtagcttatctggcgtcagtatcacatctgaactaaatgaagaattgaatgacttaattcagcgttttcataatcagcttcgtgattctcagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatcttaacaattcatcatcctctccacaaaggagtgtcgatcagagaagtacttcagctccctctgcttctgtaggcttggcaccggttgtcaatggagaatccaatagcctcacatcatctgttccttatcctactgcttctctagtatctcagaatgagagtgaaaacgaaggccacctcaatccatctgaaaaactccagaagttaaatgaagttcgaaagagattgaatgagctaagagaattagttcattattatgaacaaacgtcagacatgatgacagatgctgtgaatgaaaacaggaaagatgaagaaactgaagagtcagaatatgattctgagcatgaaaattccgagcctgttactaacattcgaaatccacaagtagcttccacttggaatgaagtaaatagtcatagtaatgcacagtgtgtttctaataatagagatgggcgaacagttaattctaattgtgaaattaacaacagatctgctgccaacataagggctctaaacatgcctccttctttagattgtcgatataatagagaaggggaacaggagattcatgttgcacaaggtgaagatgatgaggaggaggaggaagaagcagaagaggagggagtcagtggagcttcattatctagtcacaggagcagtctggttgatgagcatccagaagatgctgaatttgaacagaagatcaaccgacttatggctgcaaaacagaaacttagacagttacaagatcttgttgctatggtacaggatgatgatgcagctcaaggagttatctctgccagtgcatcaaatttggatgatttctacccagcagaagaagacaccaagcaaaattcaaataacactagaggaaatgccaataaaacacagaaagatactggagtaaatgaaaaggcaagagagaaattttatgaggctaaactacagcagcaacagagagagctaaaacaattgcaggaagaaagaaagaaactgattgacattcaggagaaaattcaagcattgcaaacggcatgccctgacttacagctgtcagctgctagtgtgggtaactgtcccaccaaaaaatatatgccagctgttacttcaaccccaactgttaatcaacacgagaccagtacaagcaaatctgtttttgagcctgaagattcttcaatagtagataatgagttgtggtcagaaatgagaagacatgaaatgttgagggaggagctgcgacagagaagaaagcagcttgaagctctgatggctgaacatcagaggaggcaaggtctagctgaaactgcatctccagtggctgtgtcattgagaagtgatggatctgagaacctatgtactcctcagcaaagtagaacagaaaaaacgatggcaacttggggagggtctacccagtgtgcactagatgaagaaggagatgaagacggttacctttctgaaggaattgttcggacagatgaagaggaggaagaagagcaagatgccagttccaatgataacttttctgtgtgtccttctaacagtgtgaatcataactcctacaatggaaaggaaactaaaaataggtggaagaacaattgccctttttcggcagatgaaaattatcgtcctttagccaagacaaggcaacagaatatcagcatgcaacggcaagaaaaccttcgttgggtgtcagagctctcttacgtagaagagaaagaacaatggcaagaacaaatcaatcagctaaagaaacagcttgattttagtgtcagtatttgtcagactttgatgcaagaccagcagactctatcttgtctgctacaaactcttctcacgggtccttacagtgttatgcccagcaatgttgcatctcctcaagtacacttcataatgcaccagttgaaccagtgctatactcagctaacatggcaacagaataatgttcagaggttgaaacaaatgctaaatgaacttatgcgccagcaaaatcagcatccagaaaaacctggaggcaaggaaagaggcagtagtgcatcgcaccctccttctcccagtttattttgtcctttcagctttccaacacagcctgtaaatctcttcaatatacctggatttactaacttttcatcatttgcaccaggtatgaatttcagccctttatttccttctaattttggagatttttctcagaatatctctacacccagtgaacagcagcaacccttagcccagaattcttcaggaaaaacagaatatatggcttttccaaaaccttttgaaagcagttcctctattggagcagagaaaccaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcaggtatgaaagtgccagtatgtctagcacatgtgaaccttgcaaaagtaggaacagacattcagcccagactgaagagcctgttcaagcaaaagtattcagcagaaagaatcatgagcaactggaaaaaataataaaatgtaataggtctacagaaatatcttcagaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgaaacttttgagaagaactttgaaagagaaacccataaaataagtgagcaaaatgatgctgataatgctagtgtcctgtctgtatcatcaaattttgagccttttgcaacagatgatctaggtaacaccgtgattcacttagatcaagcattagccagaatgagagaatatgagcgtatgaagactgaggctgaaagtaactcaaatatgagatgcacctgcaggattattgaggatggagatggtgctggtgcaggtactacagttaataatttagaagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggagcacatggatgaagtatgctcctcgcagcttctaacttcagtaaggcgcatggttttgacccttacccagcaaaatgatgagagcaaagagtttgtaaagttctttcataaacaacttggaagtatattacaggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggtcctacaacgtgactttaaaaagacagcagaaagcaaaaatgtcccattggaacgagaagccactagtaaaaatgaccaaaataactgtcctgtgaaaccctgttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatgaagcagaatctggtaatataagtcaaaagtctgatgaagaagattttgtaaaagttgaagatttaccactgaaactgacaatatattcagaggcagatctaagaaagaaaatggtagaagaagaacagaaaaaccatttatctggtgaaatatgtgaaatgcagaccgaagaattagctggaaattctgagacactaaaagaacctgaaacggtgggagcccagagtatatgagatgtcttcagaggctcatctaactctgtccttacatactcaatgcatatatgaaaacaatactaaataaacatctgatctgtataaaaatgtaaattagtttgacactgcttttttgataggtgtggtcatttctccccatggtagtttaaaacatcagaaactgaattctggacagatttaagccttgacacactgtgtttttttttttttcccccttcttttttgggtcttcatttttttccccattgtgatgtttggtaacgaatttaaaatgtagttttaaataaagtttggacttatctataaagtatcttttttggaaattatattgaattctatacagcaagtcaatgttttatataactttaggctgctcagagaagagcaatggttaagagttagttagagaaatatattatttgttataaagcccatccattaggccagtcttccaactaatgccagtgttgctgctgttgggtctgatgttcttcttttagatacctgcaggtcctattcctgtgcaagaatagggcagattatcaagatatccaggatacctatgaagttattatagaatatttattaatccattgaaattggataataagtttagaacataggttctcagtatctagaacttacatcattatcatctgtttgttaggatttgaaattctggaaaatatttatctacatcgcctcagactaaaagtaaaaaaaataagctttatataattagggagatttctgcacagagaagtaacattgtggttaattttaaatgaaaaacttaactttttcaagtggggataaataatacaactaaatttctgtaatagtaagattctgtatgccttcagataaacttgcctattgagatggtaatttaaagccaaagcatagcagtttcttttgtgtgtagtgaggttgaagcagatttgcaggtgaagtattgaaagtttatgtgactttaagtcagcttttgaaaagtgattgatttgctttttatcccaaactgtccatatacccagtaaggcttcaaaaaaccagtcaacaatgagtaagtcaatcttatagattcttcttcctcgaataaaatacaaagaattagttccaataagtattttaactttgttaacaactgaaataccccataaaaaaagaacttgttgagagtatttctttaaaatggttacttgctgcccaggcaccatggctcactcctgtaatcccagcaccttgggaggccgaggcgggcagatcacgaggtcaagagattgagaccatcctgcccaacatgggggaaaccccgtctctactaaaaataaaaaaattagctgggagaggtggcacgtgcctgtagtcctagctacttgggaggctaaggcaggagaatagcctgaacccgggaggtggaggttgcaggttgcagtgagccgagatcatgccactgcactccagcctggcaacagagcgagactctgtctcaaaaaaaaaaaaaaaaaaaaaaaaaagttaacttgctgtatacctcagtgtaatgtccattcaaggagtattaaatgaggatttccctgcgaggacatttactgtattgctacttaaattatggaagacaatatatcttcaactttaataaaacctattcagaaaattaccaattcagaattcggagttcttatccaggtgctctaactaacttcagggaaattggaacaataagttatgttacatgcacactcaaattctttattttctccactttaagcaggaaagggtaaaaactgttttggtactcaagcccagccttacatactgtgtttctctctctgtctgcatgcatattaaagtggaaaaattgtatttatatcttagttattaccatagtacctatgaaccttatcaaaattgcttatttgactggtgttacagctgctattaatctaagtctattgtttttctattttagtagataatttagttttaaaatacgtagggtttgagagcagatatatttatttaatctgttttctctagtaactattgctgaagggttaggcattcagtattcctatttgtcctaattttgaagttaaaaattttggttacagatagatagagggagaaaagttcaaaatgagtgagagagaactttatgcaggttgagataatgcctaaaataatgagctggccagactgtggaggtactctttgtattttgtaacattgactttgggtaaatgctttttcactgttaataaatatatatcctgtat

SEQ ID NO: 21892 - DNA, 2379 bp, Homo sapiens
gaaaagcgtctgcacaggccagcctggcatctaaagataaaactcccaagtcaaaaagtaagaagaggaattctactcagctgaaaagcagagttaaaaacatcaggtatgaaagtgccagtatgtctagcacatgtgaaccttgcaaaagtaggaacagacattcagcccagactgaagagcctgttcaagcaaaagtattcagcagaaagaatcatgagcaactggaaaaaataataaaatgtaataggtctacagaaatatcttcagcacatgctaggagaatactacagcagtctaacagaaatgcatgcaatgaagcgccagaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgaaacttttgagaagaactttgaaagagaaacccataaaataagtgagcaaaatgatgctgataatgctagtgtcctgtctgtatcatcaaattttgagccttttgcaacagatgatctaggtaacaccgtgattcacttagatcaagcattagccagaatgagagaatatgagcgtatgaagactgaggctgaaagtaactcaaatatgagatgcacctgcaggattattgaggatggagatggtgctggtgcaggtactacagttaataatttagaagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggagcacatggatgaagtatgctcctcgcagcttctaacttcagtaaggcgcatggttttgacccttacccagcaaaatgatgagagcaaagagtttgtaaagttctttcataaacaacttggaagtatattacaggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggtcctacaacgtgactttaaaaagacagcagaaagcaaaaatgtcccattggaacgagaagccactagtaaaaatgaccaaaataactgtcctgtgaaaccctgttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatgaagcagaatctggtaatataagtcaaaagtctgatgaagaagattttgtaaaagttgaagatttaccactgaaactgacaatatattcagaggcagatctaagaaagaaaatggtagaagaagaacagaaaaaccatttatctggtgaaatatgtgaaatgcagaccgaagaattagctggaaattctgagacactaaaagaacctgaaacggtgggagcccagagtatatgagatgtcttcagaggctcatctaactctgtccttacatactcaatgcatatatgaaaacaatactaaataaacatctgatctgtat

SEQ ID NO: 21893 - DNA, 2379 bp, Homo sapiens; identical to SEQ ID NO: 21892

SEQ ID NO: 21894 - DNA, 1426 bp, Homo sapiens
gtggctgcggcggttggcgctgcgtagctgaggtcgaaaaggcggccactggggccgaggcagccaggaaacgtgtgggcctctctgctgcggtctccgagggccgaccgctgccggcggcgggtcgtgggggctgactgtcgctctgcctttgacaggagaggctgcttcttgtagagagagttaattgttaaatccagtatggccacaggaggaggtccctttgaagatggcatgaatgatcaggatttaccaaactggagtaatgagaatgttgatgacaggctcaacaatatggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcagagaagcattggaagtgattcccaaggtagagcaacagctgctaacaacaaacgtcagcttagtgaaaaccgaaagcccttcaactttttgcctatgcagattaatactaacaagagcaaagatgcatctacaaaccccccaaacagagaaacgattggatcagcacagtgtaaagagttgtttgcttctgctttaagtaatgacctcttgcaaaactgtcaggtgtctgaagaagatgggaggggagaacctgcaatggagagcagccagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgccagagatcctcagcaggagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctgttgttgcagaaactgcaggtagcttatctggcgtcagtatcacatctgaactaaatgaagaattgaatgacttaattcagcgttttcataatcagcttcgtgattctcagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaa

SEQ ID NO: 21895 - DNA, 2953 bp, Homo sapiens
caggagtgacaggaattgtttctgcctgaggagacactctgcagcctgggctctgtgagactgaggtggcggtcagccggagtgagtgttggggtcctggggcacctgccttacatggcttgtttatgaacattaaagggaagaagttgaagcttgaggagcgaggatggcagtcaacaaaggcctcaccttgctggatggagacctccctgagcaggagaatgtgctgcagcgggtcctgcagctgccggtggtgagtggcacctgcgaatgcttccagaagacctacaccagcactaaggaagcccaccccctggtggcctctgtgtgcaatgcctatgagaagggcgtgcagagcgccagtagcttggctgcctggagcatggagccggtggtccgcaggctgtccacccagttcacagctgccaatgagctggcctgccgaggcttggaccacctggaggaaaagatccccgccctccagtacccccctgaaaagattgcttctgagctgaaggacaccatctccacccgcctccgcagtgccagaaacagcatcagcgttcccatcgcgagcacttcagacaaggtcctgggggccgctttggccgggtgcgagcttgcctggggggtggccagagacactgcggaatttgctgccaacactcgagctggccgactggcttctggaggggccgacttggccttgggcagcattgagaaggtggtggagtacctcctccctccagacaaggaagagtcagcccctgctcctggacaccagcaagcccagaagtctcccaaggccaagccaagcctcttgagcagggttggggctctgaccaacaccctctctcgatacaccgtgcagaccatggcccgggccctggagcagggccacaccgtggccatgtggatcccaggcgtggtgcccctgagcagcctggcccagtggggtgcctcagtggccatgcaggcggtgtcccggcggaggagcgaagtgcgggtaccctggctgcacagcctcgcagccgcccaggaggaggatcatgaggaccagacagacacggagggagaggacacggaggaggaggaagaattggagactgaggagaacaagttcagtgaggtagcagccctgccaggccctcgaggcctcctgggtggtgtggcacataccctgcagaagaccctccagaccaccatctcggctgtgacatgggcacctgcagctgtgctgggcatggcagggagggtgctgcacctcacaccagcccctgctgtctcctcaaccaaggggagggccatgtccctatcagatgccctgaagggcgttactgacaacgtggtggacacagtggtgcattacgtgccgctccccaggctgtcgctgatggagcccgagagcgaattccgggacatcgacaacccaccagccgaggtcgagcgccgggaggcggagcgcagagcgtctggggcgccgtccgccggcccggagcccgccccgcgtctcgcacagccccgccgcagcctgcgcagcgcgcagagccccggcgcgccccccggcccgggcctggaggacgaagtcgccacgcccgcagcgccgcgcccgggcttcccggccgtgccccgcgagaagccaaagcgcagggtcagcgacagcttcttccggcccagcgtcatggagcccatcctgggccgcacgcattacagccagctgcgcaagaagagctgagtcgccgcaccagccgccgcgccccgggccggcgggtttctctaacaaataaacagaacccgcactgcccaggcgagcgttgccactttcaaagtggtcccctggggagctcagcctcatcctgatgatgctgccaaggcgcactttttatttttattttatttttattttttttttagcatccttttggggcttcactctcagagccagtttttaagggacaccagagccgcagcctgctctgattctatggcttggttgttactataagagtaattgcctaacttgatttttcatctctttaaccaaacttgtggccaaaagatatttgaccgtttccaaaattcagattctgcctctgcggataaatatttgccacgaatgagtaactcctgtcaccactctgaaggtccagacagaaggttttgacacattcttagcactgaactcctctgtgatctaggatgatctgttccccctctgatgaacatcctctgatgatctaggctcccagcaggctactttgaagggaacaatcagatgcaaaagctcttgggtgtttatttaaaatactagtgtcactttctgagtacccgccgcttcacaggctgagtccaggcctgtgtgctttgtagagccagctgcttgctcacagccacatttccatttgcatcattactgccttcacctgcatagtcactcttttgatgctggggaaccaaaatggtgatgatatatagactttatgtatagccacagttcatccccaaccctagtcttcgaaatgttaatatttgataaatctagaaaatgcattcatacaattacagaattcaaatattgcaaaaggatgtgtgtctttctccccgagctcccctgttccccttcattgaaaaccaccacggtgccatctcttgtgtatgcagggctatgcacctgcaggcacgtgtgtatgcactccccgcttgtgtttacacaagctgtggggtgttacgcatgcctgcttttttcacttaataatacagcttggagagatttttgtatcacattataaatcccactcgctctttttgatggccacataataactactgcataatatggatacgccttatttgatttaactagttccctaatgatggacttttaagttgtttcctttttttttcttttttgctactgcaaacgatgctataataaatgtccttatcaaaaatg

SEQ ID NO: 21896 - DNA, 2900 bp, Homo sapiens
tggaagcagcattgcccaagcctcccaggagtgacaggaattgtttctgcctgaggagacactctgcagcctgggctctgtgagactgaggtggcggtcagccggacttgaggagcgaggatggcagtcaacaaaggcctcaccttgctggatggagacctccctgagcaggagaatgtgctgcagcgggtcctgcagctgccggtggtgagtggcacctgcgaatgcttccagaagacctacaccagcactaaggaagcccaccccctggtggcctctgtgtgcaatgcctatgagaagggcgtgcagagcgccagtagcttggctgcctggagcatggagccggtggtccgcaggctgtccacccagttcacagctgccaatgagctggcctgccgaggcttggaccacctggaggaaaagatccccgccctccagtacccccctgaaaagattgcttctgagctgaaggacaccatctccacccgcctccgcagtgccagaaacagcatcagcgttcccatcgcgagcacttcagacaaggtcctgggggccgctttggccgggtgcgagcttgcctggggggtggccagagacactgcggaatttgctgccaacactcgagctggccgactggcttctggaggggccgacttggccttgggcagcattgagaaggtggtggagtacctcctccctccagacaaggaagagtcagcccctgctcctggacaccagcaagcccagaagtctcccaaggccaagccaagcctcttgagcagggttggggctctgaccaacaccctctctcgatacaccgtgcagaccatggcccgggccctggagcagggccacaccgtggccatgtggatcccaggcgtggtgcccctgagcagcctggcccagtggggtgcctcagtggccatgcaggcggtgtcccggcggaggagcgaagtgcgggtaccctggctgcacagcctcgcagccgcccaggaggaggatcatgaggaccagacagacacggagggagaggacacggaggaggaggaagaattggagactgaggagaacaagttcagtgaggtagcagccctgccaggccctcgaggcctcctgggtggtgtggcacataccctgcagaagaccctccagaccaccatctcggctgtgacatgggcacctgcagctgtgctgggcatggcagggagggtgctgcacctcacaccagcccctgctgtctcctcaaccaaggggagggccatgtccctatcagatgccctgaagggcgttactgacaacgtggtggacacagtggtgcattacgtgccgctccccaggctgtcgctgatggagcccgagagcgaattccgggacatcgacaacccaccagccgaggtcgagcgccgggaggcggagcgcagagcgtctggggcgccgtccgccggcccggagcccgccccgcgtctcgcacagccccgccgcagcctgcgcagcgcgcagagccccggcgcgccccccggcccgggcctggaggacgaagtcgccacgcccgcagcgccgcgcccgggcttcccggccgtgccccgcgagaagccaaagcgcagggtcagcgacagcttcttccggcccagcgtcatggagcccatcctgggccgcacgcattacagccagctgcgcaagaagagctgagtcgccgcaccagccgccgcgccccgggccggcgggtttctctaacaaataaacagaacccgcactgcccaggcgagcgttgccactttcaaagtggtcccctggggagctcagcctcatcctgatgatgctgccaaggcgcactttttatttttattttatttttattttttttttagcatccttttggggcttcactctcagagccagtttttaagggacaccagagccgcagcctgctctgattctatggcttggttgttactataagagtaattgcctaacttgatttttcatctctttaaccaaacttgtggccaaaagatatttgaccgtttccaaaattcagattctgcctctgcggataaatatttgccacgaatgagtaactcctgtcaccactctgaaggtccagacagaaggttttgacacattcttagcactgaactcctctgtgatctaggatgatctgttccccctctgatgaacatcctctgatgatctaggctcccagcaggctactttgaagggaacaatcagatgcaaaagctcttgggtgtttatttaaaatactagtgtcactttctgagtacccgccgcttcacaggctgagtccaggcctgtgtgctttgtagagccagctgcttgctcacagccacatttccatttgcatcattactgccttcacctgcatagtcactcttttgatgctggggaaccaaaatggtgatgatatatagactttatgtatagccacagttcatccccaaccctagtcttcgaaatgttaatatttgataaatctagaaaatgcattcatacaattacagaattcaaatattgcaaaaggatgtgtgtctttctccccgagctcccctgttccccttcattgaaaaccaccacggtgccatctcttgtgtatgcagggctatgcacctgcaggcacgtgtgtatgcactccccgcttgtgtttacacaagctgtggggtgttacgcatgcctgcttttttcacttaataatacagcttggagagatttttgtatcacattataaatcccactcgctctttttgatggccacataataactactgcataatatggatacgccttatttgatttaactagttccctaatgatggacttttaagttgtttcctttttttttcttttttgctactgcaaacgatgctataataaatgtccttatc

SEQ ID NO: 21897 - DNA, 1972 bp, Homo sapiens
cgtgctgccgcgggtcacgtgctgcggaggcttggggaggggcggcgaggcggggtttatagcccgggcgcccgcgggccccacgctttgaccgggtcgtggcagccggagtcgtcttcgggacgcgcctgctcttcgcctttcgctgcagtccgtcgatttctttctccaggaagaaaaatggcatccgttgcagttgatccacaaccgagtgtggtgactcgggtggtcaacctgcccttggtgagctccacgtatgacctcatgtcctcagcctatctcagtacaaaggaccagtatccctacctgaagtctgtgtgtgagatggcagagaacggtgtgaagaccatcacctccgtggccatgaccagtgctctgcccatcatccagaagctagagccgcaaattgcagttgccaatacctatgcctgtaaggggctagacaggattgaggagagactgcctattctgaatcagccatcaactcagattgttgccaatgccaaaggcgctgtgactggggcaaaagatgctgtgacgactactgtgactggggccaaggattctgtggccagcacgatcacaggggtgatggacaagaccaaaggggcagtgactggcagtgtggagaagaccaagtctgtggtcagtggcagcattaacacagtcttggggagtcggatgatgcagctcgtgagcagtggcgtagaaaatgcactcaccaaatcagagctgttggtagaacagtacctccctctcactgaggaagaactagaaaaagaagcaaaaaaagttgaaggatttgatctggttcagaagccaagttattatgttagactgggatccctgtctaccaagcttcactcccgtgcctaccagcaggctctcagcagggttaaagaagctaagcaaaaaagccaacagaccatttctcagctccattctactgttcacctgattgaatttgccaggaagaatgtgtatagtgccaatcagaaaattcaggatgctcaggataagctctacctctcatgggtagagtggaaaaggagcattggatatgatgatactgatgagtcccactgtgctgagcacattgagtcacgtactcttgcaattgcccgcaacctgactcagcagctccagaccacgtgccacaccctcctgtccaacatccaaggtgtaccacagaacatccaagatcaagccaagcacatgggggtgatggcaggcgacatctactcagtgttccgcaatgctgcctcctttaaagaagtgtctgacagcctcctcacttctagcaaggggcagctgcagaaaatgaaggaatctttagatgacgtgatggattatcttgttaacaacacgcccctcaactggctggtaggtcccttttatcctcagctgactgagtctcagaatgctcaggaccaaggtgcagagatggacaagagcagccaggagacccagcgatctgagcataaaactcattaaacctgcccctatcactagtgcatgctgtggccagacagatgacaccttttgttatgttgaaattaacttgctaggcaaccctaaattgggaagcaagtagctagtataaaggccctcaattgtagttgtttccagctgaattaagagctttaaagtttctggcattagcagatgatttctgttcacctggtaagaaaagaatgataggcttgtcagagcctatagccagaactcagaaaaaattcaaatgcacttatgttctcattctatggccattgtgttgcctctgttactgtttgtattgaataaaaacatcttcatgtgggctggggtagaaactggtgtctgctctggtgtgatctgaaaaggcgtcttcactgctttatctcatgatgcttgcttgtaaaacttgattttagtttttcatttctcaaataggaatactacctttgaattcaataaaattcactgcaggata

SEQ ID NO: 21898 - DNA, 655 bp, Homo sapiens
tttgaccgggtcgtggcagccggagtcgtcttcgggacgcgcctgctcttcgcctttcgctgcagtccgtcgatttctttctccaggaagaaaaatggcatccgttgcagttgatccacaaccgagtgtggtgactcgggtggtcaacctgcccttggtgagctccacgtatgacctcatgtcctcagcctatctcagtacaaaggaccagtatccctacctgaagtctgtgtgtgagatggcagagaacggtgtgaagaccatcacctccgtggccatgaccagtgctctgcccatcatccagaagctagagccgcaaattgcagttgccaatacctatgcctgtaaggggctagacaggattgaggagagactgcctattctgaatcagccatcaactcaggtgagcttgggacaaaagtgctgagacttgacacttcacatgttttcatcttctatctgttaaaacaagctgtacatatcacaaacaggcaaatacttgttttcccaacctggatctggatgtatgtttgaaaaataatggccacttccttacttcctgaactgttgtcaagttgtatctacgaagcagagaagaactagcctcctttggattagaaaacttttagtgtgttgtctatcagtttgtgtcttt

SEQ ID NO: 21899 - DNA, 631 bp, Homo sapiens
ggcagccggagtcgtcttcgggacgcgcctgctcttcgcctttcgctgcagtccgtcgatttctttctccaggaagaaaaatggcatccgttgcagttgatccacaaccgagtgtggtgactcgggtggtcaacctgcccttggtgagctccacgtatgacctcatgtcctcagcctatctcagtacaaaggaccagtatccctacctgaagtctgtgtgtgagatggcagagaacggtgtgaagaccatcacctccgtggccatgaccagtgctctgcccatcatccagaagctagagccgcaaattgcagttgccaatacctatgcctgtaaggggctagacaggattgaggagagactgcctattctgaatcagccatcaactcaggcaaatacttgttttcccaacctggatctggatgtatgtttgaaaaataatggccacttccttacttcctgaactgttgtcaagttgtatctacgaagcagagaagaactagcctcctttggattagaaaacttttagtgtgttgtctatcagtttgtgtctttgctcctataaatgaaattgctgtctcaagtaactgattgtcttgtggtattaaataaatgcagacgtgatatatataa

SEQ ID NO: 21900 - DNA, 1736 bp, Homo sapiens
gtgctgccgcgggtcacgtgctgcggaggcttggggaggggcggcgaggcggggtttatagcccgggcgcccgcgggccccacgctttgaccgggtcgtggcagccggagtcgtcttcgggacgcgcctgctcttcgcctttcgctgcagtccgtcgatttctttctccaggaagaaaaatggcatccgttgcagttgatccacaaccgagtgtggtgactcgggtggtcaacctgcccttggtgagctccacgtatgacctcatgtcctcagcctatctcagtacaaaggaccagtatccctacctgaagtctgtgtgtgagatggcagagaacggtgtgaagaccatcacctccgtggccatgaccagtgctctgcccatcatccagaagctagagccgcaaattgcagttgccaatacctatgcctgtaaggggctagacaggattgaggagagactgcctattctgaatcagccatcaactcagattgttgccaatgccaaaggcgctgtgactggggcaaaagatgctgtgacgactactgtgactggggccaaggattctgtggccagcacgatcacaggggtgatggacaagaccaaaggggcagtgactggcagtgtggagaagaccaagtctgtgaaaaagaagcaaaaaaagttgaaggatttgatctggttcagaagccaactccattctactgttcacctgattgaatttgccaggaagaatgtgtatagtgccaatcagaaaattcaggatgctcaggataagctctacctctcatgggtagagtggaaaaggagcattggatatgatgatactgatgagtcccactgtgctgagcacattgagtcacgtactcttgcaattgcccgcaacctgactcagcagctccagaccacgtgccacaccctcctgtccaacatccaaggtgtaccacagaacatccaagatcaagccaagcacatgggggtgatggcaggcgacatctactcagtgttccgcaatgctgcctcctttaaagaagtgtctgacagcctcctcacttctagcaaggggcagctgcagaaaatgaaggaatctttagatgacgtgatggattatcttgttaacaacacgcccctcaactggctggtaggtcccttttatcctcagctgactgagtctcagaatgctcaggaccaaggtgcagagatggacaagagcagccaggagacccagcgatctgagcataaaactcattaaacctgcccctatcactagtgcatgctgtggccagacagatgacaccttttgttatgttgaaattaacttgctaggcaaccctaaattgggaagcaagtagctagtataaaggccctcaattgtagttgtttccagctgaattaagagctttaaagtttctggcattagcagatgatttctgttcacctggtaagaaaagaatgataggcttgtcagagcctatagccagaactcagaaaaaattcaaatgcacttatgttctcattctatggccattgtgttgcctctgttactgtttgtattgaataaaaacatcttcatgtgggctggggtagaaactggtgtctgctctggtgtgatctgaaaaggcgtcttcactgctttatctcatgatgcttgcttgtaaaacttgattttagtttttcatttctcaaataggaatactacctttgaattcaataaaattcactgcaggatagaccagtt

SEQ ID NO: 21901 - DNA, 623 bp, Homo sapiens
cagaacgttttgtcagaacaattatggctttcttcctgaagtgtgcttggccggaaaagaaagcaggagacctcaagggctaataatctagcagtggctgacactgaaatgatgcatggaagaaaggctaccaagcaagggaggtggagagcagtttgaagcaactggggtaaagtccggagaagaagctggtgagaaagagacaggagccagatgctgaatgacgatttctttctccaggaagaaaaatggcatccgttgcagttgatccacaaccgagtgtggtgactcgggtggtcaacctgcccttggtgagctccacgtatgacctcatgtcctcagcctatctcagtacaaaggaccagtatccctacctgaagtctgtgtgtgagatggcagagaacggtgtgaagaccatcacctccgtggccatgaccagtgctctgcccatcatccagaagctagagccgcaaattgcagttgccaatacctatgcctgtaaggggctagacaggattgaggagagactgcctattctgaatcagccatcaactcagattgttgccaatgccaaaggcgctgtgactggggcaaaagatgctgtgacgactactgtgactggg

SEQ ID NO: 21902 - DNA, 2340 bp, Homo sapiens
tggcgcgggcaatccctcaacctgattggtcccctcgcccgtcactccagtgcgcccccaacctaccacgcagtaaaagccacccccgcctcggcccggacggtttccaagctggttttgaagtcgcggcagctgttcctgggacgtccggttgaccgcgcgtctgctgcagagaccatgtctgccgacggggcagaggctgatggcagcacccaggtgacagtggaagaaccggtacagcagcccagtgtggtggaccgtgtggccagcatgcctctgatcagctccacctgcgacatggtgtccgcagcctatgcctccaccaaggagagctacccgcacatcaagactgtctgcgacgcagcagagaagggagtgaggaccctcacggcggctgctgtcagcggggctcagccgatcctctccaagctggagccccagattgcatcagccagcgaatacgcccacagggggctggacaagttggaggagaacctccccatcctgcagcagcccacggagaaggtcctggcggacaccaaggagcttgtgtcgtctaaggtgtcgggggcccaagagatggtgtctagcgccaaggacacggtggccacccaattgtcggaggcggtggacgcgacccgcggtgctgtgcagagcggcgtggacaagacaaagtccgtagtgaccggcggcgtccaatcggtcatgggctcccgcttgggccagatggtgttgagtggggtcgacacggtgctggggaagtcggaggagtgggcggacaaccacctgccccttacggatgccgaactggcccgcatcgccacatccctggatggctttgacgtcgcgtccgtgcagcagcagcggcaggaacagagctacttcgtacgtctgggctccctgtcggagaggctgcggcagcacgcctatgagcactcgctgggcaagcttcgagccaccaagcagagggcacaggaggctctgctgcagctgtcgcaggtcctaagcctgatggaaactgtcaagcaaggcgttgatcagaagctggtggaaggccaggagaagctgcaccagatgtggctcagctggaaccagaagcagctccagggccccgagaaggagccgcccaagccagagcaggtcgagtcccgggcgctcaccatgttccgggacattgcccagcaactgcaggccacctgtacctccctggggtccagcattcagggcctccccaccaatgtgaaggaccaggtgcagcaggcccgccgccaggtggaggacctccaggccacgttttccagcatccactccttccaggacctgtccagcagcattctggcccagagccgtgagcgtgtcgccagcgcccgcgaggccctggaccacatggtggaatatgtggcccagaacacacctgtcacgtggctcgtgggaccctttgcccctggaatcactgagaaagccccggaggagaagaagtagggggagaggagaggactcagcgggccccgtctctataatgcagctgtgctctggagtcctcaacccggggctcatttcaaacttattttctagccactcctcccagctcttctgtgctgtccacttgggaagctaaggctctcaaaacgggcatcacccagttgacccatctctcagcctctctgagcttggaagaagcctgttctgagcctcaccctatcagtcagtagagagagatgtccagaaaaaatatctttcaggaaagttctcccctgcagaattttttttccttgttaaatatcaggaatataggccgggtgcggtggctcacacctgtaatcccagcactttgggaggctgaggcgggcggaacacctgaggtcaggtgttcgagaccagccaggccaacatggtgaaaccccgtctctactaaaaatacaaaaaaaaatgagccgggcatggtagcaggtgtctgttatcccagttaggaggctgaggcaagagaatctcttgaacctgagaggcggaggttgcagtgagccaagatcgcgccattgcactccagcctgggggacaagagtgagacttagtctcaaaaaaaaaaaaaaagaaaaaaaaatcagggatatagttcatatcccacttctttgtttacaccgatgtccctgaatatcagcctgtagctaatggacttgggatttctggtctaagtgggcctcctggggatggggtggtacactgagcttctgagcctcattgtagagtagaaaggtactggggcctgtgtggtaagccttgttgaaatgctctggtattcagtattgccttaataaacttcacccacaactgcatacaggc

SEQ ID NO: 21903 - DNA, 2154 bp, Homo sapiens
ttttgaagtcgcggcagctgttcctgggacgtccggttgaccgcgcgtctgctgcagagaccatgtctgccgacggggcagaggctgatggcagcacccaggtgacagtggaagaaccggtacagcagcccagtgtggtggaccgtgtggccagcatgcctctgatcagctccacctgcgacatggtgtccgcagcctatgcctccaccaaggagagctacccgcacatcaagactgtctgcgacgcagcagagaagggagtgaggaccctcacggcggctgctgtcagcggggctcagccgatcctctccaagctggagccccagattgcatcagccagcgaatacgcccacagggggctggacaagttggaggagaacctccccatcctgcagcagcccacggagaaggtgtcgggggcccaagagatggtgtctagcgccaaggacacggtggccacccaattgtcggaggcggtggacgcgacccgcggtgctgtgcagagcggcgtggacaagacaaagtccgtagtgaccggcggcgtccaatcggtcatgggctcccgcttgggccagatggtgttgagtggggtcgacacggtgctggggaagtcggaggagtgggcggacaaccacctgccccttacggatgccgaactggcccgcatcgccacatccctggatggctttgacgtcgcgtccgtgcagcagcagcggcaggaacagagctacttcgtacgtctgggctccctgtcggagaggctgcggcagcacgcctatgagcactcgctgggcaagcttcgagccaccaagcagagggcacaggaggctctgctgcagctgtcgcaggtcctaagcctgatggaaactgtcaagcaaggcgttgatcagaagctggtggaaggccaggagaagctgcaccagatgtggctcagctggaaccagaagcagctccagggccccgagaaggagccgcccaagccagagcaggtcgagtcccgggcgctcaccatgttccgggacattgcccagcaactgcaggccacctgtacctccctggggtccagcattcagggcctccccaccaatgtgaaggaccaggtgcagcaggcccgccgccaggtggaggacctccaggccacgttttccagcatccactccttccaggacctgtccagcagcattctggcccagagccgtgagcgtgtcgccagcgcccgcgaggccctggaccacatggtggaatatgtggcccagaacacacctgtcacgtggctcgtgggaccctttgcccctggaatcactgagaaagccccggaggagaagaagtagggggagaggagaggactcagcgggccccgtctctataatgcagctgtgctctggagtcctcaacccggggctcatttcaaacttattttctagccactcctcccagctcttctgtgctgtccacttgggaagctaaggctctcaaaacgggcatcacccagttgacccatctctcagcctctctgagcttggaagaagcctgttctgagcctcaccctatcagtcagtagagagagatgtccagaaaaaatatctttcaggaaagttctcccctgcagaattttttttccttgttaaatatcaggaatataggccgggtgcggtggctcacacctgtaatcccagcactttgggaggctgaggcgggcggaacacctgaggtcaggtgttcgagaccagccaggccaacatggtgaaaccccgtctctactaaaaatacaaaaaaaaatgagccgggcatggtagcaggtgtctgttatcccagttaggaggctgaggcaagagaatctcttgaacctgagaggcggaggttgcagtgagccaagatcgcgccattgcactccagcctgggggacaagagtgagacttagtctcaaaaaaaaaaaaaaagaaaaaaaaatcagggatatagttcatatcccacttctttgtttacaccgatgtccctgaatatcagcctgtagctaatggacttgggatttctggtctaagtgggcctcctggggatggggtggtacactgagcttctgagcctcattgtagagtagaaaggtactggggcctgtgtggtaagccttgttgaaatgctctggtattcagtatt

SEQ ID NO: 21904 - DNA, 2439 bp, Homo sapiens
gacagctggtgtctgaagccgctcgcgcccagggtgaccctgtttgcagcacgatgtctgaagaagaggcggctcagatccccagatccagtgtgtgggagcaggaccagcagaacgtggtgcagcgtgtggtggctctgcccctggtcagggccacgtgcaccgcggtctgcgatgtttacagtgcagccaaggacaggcacccgctgctgggctccgcctgccgcctggctgagaactgcgtgtgcggcctgaccacccgtgccctggaccacgcccagccgctgctcgagcacctgcagccccagctggccactatgaacagcctcgcctgcaggggcctggacaagctggaagagaagcttccctttctccagcaaccttcggagacggtggtgacctcagccaaggacgtggtggccagcagtgtcacgggtgtggtggacctggcccggaggggccggcgctggagcgtggagctgaagcgctccgtgagccatgctgtggatgttgtactggaaaaatcagaggagctggtggatcacttcctgcccatgacggaggaagagctcgcggcactggcggctgaggctgaaggccctgaagtgggttcggtggaggatcagaggagacagcagggctactttgtgcgcctcggctccctgtcagcacggatccgccacctggcctacgagcactctgtggggaaactgaggcagagcaaacaccgtgcccaggacaccctggcccagctgcaggagacgctggagctgatagaccacatgcagtgtggggtgacccccaccgccccggcctgccctgggaaggtgcacgagctgtggggggaatggggccagcgccctccggagagccgccgccggagccaggcagagctggagacgctggtgctgtcccgcagcctgacccaggagctgcagggcacggtagaggctctggagtccagcgtgcggggcctgcccgccggcgcccaggagaaggtggctgaggtgcggcgcagtgtggatgccctgcagaccgccttcgctgatgcccgctgcttcagggacgtgccagcggccgcgctggccgagggccggggtcgcgtggcccacgcgcacgcctgcgtggacgagctgctggagctggtggtgcaggccgtgccgctgccctggctggtgggacccttcgcgcccatccttgtggagcgacccgagcccctgcccgacctggcggacctggtggacgaggtcatcgggggccctgacccccgctgggcgcacctggactggccggcccagcagagagcctgggaggcagagcacagggacgggagtgggaatggggatggggacaggatgggtgttgccggggacatctgcgagcaggaacccgagacccccagctgcccggtcaagcacaccctgatgcccgagctggacttctgacccatgggccagtggaggcggggaggaaaggccacctgcacaccccgatccctgctgccccctggtggccacacgtaagctcgaggccttggccttgacccttctttggaatcaggcccaactccggatctctgaccacctttttggtattggactctcccattttttccttgaacacatggacaaagaggcccgggggagcagggcctcgaaccctattcaggccaacttgagccacaagctgggttcttcacctatgtcctgctccctggctccatgaagcgaatccaaatctttccaagaggctgggcacagtggctcacgcctgtaatcccagcactttgggagtctgaggcaggtggatcatctgaagtcaggagttcgggatcatcctggccaacatgatgaaaccctgtctctacttagaaagaaagaaaaaaaaaaaaaaagccaggtgtggtggtgtgcacctgtagtcccagctagttgtgaggctgacgcagaagaattgcttaaacccgagaggcgcggagcttgcagtgagcagagatcgcgccactgcacaccagcctgggtgacagagcgagactccatctaacaaaaaataatagtaacagcctcccgaagaaatacacattttgcccaatgccttctgtttggggctttgaaaagtgagccctgactgggtgtggtggttgacacctgttatcacagcactttgggaggccaaggtgggaggactgcttgagcccaggagttggaggctgcagtgagccatgatcttgcccctgcgctctcgcctgggtgacagagcaagactctatctcaaaaatgtttttaaaaaatacttcctagggaaacacacattttgccctatttggaactttgaaaagtgagccctcctctgcccatgggccgtgctgctcagcctgccatactcgcttgctttgctgtttgggatttgcctccagaataaaggtcctttttgttgttg

SEQ ID NO: 21905 - DNA, 6385 bp, Homo sapiens
gtaaccgccgccggcgcgcgggcctcgggcaggtcggggtcccagcgccggctcgggcagcggaggcgccgccggaagttccttgggctgctggactcctcggcttgaaacggcgccggcgtgggggcgtgtgcccttggccctgtcccaggtggagagtggtcgagccgcgcgcagggtgcgctcgtttgaactgcggtgacaccgagggttggggactcgaacccccgcttcgcagctcaggagcctgaggtccgaaagcttcgttccagagcccagcatgaatggatacgcggaatttccgcccagccccagtaaccccaccaaggagcccgtggagccccagcccagccaggtcccactgcaggaagatgtggacatgagcagtggctccagtggacatgagaccaacgaaaactgctccacggggcgggactcgcagggcagtgactgtgacgacagtgggaaggagctggggatgctggtggagccaccggatgcccgccagagtccagatacctttagcctgatgatggcaaaatctgaacacaacccatctacaagtggctgcagtagcgaccagtcttcgaaagtggacacacacaaagaactgataaaaacactaaaggagctgaaggtccacctccctgcagacaagaaggccaagggcaaggccagtacgctggccaccttgaagtacgccctcaggagcgtgaagcaggtgaaagccaatgaagagtattaccagctgctgatgtccagcgagggtcacccctgtggagcagacgtgccctcctacaccgtggaggagatggagagcgttacctctgagcacattgtgaagaatgccgatatgtttgcggtggccgtgtccctggtgtctgggaagatcctgtacatctctgaccaggttgcatccatatttcactgtaaaagagatgccttcagcgatgccaagtttgtggagttcctggcgcctcacgatgtgggcgtgttccacagtttcacctccccgtacaagcttcccttgtggagcatgtgcagtggagcagattcttttactcaagaatgcatggaggagaaatctttcttttgccgtgtcagtgtccggaaaagccacgagaatgaaatccgctaccaccccttccgcatgacgccctacctggtcaaggtgcgggaccaacaaggtgctgagagtcagctttgctgccttctgctggcagagagagtgcactctggttatgaagcccctagaattcctcctgaaaagagaatttttacaaccacccatacaccaaattgtttgttccaggatgtggatgaaagggcggtccctctcctgggctacctacctcaggacctgattgaaaccccagtgctcgtgcagctccaccctagtgacaggcccttgatgctggccatccacaaaaagatcctgcagtcaggcgggcagcctttcgactattctcccattcggtttcgcgcccggaacggagagtacatcacgttggacaccagctggtccagcttcatcaacccatggagcaggaaaatctccttcatcattgggaggcacaaagtcagggtgggccctttgaatgaggacgtgtttgcagcccacccctgcacagaggagaaggccctgcaccccagcattcaggagctcacagagcagatccaccggctcctgctgcagcccgtcccccacagcggctccagtggctacgggagtctgggcagcaacgggtcccacgagcaccttatgagccagacctcctccagcgacagcaacggccatgaggactcacgccggaggagagccgaaatttgtaaaaatggtaacaagaccaaaaatagaagtcattattctcatgaatctggagaacaaaagaaaaaatccgttacagaaatgcaaactaatcccccagctgagaagaaagctgtccctgccatggaaaaggacagcctgggggtcagcttccccgaggagttggcctgcaagaaccagcccacctgctcctaccagcagatcagctgcttggacagcgtcatcaggtacttggagagctgcaatgaggctgccaccctgaagaggaaatgcgagttcccagcaaacgtcccagcgctaaggtccagtgataagcggaaggccacagtcagcccagggccacacgctggagaggcagagccgccctccagggtgaacagccgcacgggagtaggtacgcacctgacctcgctggcactgccgggcaaggcagagagtgtggcgtcgctcaccagccagtgcagctacagcagcaccatcgtccatgtgggagacaagaagccgcagccggagttagagatggtggaagatgctgcgagtgggccagaatccctggactgcctggcgggccctgccctggcctgtggtctcagccaagagaaggagcccttcaagaagctgggcctcaccaaggaggtactcgctgcacacacacagaaggaggagcagagcttcctgcagaagttcaaagaaataagaaaactcagcattttccagtcccactgccattactacttgcaagaaagatccaaggggcagccaagtgaacgaactgcccctggactaagaaatacttccggaatagattcaccttggaaaaaaacaggaaagaacagaaaattgaagtccaagcgggtcaaacctcgagactcatctgagagcaccggatctggggggcccgtgtccgcccggcccccgctggtgggcttgaacgccacagcctggtcaccctcagacacgtcccagtccagctgcccagccgtgccctttcccgccccagtgccagcagcttattcactgcccgtgtttccagcgccagggactgtggcagcacccccggcacctccccacgccagcttcacagtgcctgctgtgcccgtggacctccagcaccagtttgcagtccagcccccacctttccctgcccctttggcgcctgtcatggcattcatgctacccagttattccttcccctcggggaccccaaacctgccccaggccttcttccccagccagcctcagtttccgagccaccccacactcacatccgagatggcctctgcctcacagcctgagttccccagccggacctcgatccccagacagccatgtgcttgtccagccacccgggccaccccaccatcggccatgggtagggcctccccaccgctctttcagtcccgcagcagctcgcccctgcagctcaacctgctgcagctggaggaagcccctgagggtggcactggagccatggggaccacaggggccacagagacagcagctgtaggggcggactgcaaacctggcacttctcgggaccagcagccgaaggcgcctctgacccgtgatgaaccctcagacacacagaacagtgacgccctttccacgtcaagcggcctcctaaacctcctgctgaatgaggacctctgctcagcctcgggctctgctgcttcggagtctctgggctccggctcactgggctgcgacgcctccccgagtggggcaggcagtagtgacacaagtcataccagcaaatattttggaagcattgactcctcagagaataatcacaaagcaaaaatgaacactggtatggaagaaagtgagcatttcattaagtgcgtcctgcaggatcccatctggctgctgatggcagatgcggacagcagcgtcatgatgacgtaccagctgccttcccgaaatttagaagcggttttgaaggaggacagagagaagctgaagctcctacagaaactccagcccaggttcacggagagtcagaagcaggagctgcgcgaggtccaccagtggatgcagacgggcggcctgcccgcagccatcgacgtggcagaatgtgtttactgtgaaaacaaggaaaaaggtaatatttgcataccatatgaggaagatattccttctctgggactcagcgaagtgtcggacaccaaagaagacgaaaatggatcccccttgaatcacaggatcgaagagcagacgtaacccctgccccacctcagcccggcagccagcgaggtacaccaggtggtgcttggaagagatgaaagatcttcatggctgtttccactgaaatggacacatatgctcatgttgctttttttgttttagaaaaaaaaacaacatagttttctgaaggggcgacttaaaactgtggagagtggggagagttcggaaagaaatatgtttttatatataaaatatatatgtggagttttgtgggatggggaagagattttagttgttatttaacttgagaaagactaagcgcctcttagtgtcagggaagttgcctcagtgctcccagaagtcctgtgactgtgacgagacctctgtctgctgcaccagctggggactctggcttccagagctttcccagggtgtttggatcagatcaaattttgtcctctcttggggactgctttttatctgaattatcatttagtcaaggtagagtgtttttttatacataccaaatggagatagcagcctctcctagttttatttcaaaacgtttcacattaaatggtgtgaagcgttgtttggcaaaccaacagctttggcttctggtgtggtcaatatttcagtctgacataggttttgtttgtagtgaacaaagttgaaacatttgctctggactaaagaagcctagtggtttgtgtggccaactccatcggatgaatgcacacgcagacagaccctctgtatatttctgcattattcttgtctccttttcagaccatgatggccaatatggagattaaaatatgtcatcagtcatctctttatggtgacttccctttgcaaaccaggctgtgaccaacacatgtgagacccagtcctgtttggttttcttccgttggaaccacccagacatctgcttccacccagccaagcccacatcacatctcctggccgagagcagccactgccactcagtctgacagcttgcgactgcatctgtattttcaggggtgcagtgagctcacctctcccactgcaccctgggttgggtgcacagccctcattcttttcatgagcccgacctctctcggagcagcttcaggcctctgccagtgtccccagcacttttaggtcatttggacacttggggaaaagtgaggccagtctgcccggctttttacaaaacctcatgttgcattgtatattccaaagatggttcagaaaatttaatattggtccctggtggaaattcaaagttatcactgaagaacagttgacttaaaattggaccaagactatgaggcttaaaagggaccagggttttcttttttttttttttttttttttttttttagatggagtttctttttgcccaggctggagtgcagtggcgccatcttggctcactgcaacctctgcctcccaggttcaagcgattctcctgcctcagcctcctgagtagctgggaccacaggcgactgccaccacacccagctaattttttgtatttttagtagagacagggtttcaccatgttggccaggctggtctcgaactcctgacctcaagcgatccacccacctcggcctcccaaagtgctgggattacaggcgtgagccaccacgcccaactgggaccagggttttctgttttttgatggaggtgaaatctctttgtaatccactaggttttcatcgtaaaaccatcttatgcctgactattaaacctattcttcataaacacaagaacactttaatttttcgttaatttacaaagtaacatcagctgcctatgcctatgataaggtagcagtctgcattcttatggccattagatgttacaaactccttgcctctaaagtcagatcatgaagggataggtgttcatctaaggttacagttatgttaccgaaacacaaaactgccaaaatcttactctgctgttatgaatgtttaccatcagcattattttatcatttaatatgtgctcactgattgttaactgtagcttcagcgcgtgccaagcagttgacttaataggatcatcttgtgaatttgtttacgtgatgccaagcatcaagtcatgttttctttagtgtgtgtgcttacacaggtgttaaacagtttttctctattttaaactgagccttctttttaatatattcccgaagagatatgtaaataagctctcagagtttctgtgatgatttgttgagccttgctggacaagtggtttgtttgtgtgcaaaccaaactttctttacccagtgcaatagatttgtttgactgcttgtgtctttttatgacctgtttgccttttagaaaattggtaaataaagcaagtatatttttattttta

SEQ ID NO: 21906 - DNA, 6235 bp, Homo sapiens
agcgccggctcgggcagcggaggcgccgccggaagttccttgggctgctggactcctcggcttgaaacggcgccggcgtgggggcgtgtgcccttggccctgtcccaggtggagagtggtcgagccgcgcgcagggtgcgctcgtttgaactgcggtgacaccgagggttggggactcgaacccccgcttcgcagctcaggagcctgaggtccgaaagcttcgttccagagcccagcatgaatggatacgcggaatttccgcccagccccagtaaccccaccaaggagcccgtggagccccagcccagccaggtcccactgcaggaagatgtggacatgagcagtggctccagtggacatgagaccaacgaaaactgctccacggggcgggactcgcagggcagtgactgtgacgacagtgggaaggagctggggatgctggtggagccaccggatgcccgccagagtccagatacctttagcctgatgatggcaaaatctgaacacaacccatctacaagtggctgcagtagcgaccagtcttcgaaagtggacacacacaaagaactgataaaaacactaaaggagctgaaggtccacctccctgcagacaagaaggccaagggcaaggccagtacgctggccaccttgaagtacgccctcaggagcgtgaagcaggtgaaagccaatgaagagtattaccagctgctgatgtccagcgagggtcacccctgtggagcagacgtgccctcctacaccgtggaggagatggagagcgttacctctgagcacattgtgaagaatgccgatatgtttgcggtggccgtgtccctggtgtctgggaagatcctgtacatctctgaccaggttgcatccatatttcactgtaaaagagatgccttcagcgatgccaagtttgtggagttcctggcgcctcacgatgtgggcgtgttccacagtttcacctccccgtacaagcttcccttgtggagcatgtgcagtggagcagattcttttactcaagaatgcatggaggagaaatctttcttttgccgtgtcagtgtccggaaaagccacgagaatgaaatccgctaccaccccttccgcatgacgccctacctggtcaaggtgcgggaccaacaaggtgctgagagtcagctttgctgccttctgctggcagagagagtgcactctggttatgaagcccctagaattcctcctgaaaagagaatttttacaaccacccatacaccaaattgtttgttccaggatgtggatgaaagtcctgcagtcaggcgggcagcctttcgactattctcccattcggtttcgcgcccggaacggagagtacatcacgttggacaccagctggtccagcttcatcaacccatggagcaggaaaatctccttcatcattgggaggcacaaagtcagggtgggccctttgaatgaggacgtgtttgcagcccacccctgcacagaggagaaggccctgcaccccagcattcaggagctcacagagcagatccaccggctcctgctgcagcccgtcccccacagcggctccagtggctacgggagtctgggcagcaacgggtcccacgagcaccttatgagccagacctcctccagcgacagcaacggccatgaggactcacgccggaggagagccgaaatttgtaaaaatggtaacaagaccaaaaatagaagtcattattctcatgaatctggagaacaaaagaaaaaatccgttacagaaatgcaaactaatcccccagctgagaagaaagctgtccctgccatggaaaaggacagcctgggggtcagcttccccgaggagttggcctgcaagaaccagcccacctgctcctaccagcagatcagctgcttggacagcgtcatcaggtacttggagagctgcaatgaggctgccaccctgaagaggaaatgcgagttcccagcaaacgtcccagcgctaaggtccagtgataagcggaaggccacagtcagcccagggccacacgctggagaggcagagccgccctccagggtgaacagccgcacgggagtaggtacgcacctgacctcgctggcactgccgggcaaggcagagagtgtggcgtcgctcaccagccagtgcagctacagcagcaccatcgtccatgtgggagacaagaagccgcagccggagttagagatggtggaagatgctgcgagtgggccagaatccctggactgcctggcgggccctgccctggcctgtggtctcagccaagagaaggagcccttcaagaagctgggcctcaccaaggaggtactcgctgcacacacacagaaggaggagcagagcttcctgcagaagttcaaagaaataagaaaactcagcattttccagtcccactgccattactacttgcaagaaagatccaaggggcagccaagtgaacgaactgcccctggactaagaaatacttccggaatagattcaccttggaaaaaaacaggaaagaacagaaaattgaagtccaagcgggtcaaacctcgagactcatctgagagcaccggatctggggggcccgtgtccgcccggcccccgctggtgggcttgaacgccacagcctggtcaccctcagacacgtcccagtccagctgcccagccgtgccctttcccgccccagtgccagcagcttattcactgcccgtgtttccagcgccagggactgtggcagcacccccggcacctccccacgccagcttcacagtgcctgctgtgcccgtggacctccagcaccagtttgcagtccagcccccacctttccctgcccctttggcgcctgtcatggcattcatgctacccagttattccttcccctcggggaccccaaacctgccccaggccttcttccccagccagcctcagtttccgagccaccccacactcacatccgagatggcctctgcctcacagcctgagttccccagccggacctcgatccccagacagccatgtgcttgtccagccacccgggccaccccaccatcggccatgggtagggcctccccaccgctctttcagtcccgcagcagctcgcccctgcagctcaacctgctgcagctggaggaagcccctgagggtggcactggagccatggggaccacaggggccacagagacagcagctgtaggggcggactgcaaacctggcacttctcgggaccagcagccgaaggcgcctctgacccgtgatgaaccctcagacacacagaacagtgacgccctttccacgtcaagcggcctcctaaacctcctgctgaatgaggacctctgctcagcctcgggctctgctgcttcggagtctctgggctccggctcactgggctgcgacgcctccccgagtggggcaggcagtagtgacacaagtcataccagcaaatattttggaagcattgactcctcagagaataatcacaaagcaaaaatgaacactggtatggaagaaagtgagcatttcattaagtgcgtcctgcaggatcccatctggctgctgatggcagatgcggacagcagcgtcatgatgacgtaccagctgccttcccgaaatttagaagcggttttgaaggaggacagagagaagctgaagctcctacagaaactccagcccaggttcacggagagtcagaagcaggagctgcgcgaggtccaccagtggatgcagacgggcggcctgcccgcagccatcgacgtggcagaatgtgtttactgtgaaaacaaggaaaaaggtaatatttgcataccatatgaggaagatattccttctctgggactcagcgaagtgtcggacaccaaagaagacgaaaatggatcccccttgaatcacaggatcgaagagcagacgtaacccctgccccacctcagcccggcagccagcgaggtacaccaggtggtgcttggaagagatgaaagatcttcatggctgtttccactgaaatggacacatatgctcatgttgctttttttgttttagaaaaaaaaacaacatagttttctgaaggggcgacttaaaactgtggagagtggggagagttcggaaagaaatatgtttttatatataaaatatatatgtggagttttgtgggatggggaagagattttagttgttatttaacttgagaaagactaagcgcctcttagtgtcagggaagttgcctcagtgctcccagaagtcctgtgactgtgacgagacctctgtctgctgcaccagctggggactctggcttccagagctttcccagggtgtttggatcagatcaaattttgtcctctcttggggactgctttttatctgaattatcatttagtcaaggtagagtgtttttttatacataccaaatggagatagcagcctctcctagttttatttcaaaacgtttcacattaaatggtgtgaagcgttgtttggcaaaccaacagctttggcttctggtgtggtcaatatttcagtctgacataggttttgtttgtagtgaacaaagttgaaacatttgctctggactaaagaagcctagtggtttgtgtggccaactccatcggatgaatgcacacgcagacagaccctctgtatatttctgcattattcttgtctccttttcagaccatgatggccaatatggagattaaaatatgtcatcagtcatctctttatggtgacttccctttgcaaaccaggctgtgaccaacacatgtgagacccagtcctgtttggttttcttccgttggaaccacccagacatctgcttccacccagccaagcccacatcacatctcctggccgagagcagccactgccactcagtctgacagcttgcgactgcatctgtattttcaggggtgcagtgagctcacctctcccactgcaccctgggttgggtgcacagccctcattcttttcatgagcccgacctctctcggagcagcttcaggcctctgccagtgtccccagcacttttaggtcatttggacacttggggaaaagtgaggccagtctgcccggctttttacaaaacctcatgttgcattgtatattccaaagatggttcagaaaatttaatattggtccctggtggaaattcaaagttatcactgaagaacagttgacttaaaattggaccaagactatgaggcttaaaagggaccagggttttcttttttttttttttttttttttttttttagatggagtttctttttgcccaggctggagtgcagtggcgccatcttggctcactgcaacctctgcctcccaggttcaagcgattctcctgcctcagcctcctgagtagctgggaccacaggcgactgccaccacacccagctaattttttgtatttttagtagagacagggtttcaccatgttggccaggctggtctcgaactcctgacctcaagcgatccacccacctcggcctcccaaagtgctgggattacaggcgtgagccaccacgcccaactgggaccagggttttctgttttttgatggaggtgaaatctctttgtaatccactaggttttcatcgtaaaaccatcttatgcctgactattaaacctattcttcataaacacaagaacactttaatttttcgttaatttacaaagtaacatcagctgcctatgcctatgataaggtagcagtctgcattcttatggccattagatgttacaaactccttgcctctaaagtcagatcatgaagggataggtgttcatctaaggttacagttatgttaccgaaacacaaaactgccaaaatcttactctgctgttatgaatgtttaccatcagcattattttatcatttaatatgtgctcactgattgttaactgtagcttcagcgcgtgccaagcagttgacttaataggatcatcttgtgaatttgtttacgtgatgccaagcatcaagtcatgttttctttagtgtgtgtgcttacacaggtgttaaacagtttttctctattttaaactgagccttctttttaatatattcccgaagagatatgtaaataagctctcagagtttctgtgatgatttgttgagccttgctggacaagtggtttgtttgtgtgcaaaccaaactttctttacccagtgcaatagatttgtttgactgcttgtgtctttttatgacctgtttgccttttagaaaattggtaaataaagcaagtatatttttattttta

SEQ ID NO: 21907 - DNA, 1228 bp, Homo sapiens
atgaatggatacgcggaatttccgcccagccccagtaaccccaccaaggagcccgtggagccccagcccagccaggtcccactgcaggaagatgtggacatgagcagtggctccagtggacatgagaccaacgaaaactgctccacggggcgggactcgcagggcagtgactgtgacgacagtgggaaggagctggggatgctggtggagccaccggatgcccgccagagtccagatacctttagcctgatgatggcaaaatctgaacacaacccatctacaagtggctgcagtagcgaccagtcttcgaaagtggacacacacaaagaactgataaaaacactaaaggagctgaaggtccacctccctgcagacaagaaggccaagggcaaggccagtacgctggccaccttgaagtacgccctcaggagcgtgaagcaggtgaaagccaatgaagagtattaccagctgctgatgtccagcgagggtcacccctgtggagcagacgtgccctcctacaccgtggaggagatggagagcgttacctctgagcacattgtgaagaatgccgatatgtttgcggtggccgtgtccctggtgtctgggaagatcctgtacatctctgaccaggttgcatccatatttcactgtaaaagagatgccttcagcgatgccaagtttgtggagttcctggcgcctcacgatgtgggcgtgttccacagtttcacctccccgtacaagcttcccttgtggagcatgtgcagtggagcagattcttttactcaagaatgcatggaggagaaatctttcttttgccgtgtcagtgtccggaaaagccacgagaatgaaatccgctaccaccccttccgcatgacgccctacctggtcaaggtgcgggaccaacaaggtgctgagagtcagctttgctgccttctgctggcagagagagtgcactctggttatgaagcccctagaattcctcctgaaaagagaatttttacaaccacccatacaccaaattgtttgttccaggatgtggatgaaagtcctgcagtcaggcgggcagcctttcgactattctcccattcggtttcgcgcccggaacggagagtacatcacgttggacaccagctggtccagcttcatcaacccatggagcaggaaaatctccttcatcattgggaggcacaaagtcagggtgggccctttgaatgaggacgtgtttgca

SEQ ID NO: 21908 - DNA, 551 bp, Homo sapiens
atcacactcaggaattcctgatgtgggttcataacttttccttctgtcccatccctggtccccaggtgagtccaggtaaagaagaacaagaagagtaaagagagatgctgcgggctccagcttcttggacagtctcgccttccccatgagagcctacacattcagagcctgctgcgtgggagcctgaaagctccttcctgtcctcttcgttccagagcccagcatgaatggatacgcggaatttccgcccagccccagtaaccccaccaaggagcccgtggagccccagcccagccaggtcccactgcaggaagatgtggacatgagcagtggctccagtggacatgagaccaacgaaaactgctccacggggcgggactcgcagggcagtgactgtgacgacagtgggaaggagctggggatgctggtggagccaccggatgcccgccagagtccagatacctttagcctgatgatggcaaaatctgaacacaacccatctacaagtggctgcagtagcgaccagtcttcgaaagtggacacacacaaag

SEQ ID NO: 21909 - DNA, 1826 bp, Homo sapiens
atcacactcaggaattcctgatgtgggttcataacttttccttctgtcccatccctggtccccaggtgagtccaggtaaagaagaacaagaagagtaaagagagatgctgcgggctccagcttcttggacagtctcgccttccccatgagagcctacacattcagagcctgctgcgtgggagcctgaaagctccttcctgtcctcttcgttccagagcccagcatgaatggatacgcggaatttccgcccagccccagtaaccccaccaaggagcccgtggagccccagcccagccaggtcccactgcaggaagatgtggacatgagcagtggctccagtggacatgagaccaacgaaaactgctccacggggcgggactcgcagggcagtgactgtgacgacagtgggaaggagctggggatgctggtggagccaccggatgcccgccagagtccagatacctttagcctgatgatggcaaaatctgaacacaacccatctacaagtggctgcagtagcgaccagtcttcgaaagtggacacacacaaagaactgataaaaacactaaaggagctgaaggtccacctccctgcagacaagaaggccaagggcaaggccagtacgctggccaccttgaagtacgccctcaggagcgtgaagcaggtgaaagccaatgaagagtattaccagctgctgatgtccagcgagggtcacccctgtggagcagacgtgccctcctacaccgtggaggagatggagagcgttacctctgagcacattgtgaagaatgccgatatgtttgcggtggccgtgtccctggtgtctgggaagatcctgtacatctctgaccaggttgcatccatatttcactgtaaaagagatgccttcagcgatgccaagtttgtggagttcctggcgcctcacgatgtgggcgtgttccacagtttcacctccccgtacaagcttcccttgtggagcatgtgcagtggagcagattcttttactcaagaatgcatggaggagaaatctttcttttgccgtgtcagtgtccggaaaagccacgagaatgaaatccgctaccaccccttccgcatgacgccctacctggtcaaggtgcgggaccaacaaggtgctgagagtcagctttgctgccttctgctggcagagagagtgcactctggttatgaagcccctagaattcctcctgaaaagagaatttttacaaccacccatacaccaaattgtttgttccaggatgtggatgaaagggcggtccctctcctgggctacctacctcaggacctgattgaaaccccagtgctcgtgcagctccaccctagtgacaggcccttgatgctggccatccacaaaaagatcctgcagtcaggcgggcagcctttcgactattctcccattcggtttcgcgcccggaacggagagtacatcacgttggacaccagctggtccagcttcatcaacccatggagcaggaaaatctccttcatcattgggaggcacaaagtcagggtgggccctttgaatgaggacgtgtttgcagcccacccctgcacagaggagaaggccctgcaccccagcattcaggagctcacagagcagatccaccggctcctgctgcaggtgggtgtggtgcctgcatgtcctcctcccaggtagcagcctgagagccccctgcagaggacataggctctgaaccctggtcctggcacacccactcagacagcttcatctgtcattctctgaacatcccccaggggacagtttgggcatagactgtgctagtccgagacagtccatagtacccttg

SEQ ID NO: 21910 - DNA, 3071 bp, Homo sapiens
ttcggggactaactgcaacggagagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgtgttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgtataacaatttggggcttttcattaaccattatcctaatggggttgtcactgttaattgtgctcgaatcatccatgggaaccagattgcaacaaatggtgttgtccatgtcattgaccgtgtgcttacacaaattggtacctcaattcaagacttcattgaagcagaagatgacctttcatcttttagagcagctgccatcacatcggacatattggaggcccttggaagagacggtcacttcacactctttgctcccaccaatgaggcttttgagaaacttccacgaggtgtcctagaaaggatcatgggagacaaagtggcttccgaagctcttatgaagtaccacatcttaaatactctccagtgttctgagtctattatgggaggagcagtctttgagacgctggaaggaaatacaattgagataggatgtgacggtgacagtataacagtaaatggaatcaaaatggtgaacaaaaaggatattgtgacaaataatggtgtgatccatttgattgatcaggtcctaattcctgattctgccaaacaagttattgagctggctggaaaacagcaaaccaccttcacggatcttgtggcccaattaggcttggcatctgctctgaggccagatggagaatacactttgctggcacctgtgaataatgcattttctgatgatactctcagcatggatcagcgcctccttaaattaattctgcagaatcacatattgaaagtaaaagttggccttaatgagctttacaacgggcaaatactggaaaccatcggaggcaaacagctcagagtcttcgtatatcgtacagctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctataagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagaggtcaccaaggtcaccaaattcattgaaggtggtgatggtcatttatttgaagatgaagaaattaaaagactgcttcagggagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactt

SEQ ID NO: 21911 - DNA, 3196 bp, Homo sapiens
ctaactgcaacggagagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgtgttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgtataacaatttggggcttttcattaaccattatcctaatggggttgtcactgttaattgtgctcgaatcatccatgggaaccagattgcaacaaatggtgttgtccatgtcattgaccgtgtgcttacacaaattggtacctcaattcaagacttcattgaagcagaagatgacctttcatcttttagagcagctgccatcacatcggacatattggaggcccttggaagagacggtcacttcacactctttgctcccaccaatgaggcttttgagaaacttccacgaggtgtcctagaaaggatcatgggagacaaagtggcttccgaagctcttatgaagtaccacatcttaaatactctccagtgttctgagtctattatgggaggagcagtctttgagacgctggaaggaaatacaattgagataggatgtgacggtgacagtataacagtaaatggaatcaaaatggtgaacaaaaaggatattgtgacaaataatggtgtgatccatttgattgatcaggtcctaattcctgattctgccaaacaagttattgagctggctggaaaacagcaaaccaccttcacggatcttgtggcccaattaggcttggcatctgctctgaggccagatggagaatacactttgctggcacctgtgaataatgcattttctgatgatactctcagcatggatcagcgcctccttaaattaattctgcagaatcacatattgaaagtaaaagttggccttaatgagctttacaacgggcaaatactggaaaccatcggaggcaaacagctcagagtcttcgtatatcgtacagctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctatagacccacactaacaaaagtcaaaattgaaggtgaacctgaattcagactgattaaagaaggtgaaacaataactgaagtgatccatggagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagaggtcaccaaggtcaccaaattcattgaaggtggtgatggtcatttatttgaagatgaagaaattaaaagactgcttcagggagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattga

SEQ ID NO: 21912 - DNA, 3373 bp, Homo sapiens
agactctcaggttgatgcagtgttccctcccacaactctgacatgtatataaattctgagctctccaaagcccactgccagttctcttcggggactaactgcaacggagagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgtgttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgtataacaatttggggcttttcattaaccattatcctaatggggttgtcactgttaattgtgctcgaatcatccatgggaaccagattgcaacaaatggtgttgtccatgtcattgaccgtgtgcttacacaaattggtacctcaattcaagacttcattgaagcagaagatgacctttcatcttttagagcagctgccatcacatcggacatattggaggcccttggaagagacggtcacttcacactctttgctcccaccaatgaggcttttgagaaacttccacgaggtgtcctagaaaggatcatgggagacaaagtggcttccgaagctcttatgaagtaccacatcttaaatactctccagtgttctgagtctattatgggaggagcagtctttgagacgctggaaggaaatacaattgagataggatgtgacggtgacagtataacagtaaatggaatcaaaatggtgaacaaaaaggatattgtgacaaataatggtgtgatccatttgattgatcaggtcctaattcctgattctgccaaacaagttattgagctggctggaaaacagcaaaccaccttcacggatcttgtggcccaattaggcttggcatctgctctgaggccagatggagaatacactttgctggcacctgtgaataatgcattttctgatgatactctcagcatggatcagcgcctccttaaattaattctgcagaatcacatattgaaagtaaaagttggccttaatgagctttacaacgggcaaatactggaaaccatcggaggcaaacagctcagagtcttcgtatatcgtacagctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctatacaactaaaattataaccaaagttgtggaaccaaaaattaaagtgattgaaggcagtcttcagcctattatcaaaactgaaggacccacactaacaaaagtcaaaattgaaggtgaacctgaattcagactgattaaagaaggtgaaacaataactgaagtgatccatggagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagaggtcaccaaggtcaccaaattcattgaaggtggtgatggtcatttatttgaagatgaagaaattaaaagactgcttcagggagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaat

SEQ ID NO: 21913 - DNA, 3210 bp, Homo sapiens
ctcttcggggactaactgcaacggagagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgtgttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgtataacaatttggggcttttcattaaccattatcctaatggggttgtcactgttaattgtgctcgaatcatccatgggaaccagattgcaacaaatggtgttgtccatgtcattgaccgtgtgcttacacaaattggtacctcaattcaagacttcattgaagcagaagatgacctttcatcttttagagcagctgccatcacatcggacatattggaggcccttggaagagacggtcacttcacactctttgctcccaccaatgaggcttttgagaaacttccacgaggtgtcctagaaaggatcatgggagacaaagtggcttccgaagctcttatgaagtaccacatcttaaatactctccagtgttctgagtctattatgggaggagcagtctttgagacgctggaaggaaatacaattgagataggatgtgacggtgacagtataacagtaaatggaatcaaaatggtgaacaaaaaggatattgtgacaaataatggtgtgatccatttgattgatcaggtcctaattcctgattctgccaaacaagttattgagctggctggaaaacagcaaaccaccttcacggatcttgtggcccaattaggcttggcatctgctctgaggccagatggagaatacactttgctggcacctgtgaataatgcattttctgatgatactctcagcatggatcagcgcctccttaaattaattctgcagaatcacatattgaaagtaaaagttggccttaatgagctttacaacgggcaaatactggaaaccatcggaggcaaacagctcagagtcttcgtatatcgtacagctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctatacaactaaaattataaccaaagttgtggaaccaaaaattaaagtgattgaaggcagtcttcagcctattatcaaaactgaaggacccacactaacaaaagtcaaaattgaaggtgaacctgaattcagactgattaaagaaggtgaaacaataactgaagtgatccatggagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatgaaa

SEQ ID NO: 21914 - DNA, 1952 bp, Homo sapiens
acaccacagacaaactgcccaaaccagagatggaaaagaaatccataggaataaagatacattgtattcagaggaaaatgacaagagagtcaacttttatcagaaacattgcaatccagaaaataaaagaaaaaaacttataataactgccaacaagaaaaagtcaacctagaattttcttgaatagaaaatattcttctaaaaattagatgaaacaaaaataagtaaaagctgagaaaatgtgtcactagaaactctctttgtaagaaatgcaaaaggaaattcttcaagctgagcaaaatgataccaagaaatctggatctactagaaggaatggaaagcacacaaatgcccaaatgtctgtgcccttcaacagattttgggcaccaaaaagaaatacttcagcacttgtaagaactggtataaaaagtccatctgtggacagaaaacgactgtgttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgtataacaatttggggcttttcattaaccattatcctaatggggttgtcactgttaattgtgctcgaatcatccatgggaaccagattgcaacaaatggtgttgtccatgtcattgaccgtgtgcttacacaaattggtacctcaattcaagacttcattgaagcagaagatgacctttcatcttttagagcagctgccatcacatcggacatattggaggcccttggaagagacggtcacttcacactctttgctcccaccaatgaggcttttgagaaacttccacgaggtgtcctagaaaggatcatgggagacaaagtggcttccgaagctcttatgaagtaccacatcttaaatactctccagtgttctgagtctattatgggaggagcagtctttgagacgctggaaggaaatacaattgagataggatgtgacggtgacagtataacagtaaatggaatcaaaatggtgaacaaaaaggatattgtgacaaattggtgtgatccatttgattgatcaggtcctaattcctgattctgccaaacaagttattgagctggctggaaaacagcaaaccaccttcacggatcttgtggcccaattaggcttggcatctgctctgaggccagatggagaatacactttgctggcacctgtgaataatgcattttctgatgatactctcagcatggatcagcgcctccttaaattaattctgcagaatcacatattgaaagtaaaagttggccttaatgagctttacaacgggcaaatactggaaaccatcggaggcaaacagctcagagtcttcgtatatcgtacagctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattgga

SEQ ID NO: 21915 - DNA, 3214 bp, Homo sapiens
agactctcaggttgatgcagtgttccctcccacaactctgacatgtatataaattctgagctctccaaagcccactgccagttctcttcggggactaactgcaacggagagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgtgttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgtataacaatttggggcttttcattaaccattatcctaatggggttgtcactgttaattgtgctcgaatcatccatgggaaccagattgcaacaaatggtgttgtccatgtcattgaccgtgtgcttacacaaattggtacctcaattcaagacttcattgaagcagaagatgacctttcatcttttagagcagctgccatcacatcggacatattggaggcccttggaagagacggtcacttcacactctttgctcccaccaatgaggcttttgagaaacttccacgaggtgtcctagaaaggatcatgggagacaaagtggcttccgaagctcttatgaagtaccacatcttaaatactctccagtgttctgagtctattatgggaggagcagtctttgagacgctggaaggaaatacaattgagataggatgtgacggtgacagtataacagtaaatggaatcaaaatggtgaacaaaaaggatattgtgacaaataatggtgtgatccatttgattgatcaggtcctaattcctgattctgccaaacaagttattgagctggctggaaaacagcaaaccaccttcacggatcttgtggcccaattaggcttggcatctgctctgaggccagatggagaatacactttgctggcacctgtgaataatgcattttctgatgatactctcagcatggatcagcgcctccttaaattaattctgcagaatcacatattgaaagtaaaagttggccttaatgagctttacaacgggcaaatactggaaaccatcggaggcaaacagctcagagtcttcgtatatcgtacagctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctatagacccacactaacaaaagtcaaaattgaaggtgaacctgaattcagactgattaaagaaggtgaaacaataactgaagtgatccatggagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatgaaatt

SEQ ID NO: 21916 - DNA, 2250 bp, Homo sapiens
atgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgtgttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgtataacaatttggggcttttcattaaccattatcctaatggggttgtcactgttaattgtgctcgaatcatccatgggaaccagattgcaacaaatggtgttgtccatgtcattgaccgtgtgcttacacaaattggtacctcaattcaagacttcattgaagcagaagatgacctttcatcttttagagcagctgccatcacatcggacatattggaggcccttggaagagacggtcacttcacactctttgctcccaccaatgaggcttttgagaaacttccacgaggtgtcctagaaaggatcatgggagacaaagtggcttccgaagctcttatgaagtaccacatcttaaatactctccagtgttctgagtctattatgggaggagcagtctttgagacgctggaaggaaatacaattgagataggatgtgacggtgacagtataacagtaaatggaatcaaaatggtgaacaaaaaggatattgtgacaaataatggtgtgatccatttgattgatcaggtcctaattcctgattctgccaaacaagttattgagctggctggaaaacagcaaaccaccttcacggatcttgtggcccaattaggcttggcatctgctctgaggccagatggagaatacactttgctggcacctgtgaataatgcattttctgatgatactctcagcatggatcagcgcctccttaaattaattctgcagaatcacatattgaaagtaaaagttggccttaatgagctttacaacgggcaaatactggaaaccatcggaggcaaacagctcagagtcttcgtatatcgtacagctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctatagtcctgaaataaaatacactaggatttctactggaggtggagaaacagaagaaactctgaagaaattgttacaagaagaggtcaccaaggtcaccaaattcattgaaggtggtgatggtcatttatttgaagatgaagaaattaaaagactgcttcagggagacacacccgtgaggaagttgcaagccaacaaaaaagttcaaggatctagaagacgattaagggaaggtcgttctcagtga

SEQ ID NO: 21917 - DNA, 3608 bp, Homo sapiens
acactgcctttccccattgggtctctgtaagagtcacacgctttgggcatccttgaaaagaatcttctgaggcctcagcattttatctgagtcttctgaatcccacttagaactgtgttgagctctcacccatcacgatgagcaacaaattcctgggcacctggaaacttgtctctagtgagaactttgacgattacatgaaagctctgggtgtggggttagccaccagaaaactgggaaatttggccaaacccactgtgatcatcagcaagaaaggagatattataactatacgaactgaaagtacctttaaaaatacagaaatctccttcaagctaggccaggaatttgaagaaaccacagctgacaatagaaagaccaagagcatcgtaaccctgcagagaggatcactgaatcaagtgcagagatgggatggcaaagagacaaccataaagagaaagctagtgaatgggaaaatggtagcggaatgtaaaatgaagggcgtggtgtgcaccagaatctatgagaaggtctgaaaaatcatttcttcattgaagtggctttttatcatttaatgatggaaatcaattgcttccattgacaaaactgaatacactgcaaatatttgtttttgcttttgtcttaatatatcagatatgcaaaggcctaaactgagaattaatctaaaagtcagtgttatttaaacattttcaatgtgcatgcatgtcattattacatcaaagcatatatattggccagacacaaacagttgatgatgtcattcaattaactacaaaattctaatctatgttgaactttgtatacttgaaatgataataaaaaggatataatttcttagtaaaatgaaatcaaagtattgatcagggtagcaaactcaaatgctgacaggggccagaggagatatggggaaggagcatcagaaatgaggcaagctaggagaatgggctattataatgtaaagaattgtagtctcagttaaaaggggtagcctctactccagccaacattttaaaattaatggataatttatagacagttaaatttatagacagttaagtaaaaatggataatttatagacagataatttatagacaggtaaatgtgagttaaatataactcacatcccactcaagacacaaaacattttcttaatcctagtacatttttttctgtcccttcccaatcagtgtccttttctgttccacccctaccaaaagcaagtagtggtttggtttctatcatatagattaattttacctgctcatatgaagggaattgtacatcatgcattcttttctgtttgccttttttaaattcagcatcatgtttttgtgatacatccacattgttgcatgcagctgtagtttgtttctttttattaccaagtactatttcattgtatgaatatatcacagtttatccattctactattaagacaattgagctatttctaattttcggctgctatgaataaagctgctacaaatatttttgtacaagactttttgtaaacataggagtccctttattttaaataaataactagtcatatcattaggtccagtaattgttgacaggcaggaacgggggaccattgcattgtgcccaagtaataataaaactatttcagatgtattatatgattgagcaaatgagaaaacatgttgatgttgatgggagtcaggatgttcactatggaaaaacaaatatacaaatatgaaatgagggaaggcaagaaagaaccatgtggaaatggaatagaattggtataaattcataatttctaaaccatgtatatgtacgtttatatgtattataattgcatacacatgcctccatgcatatatgtgtgtgataatacacatgcatttatgtgcgtgtgtgtatacacatgcatatatttactaatcctatctgccaaaatggcttagacacaaaaacacctcagcagaaatgaatatacctagcactcagatcttcgtgtctaatatagtttgccactaaaaggaaccaaggctacttggaaaaatggatgattccaaagcaagggcaaggtaggaacaagatgagcttgaaatatcttgttatgccagaaagtaatgttaaaaaaaaaaatagaggtatattgccaaaacatagagccagcttgaaggggctcccactggccaaacttgagccaatctgagagcaaaataattgagaaaaataaataacaagataattgagaaaaaaataaaataaattcccaattccattgggaaaaaatagaaatccatgaatccatactgatataatgatagataatcgatagataggtagatgactgacagatgatagatagatatatagatagatagatagatagatagatagatagatagatagatagagaaatgagaaggtttctcttttgcaatagaacgtcatggaccagtgttaaatgtgagtggaaggagttctggaattggaaaaccatcatttttcaaccatcacagtaaatatggctcaggcaagaattatcaatcaatgctaaagctagggggaaatttcgcttaggagcaggatattagggtattagtctgggcttaaagtatctcctcacagattgttgttagtttctggggaaagaatagtaaccatgcaatggaaaaaaatggacaacctcttgactaggttatcaaaattaacctcaccaataaagggtggatgttcaacatgtgccttcaaatgtgacccactgagaaggaaacaacatcactgtaacaacaacaaccagaaacgacagggggttttgactgaattcttcaaaaatgtcaatgtcatagaagacaaagaaaggttgtggaaatgtttcagattaaatgatagtaaaaacacctgacaactaaacatagtaagtaatactagactggattctgtaccagaggtaacataagtgctccaaaggacaatgttaggtcaactggcaaattggaatatagacagtcaatcagataagaagtatactttgattaagtaaaaaaaatccctattcttggaaaatacacaataaagtattttgaggtaaagggccataatgtatgcaatctactctcaaaaaattcagaaacatatatttgtgtgcatttgcatgtgcaacagtacacacaaacatacataaagagagcaattgataaggcaaataaggtaacatttaacaataatctgatacacataaatagagaaagagcaattgataaagtaaatgaggtaaaatttaacaataatctgagcaaaaggtatatgtgttttctttgagacagtctgattcttgcaacttattctgtaagttggaacttatttccaaacatgattgaaaaaaaaccccgcacttggcaacttcttctctttttcagcctagaaatgtctgtgttaagtggttttttatttattgttgttgtttgttgttattgttgttttgttgccaggctccaactcacaaaatacgagtttaaaaactgcgttgttatttttagagatttgtgataatacaacttgttataaaatttattcctcaataaatataatttctctactatgcaaaaa

SEQ ID NO: 21918 - DNA, 1829 bp, Homo sapiens
agttacagggagcaccaccagggaacatctcggggagcctggttggaagctgcaggcttagtctgtcggctgcgggtctctgactgccctgtggggagggtcttgccttaacatcccttgcatttggctgcaaagaaatctgcttggaagaaggggttacgctgtttggccgggcagaaactccgctgagcagaacttgccgccagaatgctcctcctgttgctgagtatcatcgtcctccacgtcgcggtgctggtgctgctgttcgtctccacgatcgtcagccaatggatcgtgggcaatggacacgcaactgatctctggcagaactgtagcacctcttcctcaggaaatgtccaccactgtttctcatcatcaccaaacgaatggctgcagtctgtccaggccaccatgatcctgtcgatcatcttcagcattctgtctctgttcctgttcttctgccaactcttcaccctcaccaaggggggcaggttttacatcactggaatcttccaaattcttgctggtctgtgcgtgatgagtgctgcggccatctacacggtgaggcacccggagtggcatctcaactcggattactcctacggtttcgcctacatcctggcctgggtggccttccccctggcccttctcagcggtgtcatctatgtgatcttgcggaaacgcgaatgaggcgcccagacggtctgtctgaggctctgagcgtacatagggaagggaggaagggaaaacagaaagcagacaaagaaaaaagagctagcccaaaatcccaaactcaaaccaaaccaaacagaaagcagtggaggtgggggttgctgttgattgaagatgtatataatatctccggtttataaaacctatttataacactttttacatatatgtacatagtattgtttgctttttatgttgaccatcagcctcgtgttgagccttaaagaagtagctaaggaactttacatcctaacagtataatccagctcagtatttttgttttgttttttgtttgtttgttttgttttacccagaaataagataactccatctcgccccttccctttcatctgaaagaagatacctccctcccagtccacctcatttagaaaaccaaagtgtgggtagaaaccccaaatgtccaaaagcccttttctggtgggtgacccagtgcatccaacagaaacagccgctgcccgaacctctgtgtgaagctttacgcgcacacggacaaaatgcccaaactggagcccttgcaaaaacacggcttgtggcattggcatacttgcccttacaggtggagtatcttcgtcacacatctaaatgagaaatcagtgacaacaagtctttgaaatggtgctatggatttaccattccttattatcactaatcatctaaacaactcactggaaatccaattaacaattttacaacataagatagaatggagacctgaataattctgtgtaatataaatggtttataactgcttttgtacctagctaggctgctattattactataatgagtaaatcataaagccttcatcactcccacatttttcttacggtcggagcatcagaacaagcgtctagactccttgggaccgtgagttcctagagcttggctgggtctaggctgttctgtgcctccaaggactgtctggcaatgacttgtattggccaccaactgtagatgtatatatggtgcccttctgatgctaagactccagaccttttgtttttgctttgcattttctgattttataccaactgtgtggactaagatgcattaaaataaacatcagagtaactcac

SEQ ID NO: 21919 - DNA, 816 bp, Homo sapiens
tcgcgcgcgcgcagccccgcagcgcagctttggcggcgccagcagcggagccaacgcacccgagtttgtgtttgaggccaccctgaggatcgggacagctgttcctttgggctgcagaaactccgctgagcagaacttgccgccagaatgctcctcctgttgctgagtatcatcgtcctccacgtcgcggtgctggtgctgctgttcgtctccacgatcgtcagccaatggatcgtgggcaatggacacgcaactgatctctggcagaactgtagcacctcttcctcaggaaatgtccaccactgtttctcatcatcaccaaacgaatggctgcagtctgtccaggccaccatgatcctgtcgatcatcttcagcattctgtctctgttcctgttcttctgccaactcttcaccctcaccaaggggggcaggttttacatcactggaatcttccaaattcttgctgaatcaaactcaagtcaaatgtgtggttaccgggattaagaacagaaagaatagaggggactcctgagtctgtgcgtgatgagtgctgcggccatctacacggtgaggcacccggagtggcatctcaactcggattactcctacggtttcgcctacatcctggcctgggtggccttccccctggcccttctcagcggtgtcatctatgtgatcttgcggaaacgcgaatgaggcgcccagacggtctgtctgaggctctgagcgtacatagggaagggaggaagggaaaacagaaagcagacaaagaaaaaagagctagcccaaaatcccaaactcaaaccaaaccaaaca

SEQ ID NO: 21920 - DNA, 1817 bp, Homo sapiens
tgttcccgttaaaggggaacgccaggagcctcccactgcccccttgcttcgcgcgcgcgcagccccgcagcgcagctttggcggcgccagcagcggagccaacgcacccgagtttgtgtttgaggccaccctgaggatcgggacagctgttcctttgggctgcagaaactccgctgagcagaacttgccgccagaatgctcctcctgttgctgagtatcatcgtcctccacgtcgcggtgctggtgctgctgttcgtctccacgatcgtcagccaatggatcgtgggcaatggacacgcaactgatctctggcagaactgtagcacctcttcctcaggaaatgtccaccactgtttctcatcatcaccaaacgaatggctgcagtctgtccaggccaccatgatcctgtcgatcatcttcagcattctgtctctgttcctgttcttctgccaactcttcaccctcaccaaggggggcaggttttacatcactggaatcttccaaattcttgctggtctgtgcgtgatgagtgctgcggccatctacacggtgaggcacccggagtggcatctcaactcggattactcctacggtttcgcctacatcctggcctgggtggccttccccctggcccttctcagcggtgtcatctatgtgatcttgcggaaacgcgaatgaggcgcccagacggtctgtctgaggctctgagcgtacatagggaagggaggaagggaaaacagaaagcagacaaagaaaaaagagctagcccaaaatcccaaactcaaaccaaaccaaacagaaagcagtggaggtgggggttgctgttgattgaagatgtatataatatctccggtttataaaacctatttataacactttttacatatatgtacatagtattgtttgctttttatgttgaccatcagcctcgtgttgagccttaaagaagtagctaaggaactttacatcctaacagtataatccagctcagtatttttgttttgttttttgtttgtttgttttgttttacccagaaataagataactccatctcgccccttccctttcatctgaaagaagatacctccctcccagtccacctcatttagaaaaccaaagtgtgggtagaaaccccaaatgtccaaaagcccttttctggtgggtgacccagtgcatccaacagaaacagccgctgcccgaacctctgtgtgaagctttacgcgcacacggacaaaatgcccaaactggagcccttgcaaaaacacggcttgtggcattggcatacttgcccttacaggtggagtatcttcgtcacacatctaaatgagaaatcagtgacaacaagtctttgaaatggtgctatggatttaccattccttattatcactaatcatctaaacaactcactggaaatccaattaacaattttacaacataagatagaatggagacctgaataattctgtgtaatataaatggtttataactgcttttgtacctagctaggctgctattattactataatgagtaaatcataaagccttcatcactcccacatttttcttacggtcggagcatcagaacaagcgtctagactccttgggaccgtgagttcctagagcttggctgggtctaggctgttctgtgcctccaaggactgtctggcaatgacttgtattggccaccaactgtagatgtatatatggtgcccttctgatgctaagactccagaccttttgtttttgctttgcattttctgattttataccaactgtgtggactaagatgcattaaaataaacatcagagtaactcac

SEQ ID NO: 21921 - DNA, 1236 bp, Homo sapiens
acccgagtttgtgtttgaggccaccctgaggatcgggacagctgttcctttgggctgcagaaactccgctgagcagaacttgccgccagaatgctcctcctgttgctgagtatcatcgtcctccacgtcgcggtgctggtgctgctgttcgtctccacgatcgtcagccaatggatcgtgggcaatggacacgcaactgatctctggcagaactgtagcacctcttcctcaggaaatgtccaccactgtttctcatcatcaccaaacgaatggctgcagtctgtccaggccaccatgatcctgtcgatcatcttcagcattctgtctctgttcctgttcttctgccaactcttcaccctcaccaaggggggcaggttttacatcactggaatcttccaaattcttgctggtctgtgcgtgatgagtgctgcggccatctacacggtgaggcacccggagtggcatctcaactcggattactccttccccctggcccttctcagcggtgtcatctatgtgatcttgcggaaacgcgaatgaggcgcccagacggtctgtctgaggctctgagcgtacatagggaagggaggaagggaaaacagaaagcagacaaagaaaaaagagctagcccaaaatcccaaactcaaaccaaaccaaacagaaagcagtggaggtgggggttgctgttgattgaagatgtatataatatctccggtttataaaacctatttataacactttttacatatatgtacatagtattgtttgctttttatgttgaccatcagcctcgtgttgagccttaaagaagtagctaaggaactttacatcctaacagtataatccagctcagtatttttgttttgttttttgtttgtttgttttgttttacccagaaataagataactccatctcgccccttccctttcatctgaaagaagatacctccctcccagtccacctcatttagaaaaccaaagtgtgggtagaaaccccaaatgtccaaaagcccttttctggtgggtgacccagtgcatccaacagaaacagccgctgcccgaacctctgtgtgaagctttacgcgcacacggacaaaatgcccaaactggagcccttgcaaaaacacggcttgtggcattggcatacttgcccttacaggtggagtatcttcgtcacacatctaaatgagaaatcagtgacaacaagtctttgaaatggtgctatggatttaccat

SEQ ID NO: 21922 - DNA, 3241 bp, Homo sapiens
agatgcactctcttgtcctcaggtcccatctgaggcagacctgtctcacaggacagcgctggagtccccagcagcagcagcagccccagccctatggttcctggcaaacccagcagacctcagcaacccggctcctgcagaccatccgagctgcctctgtccactcctgggcaggttgtgcttgcattctggaagctgtttgacatacaaaggccagatatcagccttctcgctaactctggagtaggggagggtgtggtgggatgtgtgattgtgtgtgtatgtgtgtgtatgtagtgtgtgtgcgcatagatatacaaagctgtgtgtatgcatctgtttgcgtgcgcaggtttgtggacctgttctggggccttctctctttcagactgctggggatgggcactttctctttccccatctcttccccatccagccccacccatccctggtacctgcaactcatcaatactggaaaccagctcctgccagtccatccatctctcagccttggcagccgctgttgcccctcagccccctccccttcctacctcaggaatcactctggttcctgtaaagcccatgactgagcagcaattggtgtggggttggggggagggagaatccagtaaaccaagacagaatacaaaaggcccacttagcccagcccgtggcatggggcagaccctcccgagtgggatccagagctgggtccagccaccctcagccccctatgatgtacccacctcattggggcttgttgcggggtaggtctaggtttgggggctgtgtctttaaggctgaaacatcagcagacaacctctgctgggccgtcttcaggggagggggaggggggctggtcagcccattagcagcagagctggcgccaggcaccagcccttcacagggccctggggattagggagagtagctcttccccagcccgatctgcctctgcgcccctgtctcctattcctctctgggtgtggtgaaggaggggtagctgacagcaggtgaaaatagagcctggccttcagggggcaagtcaaggcactagctatggggcctaagccaggtcaactctccctccagctggcctcctccctactcctgtgccagaagcctgccctttaacttcaggtccttctacctcgcaattttcagggactctagttcaagtcaggccttcctaccctaggttctagctttgggtgcttgttgggaggaagtgacccccaccccagcggcaacagggggcaatcaagtgggtagaggcctgcaaccagggaagggaggggaaggcgctcctgctgttccgcaggggtggggcatccccctccccatacaacccccctccagcgggccatcaggccagtgggaggagctgcccgtgccccccctgagaccgcagggctataaagccgcctcgcagcggtctgcggctccttcccagcccccggcctagctctgcgaacggtgactgcccatccttggccgcaatgagccaccacccgtcgggcctccgggccggcttcagctccacctcataccgccgtaccttcggtccaccgccctcactatcccccggggccttctcctactcgtccagctcccgcttctccagcagccgcctgctgggctccgcgtccccgagctcctcggtgcgcctgggcagcttccgtagcccccgagcgggagcgggcgccctcctgcgcctgccctcggagcgcctcgacttctccatggccgaggccctcaaccaggagttcctggccacgcgcagcaacgagaagcaggagctgcaggagctcaacgaccgcttcgccaacttcatcgagaaggtacgctttctggagcagcagaacgcggccctgcgcggggagctgagccaagcccggggccaggagccggcgcgcgccgaccagctgtgccagcaggagctgcgcgagctgcggcgagagctggagctgttgggccgcgagcgtgaccgggtgcaggtggagcgcgacgggctggcggaggacctggcggcgctcaagcagaggttggaggaggagacgcgcaagcgggaggacgcggagcacaacctcgtgctcttccgcaaggacgtggacgatgccactctgtcccgcctggaactagagcgcaagattgagtctctgatggatgagattgagttcctcaagaagctgcacgaggaggagctgcgagacctgcaggtgagtgtggagagccagcaggtgcagcaggtggaggtggaagccacggtgaagcccgagctgacggcagcgctgagggacatccgcgcgcagtacgagagcatcgccgcgaagaacctgcaggaggcggaggagtggtacaagtccaagtacgcggacctgtccgacgctgccaaccggaaccacgaggccctgcgccaggccaagcaggagatgaacgagtcccgacgccagatccagagtctaacgtgcgaggtggacgggctgcgcggcacgaacgaggcgctgctcaggcagttgagagagctggaggagcagttcgccctggaggcggggggctaccaggcgggcgctgcgcggctcgaggaggagctgcgacagctaaaagaggagatggcgcggcacctgagggagtaccaggagctcctcaacgtcaagatggccctggacatcgagatcgccacctaccgcaagctgctggagggcgaggagagccggatctccgtgcccgtccattcttttgcctccttaaatataaagacgactgtgcctgaggtggagcctccccaggacagccacagccggaagacggttctgatcaagaccattgagacccggaatggggaggtggtgacagagtcccagaaggagcagcgcagtgagctggacaagtcttctgcccacagttactgaaccccttggtccggagccttgactctgccctaggcctgctcaaagcccaaaccctaagaccactcctgaattgtctcctctccctctgcatgtgtctaaaaggtggtaccaggcatccctttcctggcttatggccaagccctacccggccagcagtcgctgggcctctccctgccctgacacttgatgtgacctatgtgcttcccttttcatgtcccgataagaagccaatgatcccccctcaggacaaatctactccagccacgatgagaagtgggtgagccagggtctgagtttcacatttgaaccaaataaaatgctgtcaagag

SEQ ID NO: 21923 - DNA, 2974 bp, Homo sapiens
caacgcccaggaccaggactatcccctgctcaagctgtgattccgagacccctgccaccactactgcattcacggggatcccaggctagtgggactcgacatgggtagcccccagggcagctccctacagcttgggccatctgcacttttcccaaggccctaagtctccgcctctgggctcgttaaggtttggggtgggagctgtgctgtgggaagcaacccggactacacttggcaagcatggcgctactgaaagtcaagtttgaccagaagaagcgggtcaagttggcccaagggctctggctcatgaactggttctccgtgttggctggcatcatcatcttcagcctaggactgttcctgaagattgaactccgaaagaggagcgatgtgatgaataattctgagagccattttgtgcccaactcattgatagggatgggggtgctatcctgtgtcttcaactcgctggctgggaagatctgctacgacgccctggacccagccaagtatgccagatggaagccctggctgaagccgtacctggctatctgtgttctcttcaacatcatcctcttccttgtggctctctgctgctttctgcttcggggctcgctggagaacaccctgggccaagggctcaagaacggcatgaagtactaccgggacacagacacccctggcaggtgtttcatgaagaagaccatcgacatgctgcagatcgagttcaaatgctgcggcaacaacggttttcgggactggtttgagattcagtggatcagcaatcgctacctggacttttcctccaaagaagtcaaagatcgaatcaagagcaacgtggatgggcggtacctggtggacggcgtccctttcagctgctgcaatcctagctcgccacggccctgcatccagtatcagatcaccaacaactcagcacactacagttacgaccaccagacggaggagctcaacctgtgggtgcgtggctgcagggctgccctgctgagctactacagcagcctcatgaactccatgggtgtcgtcacgctcctcatttggctcttcgaggtgaccattacaattgggctgcgctacctacagacgtcgctggatggtgtgtccaaccccgaggaatctgagagcgagagccagggctggctgctggagaggagcgtgccggagacctggaaggcctttctggagagtgtgaagaagctgggcaagggcaaccaggtggaagccgagggcgcagacgcaggccaggccccagaggctggctgagggccctggggcccctcccctcccgaacactgagaaatagtgcactccaagaaacgtggatctccccctcatccaactccgaaagtctgaatctcccaaggagggcaccatcttacagagactctccctgacggtggaatttaagtttagggtccctaaaagcatttgacacacagttgttgaatgactgacccaaaatgtgaatgaagctaatgtgaatgtgagtgaagctcccttcaggcccgctgccctaggatatgccctcctggtgactcgggggctgtctcagacgactagcccaggacccatctttctcacacggatttagtcccaccctatggccactggccgtatctgagggctgctccccttttagaatttacctcttatgagctccatgttgcttcactctatccaaagtgtcacttggtgcataagcacagaaatctgaaaaatggccatgttgtcttttttttttttttttaatgccaagattgacaggttggccgtttgcttaatgccagaagttgggggaaagttacgcttttctaagaataatggactcttaaggcattgagggctctaaacaggattctttaatcatggagcaagagaatttcaaggcaggggattttatcccccaccaaaaacacagtgaaaggcctgcttttgtgtcccattcacatgccctcggtcactgagtctggagtgaaccacgggttgaggaagtcaggctgttggcgtgtcccagcaccacaccacccctaaagtgccaggtgatctcctgtggctcatcggtggaagcagtggggtaggctgctgccctgctgtggaagaggagcaacaatcagacatgagtccaccctttggagaccaggcctcagctcttggtgggcccagggacacccacacaggtggccatcacagccccatggacaacactaattgtccacagcaaagggcaaggaatcctctgggagcttcttccgtttcttccccccagatacccatcttgaaaaacactatttctggaatgcttctgcatcaaaggagattctttgagatagcccatcttcctgagctagcaaatacaggagttttcactttctttaggaaagagaagctttcaggggaaggagagaatgattttgctgacttcccaagccctggtgaccagaccaaggcagggcccagcataattcctccagttggatgaacattcaagagagctcgttcctacctggctggagaccgaggccagaaggcaaaaaccagaaagggaacagtccataacttacctctgcttctgaccgatggtgtttgggaataggttactttggactgagtttgggttctctgctgtcctaagaacttcagtgtagagaaaataagacttctggtgctgctggggtatgttctgggcttaattcccccaagcagaagaccagatccaagatgtttggacaccctgtcagacgttggtcccaagtttaattagatttctgaatctcgttgaggccaaggaatgatccatactgaaaaaatgctgagccagccatctttggcaaaggtccctgagctcttgctatctctcaagagtgctgagaaccacggtgaaagtgctgctctaggcccacaagtgtaactatgctgttaacagctgtcaatagataattaaaattcatactgtatg

SEQ ID NO: 21924 - DNA, 1643 bp, Homo sapiens
ggaagtacctacctgggataacggcggcgagcggacggctgcatttacggggtctcccggagggccagagtcgtggcttacagaagagacgaaatgtggtctgagggacgatatgaatatgaaagaattccgagagaacgagcacctcctcgaagtcatcccagtgatggctacaatagactagttaatattgtgccaaagaaaccaccactgctagacagacctggtgaaggaagctacaatagatattacagtcatgttgattaccgagactatgacgagggccgcagtttttctcatgatcgaagaagtggtccacctcacagaggagatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaaagtccgtgcgtcctggtgcctcctacaaacggcagaatgaaggaaatcctgaaagagataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaataggtgagcggtgtgttgaagaactcaagcatttcattgcagagtatgatacttccactcaagattttggagagcctttttagatttttctgctcaggctaaaaaaaaaaaaaaacagtttctaaaaattttttttcctggattgtgtaaatccttaatatatggaatttttgtgatgcagagaaatactttatgatagttgacaacatttcagtattaaataaacatctaaaatagtctgtttaaaatgtttgattcaaatttttgtattttttgtagagatggggttcaccatgttggccaggctagtctctaactcctggcctcaagtgatctgcctgcctcagcctctcaaagtgttgagattacaggcgtgagccaccgctccctgcccaacacatataccatctgaaaatgttagaattctgagttgtgattttattgacttgttgcttgctttttcttaggctttgtaacttgtaatatgttaaagtgtactatcctaataaactgaatactttggtatctt

SEQ ID NO: 21925 - DNA, 2170 bp, Homo sapiens
tacctgggataacggcggcgagcggacggctgcatttacggggtctcccggagggccagagtcgtggcttacagaagagacgaaatgtggtctgagggacgatatgaatatgaaagaattccgagagaacgagcacctcctcgaagtcatcccagtgatggctacaatagactagttaatattgtgccaaagaaaccaccactgctagacagacctggtgaaggaagctacaatagatattacagtcatgttgattaccgagactatgacgagggccgcagtttttctcatgatcgaagaagtggtccacctcacagaggagatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaaagtccgtgcgtcctggtgcctcctacaaacggcagaatgaaggaaatcctgaaagagataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaatagagtctgcaggacagacttggcagcaggtaccccctgtgaggaacactgaaatggatcacgacggaacccccgaaaacgaaggcgaagagactgcgcagtcagccccgcagcccccgcaggccccgcagcccctgcagccccggaagaaacgggttcgtcggacgacacagcttcgtcggacgacaggagccccagacattacctgggggatgctgaagaagacaactcaggaggctgagaggatcctgctccgaacacagacaccattcactccagaaaatttgttccttgctatgctctctgttgtacattgcaactcacgcaaggatgtaaagccagaaaacaagcagtaactgctatgcctgacaaaactgttgctgcacacatctgtactcgtcaatcaacaaaacctgatgcaaaaaacagaaaaggggtgatgtaggagatggtcaggttggtaggagaagctataaggaaagacgcaattggaaggtcgggaggttttccaaagcttcaggagagaataaagctgaaggcagctttattaattaattctcttaccctgaggctgagggcgaacagtaggtagcaagggagtgtaaaggaatttatctagataagtttgtttacttatgccctccggaaatcatgcaagactgctccctgcaaaggggggcgacaatgttcattactcacaaattgtgttggcttcaggcctttggtattctgtctctactgaataaatacaaatggttccagcctatcaggactgcactctcttctcggctgcactaaagctggcactcccccagccgttctcatgcaaaatacctgtgtcagaatactcctttcatccatcactcagccagagtcttcaggacagactccgcatgggacttgtccaaaaaaactctaatcaaaagaggaaaattttggaatatgccaggaatagtggaattttattttttaaatttttttataggcccatatgctctatctcaagaaacaagatgattgtaacatgtccatgattaaactattggcagattattgctgtgttaa

SEQ ID NO: 21926 - DNA, 1693 bp, Homo sapiens
attgcgcgcgccggaagtacctacctgggataacggcggcgagcggacggctgcatttacggggtctcccggagggccagagtcggaaattgttgaaaacgttaaatttgattcctaaaaggactcaatggcttacagaagagacgaaatgtggtctgagggacgatatgaatatgaaagaattccgagagaacgagcacctcctcgaagtcatcccagtgatggctacaatagactagttaatattgtgccaaagaaaccaccactgctagacagacctggtgaaggaagctacaatagatattacagtcatgttgattaccgagactatgacgagggccgcagtttttctcatgatcgaagaagtggtccacctcacagaggagatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaaagtccgtgcgtcctggtgcctcctacaaacggcagaatgaaggaaatcctgaaagagataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaataggtgagcggtgtgttgaagaactcaagcatttcattgcagagtatgatacttccactcaagattttggagagcctttttagatttttctgctcaggctaaaaaaaaaaaaaaacagtttctaaaaattttttttcctggattgtgtaaatccttaatatatggaatttttgtgatgcagagaaatactttatgatagttgacaacatttcagtattaaataaacatctaaaatagtctgtttaaaatgtttgattcaaatttttgtattttttgtagagatggggttcaccatgttggccaggctagtctctaactcctggcctcaagtgatctgcctgcctcagcctctcaaagtgttgagattacaggcgtgagccaccgctccctgcccaacacatataccatctgaaaatgttagaattctgagttgtgattttattgacttgttgcttgctttttcttaggctttgtaacttgtaatatgttaaagtgtactatcctaataaactgaatactttggt

SEQ ID NO: 21927 - DNA, 3377 bp, Homo sapiens
cggcggcgagcggacggctgcatttacggggtctcccggagggccagagtcgtggcttacagaagagacgaaatgtggtctgagggacgatatgaatatgaaagaattccgagagaacgagcacctcctcgaagtcatcccagtgatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaaagtccgtgcgtcctggtgcctcctacaaacggcagaatgaaggaaatcctgaaagagataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaatagagtctgcaggacagacttggcagcaggtaccccctgtgaggaacactgaaatggatcacgacggaacccccgaaaacgaaggcgaagagactgcgcagtcagccctctttggattccagcacgacgcatcaaaccataccatagtggggctaggacccaaccaagtaccagaaatgaaggaaacgaccctgcaggccccgcagcccccgcaggccccgcagcccctgcagccccggaagaaacgggttcgtcggacgacacagcttcgtcggacgacaggagccccagacattacctgggggatgctgaagaagacaactcaggaggctgagaggatcctgctccgaacacagacaccattcactccagaaaatttgttccttgctatgctctctgttgtacattgcaactcacgcaaggatgtaaagccagaaaacaagcagtaactgctatgcctgacaaaactgttgctgcacacatctgtactcgtcaatcaacaaaacctgatgcaaaaaacagaaaaggggtgatgtaggagatggtcaggttggtaggagaagctataaggaaagacgcaattggaaggtcgggaggttttccaaagcttcaggagagaataaagctgaaggcagctttattaattaattctcttaccctgaggctgagggcgaacagtaggtagcaagggagtgtaaaggaatttatctagataagtttgtttacttatgccctccggaaatcatgcaagactgctccctgcaaaggggggcgacaatgttcattactcacaaattgtgttggcttcaggcctttggtattctgtctctactgaataaatacaaatggttccagcctatcaggactgcactctcttctcggctgcactaaagctggcactcccccagccgttctcatgcaaaatacctgtgtcagaatactcctttcatccatcactcagccagagtcttcaggacagactccgcatgggacttgtccaaaaaaactctaatcaaaagaggaaaattttggaatatgccaggaatagtggaattttattttttaaatttttttataggcccatatgctctatctcaagaaacaagatgattgtaacatgtccatgattaaactattggcagattattgctgtgttaatctctgtagtctaatgagttctttgttctgttctgctgccttttacgttttcttgtcctttcaaaagtgttcttgaaagaaacaaagcgaataggcagttagcacagcacagctaccccttaccaagcagtctatggaaacaacccctcatccaaatcatgggttagttaagaatctaactggggcaattaagatgaattccactcacttcctggtcacttcagcagcccagcggcattgagccaaaatatacaattctgtgttattagtgaggaaactttaaaactcatgtttgttattacttactacccaatttcattatcctcccttcctctttccatttctattctctctcacttgaattctggcattatttttagtggcctctactgataatacctaccctagagtacataaaaattatattaaaagaggaagtagcagtatgcataattttaacagattctataatgggtgcctcaaaatatgtattgtgccattccgcaaatttaaaagctaattgaggacaatttttttttaatttcctaaatgagaccaccttggatttttatttttgccatttagatgtttatacttatttagcttttataaaacataagccaagctaaatcccacataacaactctggtattcttccctcatatgagcagtgattttatttgttacccaccttagatagactaagaaagttctagtcttgtttctccttctccccgcttccctggggtttttccttaccataagtattctggtccgagggttcagttcctttagtcaagatgtcacaagtttaaaaacaaaacttgagaaactaccaaaggctcaggagttgtccactttgttgaaatccattaaattagagaagtctcactaacagatgtatttaaatataggtacaacaaataatttctttttctccccttccccaaattacagtcagcatttaaagctgtttatggcttgccatcagcattattctggtaggcttgttagtgttaaaatctatttgattttttttttttttttttgcctcttaaagtctaattttaggatggatgaattcagatgtttaccagagtgtgtattttacataatgttcttgattaaaaagacttgtttgtaaattatccgttgtttttgcatatgcccagttgatgtgataaaattttcattgtcttgccatataaagccttggttatcaacaggtggaatgtagatattgtaaagctttttgtgaattaaaagtgcaaaataaagcaaccacatttaa

SEQ ID NO: 21928 - DNA, 1581 bp, Homo sapiens
cctgggataacggcggcgagcggacggctgcatttacggggtctcccggagggccagagtcgtggcttacagaagagacgaaatgtggtctgagggacgatatgaatatgaaagaattccgagagaacgagcacctcctcgaagtcatcccagtgatggctacaatagactagttaatattgtgccaaagaaaccaccactgctagacagacctggtgaaggaagctacaatagatattacagtcatgttgattaccgagactatgacgagggccgcagtttttctcatgatcgaagaagtggtccacctcacagaggagatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaaataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaataggtgagcggtgtgttgaagaactcaagcatttcattgcagagtatgatacttccactcaagattttggagagcctttttagatttttctgctcaggctaaaaaaaaaaaaaaacagtttctaaaaattttttttcctggattgtgtaaatccttaatatatggaatttttgtgatgcagagaaatactttatgatagttgacaacatttcagtattaaataaacatctaaaatagtctgtttaaaatgtttgattcaaatttttgtattttttgtagagatggggttcaccatgttggccaggctagtctctaactcctggcctcaagtgatctgcctgcctcagcctctcaaagtgttgagattacaggcgtgagccaccgctccctgcccaacacatataccatctgaaaatgttagaattctgagttgtgattttattgacttgttgcttgctttttcttaggctttgtaacttgtaatatgttaaagtgtactatcctaataaactgaatactttggtatcttagagaa

SEQ ID NO: 21929 - DNA, 588 bp, Homo sapiens
aacttttctggagtaccatcgaaactgcactgatatgaggagatgtagtgatgatgtggcaggaaattgttgaaaacgttaaatttgattcctaaaaggactcaatggcttacagaagagacgaaatgtggtctgagggacgatatgaatatgaaagaattccgagagaacgagcacctcctcgaagtcatcccagtgatggctacaatagactagttaatattgtgccaaagaaaccaccactgctagacagacctggtgaaggaagctacaatagatattacagtcatgttgattaccgagactatgacgagggccgcagtttttctcatgatcgaagaagtggtccacctcacagaggagatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctact

SEQ ID NO: 21930 - DNA, 576 bp, Homo sapiens
agtaccatcgaaactgcactgatatgaggagatgtagtgatgatgtggcagtggcttacagaagagacgaaatgtggtctgagggacgatatgaatatgaaagaattccgagagaacgagcacctcctcgaagtcatcccagtgatggctacaatagactagttaatattgtgccaaagaaaccaccactgctagacagacctggtgaaggaagctacaatagatattacagtcatgttgattaccgagactatgacgagggccgcagtttttctcatgatcgaagaagtggtccacctcacagaggagatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaac

SEQ ID NO: 21931 - DNA, 1095 bp, Homo sapiens
gggataacggcggcgagcggacggctgcatttacggggtctcccggagggccagagtcggaaattgttgaaaacgttaaatttgattcctaaaaggactcaatggcttacagaagagacgaaatgtggtctgagggacgatatgaatatgaaagaattccgagagaacgagcacctcctcgaagtcatcccagtgatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaacatagaaagtccgtgcgtcctggtgcctcctacaaacggcagaatgaaggaaatcctgaaagagataaagagaggcctgtccagtctttgaaaacatcaagagatacttcaccctcaagtggttcagcagtttcttcatcaaaggtgttagacaaacccagtaggctaactgaaaaggaacttgctgaggctgcaagcaagtgggctgctgaaaagctagagaaatcagatgaaagtaacttgcctgaaatttctgagtatgaggcgggatccacagcaccattgtttactgaccagccagaggaacctgagtcaaacacaacacatgggatagaattatttgaagatagtcagctaaccactcgctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaataggtgagcggtgtgttgaagaactcaagcatttcattgcagagtatgatacttccactcaagattttggagagcctttttagatttttctgctcaggctaaaaaaaaaaaaaaaca

SEQ ID NO: 21932 - DNA, 6238 bp, Homo sapiens
cgcgccgccgctcgctcacctgcgctcccgcccgcccctcggtgcgcgcccggcccgccagccgccgccgcccgcaccccgagcgccaccatgaactcgctcttcaggaagagaaacaaaggcaaatacagccccactgtgcagacccggagcatctctaacaaggagctctcggagctgatcgagcagctgcagaagaatgccgaccaggtggagaagaacatcgtggacacagaggccaagatgcagagtgacctggctcggctgcaggagggtcggcagcctgagcaccgggacgtgaccctgcagaaggtgttggactctgagaagctgctctatgtgctagaggcggatgcggccattgccaagcacatgaagcacccacagggggacatgatcgccgaggatatccgccagctgaaggagcgtgtgaccaacctgcgcgggaaacacaagcagatctacaggctggcggtgaaggaagtggatccacaggtcaactgggcggcactggtggaggagaagctggacaagctgaacaaccagagctttgggactgacctgccgctggtggaccaccaagtggaggagcataacatcttccacaatgaggtcaaggccatcgggccccacctggccaaggacggggacaaggagcagaacagcgaactccgggccaagtaccagaaactgctggcagcatcacaggcccggcagcagcacctgagttcgctgcaggactacatgcagcgctgcaccaatgagctgtactggctggaccagcaggccaagggccgcatgcagtacgactggagtgaccgcaacctcgactaccccagccgccggcgccagtatgagaatttcatcaaccggaacctggaggccaaagaggagagaatcaacaaactgcacagcgagggcgaccagctgctggcggccgagcaccccgggaggaactccattgaggcgcacatggaggctgtgcacgcagactggaaggagtacctgaacctgctcatctgcgaggagagccacctcaagtacatggaggactaccaccagtttcacgaagacgtgaaggacgctcaggagctgctgcgcaaggtggactcggacctgaaccagaagtatggccctgacttcaaggaccggtaccagattgagctgctgctgcgggagctggatgaccaggagaaggtgctggacaagtatgaggacgtggtgcaggggctgcagaagcgaggccagcaggtggtgcccctcaagtaccgccgggagactccgctcaagcccatccccgtggaggcactctgtgactttgagggggagcagggcctgatctcgcggggctacagctacaccctgcagaagaacaacggggagagctgggagctcatggacagcgctgggaacaagctgattgctccggccgtgtgttttgtgatcccccccacagaccctgaggccctggctctggctgacagcctgggcagccagtaccggagcgtgcggcagaaggcagctgggagcaaacgcacgctgcagcagcggtatgaggtgctgaagaccgagaatcccggagatgcctctgacctacaggggcggcagctgctggctggcttggacaaggtggccagcgacctggaccggcaggagaaggccatcacagggatcctgcggccaccactggagcaaggccgggctgtgcaggacagtgccgagcgggccaaggacctcaagaacatcaccaacgagctactgcggattgaacctgagaagacgcggagcacggctgagggcgaagccttcatccaggccctcccaggcagtggcaccacacccctgctgaggacccgggtggaggacaccaaccggaaatacgagcacctcctgcagctgctggacttggcccaggagaaggttgatgtggccaaccgcctggagaagagcctgcagcagagctgggagttgctggccacacacgagaaccatctgaatcaggatgacacagtgcctgagagcagccgtgtcctggacagcaaggggcaggagctggcggccatggcctgtgagttacaggcccagaagtccctcctgggtgaggtggagcagaacttgcaggcggccaagcagtgctcgagcacactggccagccgcttccaggagcactgtccggacctggagcgccaggaggccgaggtgcacaagctgggccagcgtttcaacaacctgcgccagcaggtggaacgcagggcgcagagcctacagagcgccaaggcagcctacgagcacttccaccgcggccatgaccacgtgctgcagttcctagtcagcatccccagttacgagccccaggagacagacagcctcagccagatggagaccaagctgaagaaccagaagaacctgctagatgagatagcaagtagggagcaggaagtacagaagatctgtgccaattcccagcagtaccagcaagctgtaaaggactatgagttagaagcagaaaaactaaggtctcttctcgacttggagaatggaaggagaagccacgtgagcaagagagccaggctccaatctcctgccaccaaagtgaaggaagaggaagcagcacttgccgccaagttcactgaagtttatgccatcaacagacagaggctgcagaatctggagtttgctctgaatctcctcagacagcagccggaagtagaagtgacccatgagaccctgcaaaggaataggccggactctggagtggaggaggcgtggaagatcaggaaggaactggatgaggagactgagcggaggcggcagctggagaacgaggtcaagagcacccaggaagaaatctggaccttgaggaatcaggggcctcaggaatcggtggtgaggaaggaggtgctcaagaaggtgccggatcccgtgctggaggagagcttccagcagctgcagcggacgctggcagaggagcagcacaagaaccagctgctgcaggaggagctggaggcactgcagctgcagctgcgtgccctggagcaggagaccagagacggggggcaggagtacgtggtcaaggaggtcctgcgcatcgagcctgacagggcccaggcggatgaggtcttgcagctgcgggaggagctggaggcactgaggcggcagaagggcgcccgggaggcagaggtgctcctcctgcagcagcgtgtggccgccctggctgaagagaagagccgggcgcaggagaaggtcacagagaaagaggtggtgaaactgcagaatgacccccagctggaggcagagtaccagcagctgcaggaggaccaccagcgccaggaccagctcagggagaagcaggaggaggagctgagcttcctccaggacaagctcaagaggctagagaaggagcgggccatggccgagggcaagatcaccgtcaaggaggtgctcaaggtggagaaggacgcggccaccgagagggaggtcagcgatctcacccgccaatatgaggacgaggctgccaaggctcgcgctagccagagggagaagacggagctgctccgaaagatatgggccttggaggaggagaacgccaaagtggtggtgcaggagaaggtgcgggagatcgtgcggccagaccccaaggcggaaagtgaagtggcgaacctccgcctggagcttgtggagcaggagcgaaagtaccggggtgccgaggagcagctccggagctaccagagtgagctggaggccctcaggaggcgaggcccccaggtggaagtcaaagaggtgactaaggaagtcattaagtacaagactgaccctgagatggagaaggagcttcagcggctcagggaggagatcgtggacaagaccagactgatcgaaaggtgtgatttagagatctaccagctgaaaaaggaaatccaggccctgaaagacaccaaaccccaggtccagaccaaagaggtggtccaggagatcctccaattccaagaagaccctcaaaccaaggaggaggtggcgtctctgagggcaaagctctcagaggagcagaagaaacaagtggatctggagagggaaagagcttcccaggaagagcagatcgcccggaaagaggaggagctctcgcgggtgaaggaaagggtggtgcagcaggaggtggtcaggtatgaggaggagccaggcctgcgggccgaggcgagcgcctttgccgagagcatcgatgtggagctgcggcagattgacaagctgcgggcagagctgcggcggctgcagcgccggcgcaccgagcttgagcggcagctggaggagctagagcgcgagcggcaggcccgcagggaggccgagcgcgaggtacagcggttgcagcagcggctggcagcgctggagcaggaagaagctgaggcccgtgagaaggtaacccatacgcagaaggtggtgctgcagcaggacccgcagcaggcgcgagagcatgccctgctccgactccagctggaagaagagcagcaccggcggcagctcctggagggggagctcgagaccctccggaggaaactggctgcactggagaaggcggaggtcaaggagaaggtggtgctctccgagagtgtccaggtggagaagggcgacaccgagcaagagatccagaggctcaagagcagcctggaggaggagagccgcagcaagcgcgagctggacgtcgaggtgagccggctggaagccaggctttcggagctggaattccataactccaagtcatccaaggaactagactttctgagggaagagaaccacaaattacagctggagaggcaaaacctgcagctggagacccgaaggctccaatcggaaatcaacatggcagcgacggaaacacgagacctgcggaacatgaccgtggcggactctgggaccaaccatgactccagactgtggtccctggagagggaactggatgacctcaagaggctctccaaggacaaagacctcgagatcgacgagctgcagaagcgcctgggctccgtggccgtcaagcgggagcagcgggagaaccacctgcggcgctccatcgtagtcatccaccctgacacaggccgcgagctgtccccggaggaagcccaccgtgccgggctcattgactggaacatgttcgtgaaactcagaagccaggagtgcgactgggaggagatctcagtgaagggtcccaatggggagtcctcagtgatacacgacaggaagtctggcaagaagttctccatcgaagaggccctgcagagtggcaggctgacccctgctcagtatgaccgctatgtcaacaaggatatgtccatccaggagctggcggtcttggtatctgggcagaagtaggcacagctcttgcaactcttcgtaacggcagacgctggccctctcctacgacgcagtgacctccttggtgtcgtcctctcccttgccctggtgcaggccaagcattttatacataccctcgctgccaggctgctcagagtcccgcccacatatgagacaggcactggctgaagacaggcaactctcgtcccaaccatcattcaccctgagtgacgtacttcatcctccaatgactggacaactgcgatgccttttcctcccttttcctgtacactcccagcaacaaactcctcatgataactgcacacaatctgaaaaccactgaaggacaagccaaccacagcagccaagcccactccttgcagcatgggtactggtggcacaccagacagtgacactgccccacaaaggcctgggcccgtgggggctgctgcctggcatgacatctctccagatttctggcttaaaaccaactttccatccgagaagcctcctcagtagttactctgctcatgagacagatctgggctccaagccaggaaaggtgaacagaaaccacaagtgtccagccctcggtgctggagtggacgttaattgtcagccaccagactgtcccggcacctacagagaatgtttcacagttctggcatttaaatcctttgatagtggattgtgctgctgttagccttagtttcagtgctttacaagtctcgcttattatctcactggtatttaggtatacaaaacagttgattattcaccacgccaatatctgggtctctgtatctcatgtagaacataagaaaatgggaactaatagggaaatttatttatagcatgaaaataaacctggtggctggagtctgcttgtacggtc

SEQ ID NO: 21933 - DNA, 6808 bp, Homo sapiens
agccggccgtggtggctccgtgcgtccgagcgtccgtccgcgccgtcggccatggccaagcgctccaggggccccgggcgccgctgcctgttggcgctcgtgctgttctgcgcctgggggacgctggccgtggtggcccagaagccgggcgcagggtgtccgagccgctgcctgtgcttccgcaccaccgtgcgctgcatgcatctgctgctggaggccgtgcccgccgtggcgccgcagacctccatcctagatcttcgctttaacagaatcagagagatccaacctggggcattcaggcggctgaggaacttgaacacattgcttctcaataataatcagatcaagaggatacctagtggagcatttgaagacttggaaaatttaaaatatctctatctgtacaagaatgagatccagtcaattgacaggcaagcatttaagggacttgcctctctagagcaactatacctgcactttaatcagatagaaactttggacccagattcgttccagcatctcccgaagctcgagaggctatttttgcataacaaccggattacacatttagttccagggacatttaatcacttggaatctatgaagagattgcgactggactcaaacacacttcactgcgactgtgaaatcctgtggttggcggatttgctgaaaacctacgcggagtcggggaacgcgcaggcagcggccatctgtgaatatcccagacgcatccagggacgctcagtggcaaccatcaccccggaagagctgaactgtgaaaggccccggatcacctccgagccccaggacgcagatgtgacctcggggaacaccgtgtacttcacctgcagagccgaaggcaaccccaagcctgagatcatctggctgcgaaacaataatgagctgagcatgaagacagattcccgcctaaacttgctggacgatgggaccctgatgatccagaacacacaggagacagaccagggtatctaccagtgcatggcaaagaacgtggccggagaggtgaagacgcaagaggtgaccctcaggtacttcgggtctccagctcgacccacttttgtaatccagccacagaatacagaggtgctggttggggagagcgtcacgctggagtgcagcgccacaggccaccccccgccgcggatctcctggacgagaggtgaccgcacacccttgccagttgacccgcgggtgaacatcacgccttctggcgggctttacatacagaacgtcgtacagggggacagcggagagtatgcgtgctctgcgaccaacaacattgacagcgtccatgccaccgctttcatcatcgtccaggctcttcctcagttcactgtgacgcctcaggacagagtcgttattgagggccagaccgtggatttccagtgtgaagccaagggcaacccgccgcccgtcatcgcctggaccaagggagggagccagctctccgtggaccggcggcacctggtcctgtcatcgggaacacttagaatctctggtgttgccctccacgaccagggccagtacgaatgccaggctgtcaacatcatcggctcccagaaggtcgtggcccacctgactgtgcagcccagagtcaccccagtgtttgccagcattcccagcgacacaacagtggaggtgggcgccaatgtgcagctcccgtgcagctcccagggcgagcccgagccagccatcacctggaacaaggatggggttcaggtgacagaaagtggaaaatttcacatcagccctgaaggattcttgaccatcaatgacgttggccctgcagacgcaggtcgctatgagtgtgtggcccggaacaccattgggtcggcctcggtgagcatggtgctcagtgtgaatgttcctgacgtcagtcgaaatggagatccgtttgtagctacctccatcgtggaagcgattgcgactgttgacagagctataaactcaacccgaacacatttgtttgacagccgtcctcgttctccaaatgatttgctggccttgttccggtatccgagggatccttacacagttgaacaggcacgggcgggagaaatctttgaacggacattgcagctcattcaggagcatgtacagcatggcttgatggtcgacctcaacggaacaagttaccactacaacgacctggtgtctccacagtacctgaacctcatcgcaaacctgtcgggctgtaccgcccaccggcgcgtgaacaactgctcggacatgtgcttccaccagaagtaccggacgcacgacggcacctgtaacaacctgcagcaccccatgtggggcgcctcgctgaccgccttcgagcgcctgctgaaatccgtgtacgagaatggcttcaacacccctcggggcatcaacccccaccgactgtacaacgggcacgcccttcccatgccgcgcctggtgtccaccaccctgatcgggacggagaccgtcacacccgacgagcagttcacccacatgctgatgcagtggggccagttcctggaccacgacctcgactccacggtggtggccctgagccaggcacgcttctccgacggacagcactgcagcaacgtgtgcagcaacgaccccccctgcttctctgtcatgatcccccccaatgactcccgggccaggagcggggcccgctgcatgttcttcgtgcgctccagccctgtgtgcggcagcggcatgacttcgctgctcatgaactccgtgtacccgcgggagcagatcaaccagctcacctcctacatagacgcatccaacgtgtacgggagcacggagcatgaggcccgcagcatccgcgacctggccagccaccgcggcctgctgcggcagggcatcgtgcagcggtccgggaagccgctgctccccttcgccaccgggccgcccacggagtgcatgcgggacgagaacgagagccccatcccctgcttcctggccggggaccaccgcgccaacgagcagctgggcctgaccagcatgcacacgctgtggttccgcgagcacaaccgcattgccacggagctgctcaagctgaacccgcactgggacggcgacaccatctactatgagaccaggaagatcgtgggtgcggagatccagcacatcacctaccagcactggctcccgaagatcctgggggaggtgggcatgaggacgctgggagagtaccacggctacgaccccggcatcaatgctggcatcttcaacgccttcgccaccgcggccttcaggtttggccacacgcttgtcaacccactgctttaccggctggacgagaacttccagcccattgcacaagatcacctcccccttcacaaagctttcttctctcccttccggattgtgaatgagggcggcatcgatccgcttctcagggggctgttcggggtggcggggaaaatgcgtgtgccctcgcagctgctgaacacggagctcacggagcggctgttctccatggcacacacggtggctctggacctggcggccatcaacatccagcggggccgggaccacgggatcccaccctaccacgactacagggtctactgcaatctatcggcggcacacacgttcgaggacctgaaaaatgagattaaaaaccctgagatccgggagaaactgaaaaggttgtatggctcgacactcaacatcgacctgtttccggcgctcgtggtggaggacctggtgcctggcagccggctgggccccaccctgatgtgtcttctcagcacacagttcaagcgcctgcgagatggggacaggttgtggtatgagaaccctggggtgttctccccggcccagctgactcagatcaagcagacgtcgctggccaggatcctatgcgacaacgcggacaacatcacccgggtgcagagcgacgtgttcagggtggcggagttccctcacggctacggcagctgtgacgagatccccagggtagacctccgggtgtggcaggactgctgtgaagactgtaggaccagggggcagttcaatgccttttcctatcatttccgaggcagacggtctcttgagttcagctaccaggaggacaagccgaccaagaaaacaagaccacggaaaatacccagtgttgggagacagggggaacatctcagcaacagcacctcagccttcagcacacgctcagatgcatctgggacaaatgacttcagagagtttgttctggaaatgcagaagaccatcacagacctcagaacacagataaagaaacttgaatcacggctcagtaccacagagtgcgtggatgccgggggcgaatctcacgccaacaacaccaagtggaaaaaagatgcatgcaccatttgtgaatgcaaagacgggcaggtcacctgcttcgtggaagcttgcccccctgccacctgtgctgtccccgtgaacatcccaggggcctgctgtccagtctgcttacagaagagggcggaggaaaagccctaggctcctgggaggctcctcagagtttgtctgctgtgccatcgtgagatcgggtggccgatggcagggagctgcggactgcagaccaggaaacacccagaactcgtgacatttcatgacaacgtccagctggtgctgttacagaaggcagtgcaggaggcttccaaccagagcatctgcggagaaggaggcacagcaggtgcctgaagggaagcaggcaggagtcctagcttcacgttagacttctcaggtttttatttaattcttttaaaatgaaaaattggtgctactattaaattgcacagttgaatcatttaggcgcctaaattgattttgcctcccaacaccatttctttttaaataaagcaggatacctctatatgtcagccttgccttgttcagatgccaggagccggcagacctgtcacccgcaggtggggtgagtcttggagctgccagaggggctcaccgaaatcggggttccatcacaagctatgtttaaaaagaaaattggtgtttggcaaacggaacagaacctttgatgagagcgttcacagggacactgtctgggggtgcagtgcaagcccccggcctcttccctgggaacctctgaactcctccttcctctgggctctctgtaacatttcaccacacgtcagcatctaatcccaagacaaacattcccgctgctcgaagcagctgtatagcctgtgactctccgtgtgtcagctccttccacacctgattagaacattcataagccacatttagaaacaggtttgctttcagctgtcacttgcacacatactgcctagttgtgaaccaaatgtgaaaaaacctccttcatcccattgtgtatctgatacctgccgagggccaagggtgtgtgttgacaacgccgctcccagccggccctggttgcgtccacgtcctgaacaagagccgcttccggatggctcttcccaagggaggaggagctcaagtgtcgggaactgtctaacttcaggttgtgtgagtgcgttaaaaaaaaaaaaaaaaaagaatccctatacctcatttgtatttttaaaatgcgtgatgttttatgaaattgtgtccattttttaggtattagatatggcagaaaaaccatttccactatgcaaagttcttttagacgtcagtgaaaatcaactctcatacctcatggtctctctttaattgaccaaaaccttccatttttctctaaatacaaagcgatctgtgttctgagcaacctttccccgaacacacagcttcagtgcagcacgctgacctgagtatccaccatgtgccaggcacagtgctgggcacacgaggcaccaaggtccgggccacctgcccgcagcaaggcccagctgaggtggtggagggagcccctgaggtcaggggccgtttcggttcagggtggcaggtgtccagcactggggtatggcgtcgaggcttccatggggtgggggaggccagcttccttctgacaggatgggcgcatacagtgcctggtgtgatttgtgcacaacccgtgttccaggtgcacatcctcccaaggagacacccagacccttccagcacgggccggccaagttgctgcggcggaggcagcatttcagctgtgaggaaggtcattggattcatgtgttttatctgtaaaaatggttgtcttaacttcttaacctcatattggtaagtgattgataaaaattggttggtgtttcatgacatgtggacttcttttgaaatagcaagtcaaatgtagtgaccaaattgtggaagagatttctgtcaaataggaaatgtgtaagttcgtctaaaagctgatggttatgtaagttgctcaggcactcagatgacagcagattctgggttctgggagtgttctgtgcctcttacatgccctggaggcctcatggtctcagtgctgaggcggcacacctgtagcacacctgcgtaatgtgcggtctgggccagtcacaaggaattgtgttgtctaagccaaagggggaagctgactgtgatttaccaaaaaaaattctgtaattcaaaccaaaatgtctgcggaatcaccagtttgatactctctgtaatcagaacagtgggcagtgcctgggtgaacgtgtctagcagccactgtgcgggatcgctgtaacaggagtggaatgtacatatttatttacttttctaactgctccaacagccaaatgccttttttatgaccattgtattcagttcattaccaaagaaatgtttgcactttgtaatgatgcctttcagttcaaataaatgggtcacattttcaaatgga

SEQ ID NO: 21934 - DNA, 2643 bp, Homo sapiens
ccaggggccccgggcgccgctgcctgttggcgctcgtgctgttctgcgcctgggggacgctggccgtggtggcccagaagccgggcgcagggtgtccgagccgctgcctgtgcttccgcaccaccgtgcgctgcatgcatctgctgctggaggccgtgcccgccgtggcgccgcagacctccatcctagatcttcgctttaacagaatcagagagatccaacctggggcattcaggcggctgaggaacttgaacacattgcttctcaataataatcagatcaagaggatacctagtggagcatttgaagacttggaaaatttaaaatatctctatctgtacaagaatgagatccagtcaattgacaggcaagcatttaagggacttgcctctctagagcaactatacctgcactttaatcagatagaaactttggacccagattcgttccagcatctcccgaagctcgagaggctatttttgcataacaaccggattacacatttagttccagggacatttaatcacttggaatctatgaagagattgcgactggactcaaacacacttcactgcgactgtgaaatcctgtggttggcggatttgctgaaaacctacgcggagtcggggaacgcgcaggcagcggccatctgtgaatatcccagacgcatccagggacgctcagtggcaaccatcaccccggaagagctgaactgtgaaaggccccggatcacctccgagccccaggacgcagatgtgacctcggggaacaccgtgtacttcacctgcagagccgaaggcaaccccaagcctgagatcatctggctgcgaaacaataatgagctgagcatgaagacagattcccgcctaaacttgctggacgatgggaccctgatgatccagaacacacaggagacagaccagggtatctaccagtgcatggcaaagaacgtggccggagaggtgaagacgcaagaggtgaccctcaggtacttcgggtctccagctcgacccacttttgtaatccagccacagaatacagaggtgctggttggggagagcgtcacgctggagtgcagcgccacaggccaccccccgccgcggatctcctggacgagaggtgaccgcacacccttgccagttgacccgcgggtgaacatcacgccttctggcgggctttacatacagaacgtcgtacagggggacagcggagagtatgcgtgctctgcgaccaacaacattgacagcgtccatgccaccgctttcatcatcgtccaggctcttcctcagttcactgtgacgcctcaggacagagtcgttattgagggccagaccgtggatttccagtgtgaagccaagggcaacccgccgcccgtcatcgcctggaccaagggagggagccagctctccgtggaccggcggcacctggtcctgtcatcgggaacacttagaatctctggtgttgccctccacgaccagggccagtacgaatgccaggctgtcaacatcatcggctcccagaaggtcgtggcccacctgactgtgcagcccagagtcaccccagtgtttgccagcattcccagcgacacaacagtggaggtgggcgccaatgtgcagctcccgtgcagctcccagggcgagcccgagccagccatcacctggaacaaggatggggttcaggtgacagaaagtggaaaatttcacatcagccctgaaggattcttgaccatcaatgacgttggccctgcagacgcaggtcgctatgagtgtgtggcccggaacaccattgggtcggcctcggtgagcatggtgctcagtgtgaatgttcctgacgtcagtcgaaatggagatccgtttgtagctacctccatcgtggaagcgattgcgactgttgacagagctataaactcaacccgaacacatttgtttgacagccgtcctcgttctccaaatgatttgctggccttgttccggtatccgagggatccttacacagttgaacaggcacgggcgggagaaatctttgaacggacattgcagctcattcaggagcatgtacagcatggcttgatggtcgacctcaacggaacaagtcagtgccaaagccttttcttcctcctccatggcctgagtaacggggttgaacacgcctcagttaagtcacattcctagggaagagttccagcattttctttcccactgtgcttatgaactgtgaaattatttccttaaactgtgattcctcttgagccctacagccctgtcgctctcactttggtttaataggaatctctgggggacgtgaagtcccttggagtgctgatcaggctacagcaggtccacctgccctgagtgggttatgccatcctggccagggtgggttatgcaagcccagtccctctgcaacaaatgagccataagggaggacttggcagcgtgcttgctccctgagtgacgttgtgtcctgggaatgcggtgccacgcgtattaggagggttgttttggaagagtcccgggtctgtgaaaccagctgatgagatcacctcgggctggtgtggagatgctgttgggggaggtatgtcccccactcactctgctctggcactttgccgttgcccagtaaataacagatgcctttacatgt

SEQ ID NO: 21935 - DNA, 1584 bp, Homo sapiens
ccctgcgtctctgcccgccccgtggcgcccgagtgcactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgacgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaagaggtctcttcataattgaccccaatggagtcatcaagcatttgagcgtcaacgatctcccagtgggccgaagcgtggaagaaaccctccgcttggtgaaggcgttccagtatgtagaaacacatggagaagtctgcccagcgaactggacaccggattctcctacgatcaagccaagtccagctgcttccaaagagtactttcagaaggtaaatcagtagatcacccatgtgtatctgcaccttctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctataataaagtagagcaacacacattgaaagcttctgatcaacggtcctgaaattttcatcttgaatgtctttgtattaaactgaattttcttttaagctaacaaagatcataattttcaatgattagccgtgtaactcctgcaatgaatgtttatgtgattgaagcaaatgtgaatcgtattattttaaaaagtggcagagtgacttaactgatcatgcatgatccctcatccctgaaattgagtttatgtagtcattttacttattttattcattagctaactttgtctatgtatatttctagatattgattagtgtaatcgattataaaggatatttatcaaatccagggattgcattttgaaattataattattttctttgctgaagtattcattgtaaaacatacaaaataaacatattttaaaacatttgcatttt

SEQ ID NO: 21936 - DNA, 1537 bp, Homo sapiens
ccctgcgtctctgcccgccccgtggcgcccgagtgcactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgacgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaagaggtctcttcataattgaccccaatggagtcatcaagcatttgagcgtcaacgatctcccagtgggccgaagcgtggaagaaaccctccgcttggtgaaggcgttccagtatgtagaaacacatggagaagtctgcccagcgaactggacaccggattctcctacgatcaagccaagtccagctgcttccaaagagtactttcagaaggtaaatcagtagatcacccatgtgtatctgcaccttctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctataataaagtagagcaacacacattgaaagcttctgatcaacggtcctgaaattttcatcttgaatgtctttgtattaaactgaattttcttttaagctaacaaagatcataattttcaatgattagccgtgtaactcctgcaatgaatgtttatgtgattgaagcaaatgtgaatcgtattattttaaaaagtggcagagtgacttaactgatcatgcatgatccctcatccctgaaattgagtttatgtagtcattttacttattttattcattagctaactttgtctatgtatatttctagatattgattagtgtaatcgattataaaggatatttatcaaatccagggattgcattttgaaattataattattttctttgctgaagtattcattgtaaaacatacaaaataaacatattttaaaacatttgcattttaccacca

SEQ ID NO: 21937 - DNA, 893 bp, Homo sapiens
cgcgcctgcgcagtggaggcggcccaggcccgccttccgcagggtgtcgccgctgtgccgctagcggtgccccgcctgctgcggtggcaccagccaggaggcggagtggaagtggccgtggggcgggtatgggactagctggcgtgtgcgccctgagacgctcagcgggctatatactcgtcggtggggccggcggtcagtctgcggcagcggcagcaagacggtacagtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgttccaagacacacctgccagggtttgtggagcaggctgaggctctgaaggccaagggagtccaggtggtggcctgtctgagtgttaatgatgcctttgtgactggcgagtggggccgagcccacaaggcggaaggcaaggttcggctcctggctgatcccactggggcctttgggaaggagacagacttattactagatgattcgctggtgtccatctttgggaatcgacgtctcaagaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgcccagccctgtgctggggccctgcaattggaatgttggccagatttctgcaataaacacttgtggtttgcggcca

SEQ ID NO: 21938 - DNA, 463 bp, Homo sapiens
caggaggcggagtggaagtggccgtggggcgggtatgggactagctggcgtgtgcgccctgagacgctcagcgggctatatactcgtcggtggggccggcggtcagtctgcggcagcggcagcaagacggtacagtgaaggagagtgggcgtctggcggggtccgcagtttcagcagagccgctgcagccatggccccaatcaaggttcggctcctggctgatcccactggggcctttgggaaggagacagacttattactagatgattcgctggtgtccatctttgggaatcgacgtctcaagaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgcccagc

SEQ ID NO: 21939 - DNA, 596 bp, Homo sapiens
caggaggcggagtggaagtggccgtggggcgggtatgggactagctggcgtgtgcgccctgagacgctcagcgggctatatactcgtcggtggggccggcggtcagtctgcggcagcggcagcaagacggtacagtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagagctgttcaagggcaagaagggtgtgctgtttggagttcctggggccttcacccctggatgttccaaggttcggctcctggctgatcccactggggcctttgggaaggagacagacttattactagatgattcgctggtgtccatctttgggaatcgacgtctcaagaggttctccatggtggtacaggatggcatagtgaaggccctgaatgtggaaccagatggcacaggcctcacctgcagcctggcacccaatatcatctcacagctctgaggccctgggccagattacttcctccacccctccctatctcacctgccca

SEQ ID NO: 21940 - DNA, 1751 bp, Homo sapiens
ccccgcccccgccgccccagtccccgcccctcgcgccttcgtttattcctccgcgcgctgggacaggctgcttcttcgccagaaccaaccggttgcttgctgtcccagcggcgccccctcatcaccgtcgccatgcccggaggtctgcttctcggggacgtggctcccaactttgaggccaataccaccgtcggccgcatccgtttccacgactttctgggagactcatggggcattctcttctcccaccctcgggactttaccccagtgtgcaccacagagcttggcagagctgcaaagctggcaccagaatttgccaagaggaatgttaagttgattgccctttcaatagacagtgttgaggaccatcttgcctggagcaaggatatcaatgcttacaattgtgaagagcccacagaaaagttaccttttcccatcatcgatgataggaatcgggagcttgccatcctgttgggcatgctggatccagcagagaaggatgaaaagggcatgcctgtgacagctcgtgtggtgtttgtttttggtcctgataagaagctgaagctgtctatcctctacccagctaccactggcaggaactttgatgagattctcagggtagtcatctctctccagctgacagcagaaaaaagggttgccaccccagttgattggaaggatggggatagtgtgatggtccttccaaccatccctgaagaagaagccaaaaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaattccataaacacatcctggtgtcatcacagccaaggtttttaggttgctataccaatggcttattaaatgaaaatggcactaaaagtttcttgagattctttatactctctgccttcagcaatcaattccattcatacatcagcactctgctggttctgtttgaaatatgttctgtatttaaaactcaaatcttgttggatctctgcagggcttgtgaccaatgaagtcatatttgttgatggttgacaaagcttgcttcactccatcagagaatgactatcaatttttttttaactgtcctatcacgtcctctcctgtcacccattttgaagagtggcagaacttgaagttcaacttcctctgtaaatatccaagtataaagcccaggaacttctagaataacccagatgcgctttaattttttttaatatgttttgatcacagaacttctagaataacccagatgctctttcatattcttttaatacatcttgatcacagctgggggaaaaaaagctttttaattctataccttcctagtagataagtgaagagcagggaaagagacctttaaatattttgctataaaaaaatttgtgataagtttctatcaaaatggggagattgcagaaaaggcttcccttggctcccaaggaggtgtagcaggtgtgagcaatattagtgccatgtgcctttcacacagggtttgcatttatcagtctgttttccgatgatgtgtacatgaaagagtacaccatgtgaagagaagagagaatgattgaaaatgttttagtatagaactcttcttgcagtgggttgctattttctagattttactttttagggaacaaaataaaatcctttgttaaaactggg

SEQ ID NO: 21941 - DNA, 4385 bp, Homo sapiens
cgatcgatctcctccggctccgacgtcctcggcctgccgggtcccgggtcctttgcggcgctagggtgggcgaacccagagcgacgctccgggacgatgtggggcagcgatcgcctggcgggtgctgggggaggcggggcggcagtgactgtggccttcaccaacgctcgcgactgcttcctccacctgccgcggcgtctcgtggcccagctgcatctgctgcagaatcaagctatagaagtggtctggagtcaccagcctgcattcttgagctgggtggaaggcaggcattttagtgatcaaggtgaaaatgtggctgaaattaacagacaagttggtcaaaaacttggactctcaaatgggggacaggtatttctcaagccatgttcccatgtggtatcttgtcaacaagttgaggtggaacccctctcagcagatgattgggagatactggagctgcatgctgtttcccttgaacaacatcttctagatcaaattcgaatagtttttccaaaagccatttttcctgtttgggttgatcaacaaacgtacatatttatccaaattgttgcactaataccagctgcctcttatggaaggctggaaactgacaccaaactccttattcagccaaagacacgccgagccaaagagaatacattttcaaaagctgatgctgaatataaaaaacttcatagttatggaagagaccagaaaggaatgatgaaagaacttcaaaccaagcaacttcagtcaaatactgtgggaatcactgaatctaatgaaaacgagtcagagattccagttgactcatcatcagtagcaagtttatggactatgataggaagcattttttcctttcaatctgagaagaaacaagagacatcttggggtttaactgaaatcaatgcattcaaaaatatgcagtcaaaggttgttcctctagacaatattttcagagtatgcaaatctcaacctcctagtatatataacgcgtcagcaacctctgtttttcataaacactgtgccattcatgtatttccatgggaccaggaatattttgatgtagagcccagctttactgtgacatatggaaagctagttaagctactttctccaaagcaacagcaaagtaaaacaaaacaaaatgtgttatcacctgaaaaagagaagcagatgtcagagccactagatcaaaaaaaaattaggtcagatcataatgaagaagatgagaaggcctgtgtgctacaagtagtctggaatggacttgaagaattgaacaatgccatcaaatataccaaaaatgtagaagttctccatcttgggaaagtctggattccagatgacctgaggaagagactaaatatagaaatgcatgccgtagtcaggataactccagtggaagttacccctaaaattccaagatctctaaagttacaacctagagagaatttacctaaagacataagtgaagaagacataaaaactgtattttattcatggctacagcagtctactaccaccatgcttcctttggtaatatcagaggaagaatttattaagctggaaactaaagatggactgaaggaattttctctgagtatagttcattcttgggaaaaagaaaaagataaaaatatttttctgttgagtcccaatttgctgcagaagactacaatacaagtccttctagatcctatggtaaaagaagaaaacagtgaggaaattgactttattcttccttttttaaagctgagctctttgggaggagtgaattccttaggcgtatcctccttggagcacatcactcacagcctcctgggacgccctttgtctcggcagctgatgtctcttgttgcaggacttaggaatggagctcttttactcacaggaggaaagggaagtggaaaatcaactttagccaaagcaatctgtaaagaagcatttgacaaactggatgcccatgtggagagagttgactgtaaagctttacgaggaaaaaggcttgaaaacatacaaaaaaccctagaggtggctttctcagaggcagtgtggatgcagccatctgttgtcctgctggatgaccttgacctcattgctggactgcctgctgtcccggaacatgagcacagtcctgatgcggtgcagagccagcggcttgctcatgctttgaatgatatgataaaagagtttatctccatgggaagtttggttgcactgattgccacaagtcagtctcagcaatctctacatcctttacttgtttctgctcaaggagttcacatatttcagtgcgtccaacacattcagcctcctaatcaggaacaaagatgtgaaattctgtgtaatgtaataaaaaataaattggactgtgatataaacaagttcaccgatcttgacctgcagcatgtagctaaagaaactggcgggtttgtggctagagattttacagtacttgtggatcgagccatacattctcgactctctcgtcagagtatatccaccagagaaaaattagttttaacaacattggacttccaaaaggctctccgcggatttcttcctgcgtctttgcgaagtgtcaacctgcataaacctagagacctgggttgggacaagattggtgggttacatgaagttaggcagatactcatggatactatccagttacctgccaagtatccagaattatttgcaaacttgcccatacgacaaagaacaggaatactgttgtatggtccgcctggaacaggaaaaaccttactagctggggtaattgcacgagagagtagaatgaattttataagtgtcaaggggccagagttactcagcaaatacattggagcaagtgaacaagctgttcgggatatttttattagagcacaggctgcaaagccctgcattcttttctttgatgaatttgaatccattgctcctcggcggggtcatgataatacaggagttacagaccgagtagttaaccagttgctgactcagttggatggagtagaaggcttacagggtgtttatgtattggctgctactagtcgccctgacttgattgaccctgccctgcttaggcctggtcgactagataaatgtgtatactgtcctcctcctgatcaggtgtcacgtcttgaaattttaaatgtcctcagtgactctctacctctggcagatgatgttgaccttcagcatgtagcatcagtaactgactcctttactggagctgatctgaaagctttactttacaatgcccaattggaggccttacatggaatgctgctctcgagtggactccaggatggaagttccagctctgatagtgacctaagtctgtcttcaatggtctttcttaaccatagcagtggctctgacgattcagctggagatggagaatgtggcttagatcagtcccttgtttctttagagatgtccgagatccttccagatgaatcaaaattcaatatgtaccggctctactttggaagctcttatgaatcagaacttggaaatggaacctcttctgatttgagctcacaatgtctctctgcaccaagctccatgactcaggatttgcctggagttcctgggaaagaccagttgttttcacagcctccagtgttaaggacagcttcacaagagggttgccaagaacttacacaagaacaaagagatcaactgagggcagatatcagtattatcaaaggcagataccggagccaaagtggagaggacgaatccatgaaccaaccaggaccaatcaaaaccagactggctattagtcagtcacatttaatgactgcacttggtcacacaagaccatccattagtgaagatgactggaagaattttgctgagctatatgaaagctttcaaaatccaaagaggagaaaaaatcaaagtggaacaatgtttcgacctggacagaaagtaactttagcataaaatatacttctttttgatttggttctgttaagttttttgatggcttttccatatgttgtaacaggaaaaaaatggtgtctatgaatttcttcttaatttaacaaatttggttaatttataaaatcacagattggtaaatgctataattatgtaatgatcaggattgagattaatactgtagtataaattgggacattataacagattccatattttatttcctaaaatctaaattcagtctttaatgaaataatattagccaaatggtggaactaatttatttcttttgaggaaaagataataaagaatgtaattaaatttaaatttcttggaattcccagttgtatattcatcacctttgtagcatttgacaaattttatgcttagcagcttcttcactgttttgaaataaaatatcctattacctactgatacaa

SEQ ID NO: 21942 - DNA, 3681 bp, Homo sapiens
atgtggggcagcgatcgcctggcgggtgctgggggaggcggggcggcagtgactgtggccttcaccaacgctcgcgactgcttcctccacctgccgcggcgtctcgtggcccagctgcatctgctgcagaatcaagctatagaagtggtctggagtcaccagcctgcattcttgagctgggtggaaggcaggcattttagtgatcaaggtgaaaatgtggctgaaattaacagacaagttggtcaaaaacttggactctcaaatgggggacaggtatttctcaagccatgttcccatgtggtatcttgtcaacaagttgaggtggaacccctctcagcagatgattgggagatactggagctgcatgctgtttcccttgaacaacatcttctagatcaaattcgaatagtttttccaaaagccatttttcctgtttgggttgatcaacaaacgtacatatttatccaaattgttgcactaataccagctgcctcttatggaaggctggaaactgacaccaaactccttattcagccaaagacacgccgagccaaagagaatacattttcaaaagctgatgctgaatataaaaaacttcatagttatggaagagaccagaaaggaatgatgaaagaacttcaaaccaagcaacttcagtcaaatactgtgggaatcactgaatctaatgaaaacgagtcagagattccagttgactcatcatcagtagcaagtttatggactatgataggaagcattttttcctttcaatctgagaagaaacaagagacatcttggggtttaactgaaatcaatgcattcaaaaatatgcagtcaaaggttgttcctctagacaatattttcagagtatgcaaatctcaacctcctagtatatataacgcgtcagcaacctctgtttttcataaacactgtgccattcatgtatttccatgggaccaggaatattttgatgtagagcccagctttactgtgacatatggaaagctagttaagctactttctccaaagcaacagcaaagtaaaacaaaacaaaatgtgttatcacctgaaaaagagaagcagatgtcagagccactagatcaaaaaaaaattaggtcagatcataatgaagaagatgagaaggcctgtgtgctacaagtagtctggaatggacttgaagaattgaacaatgccatcaaatataccaaaaatgtagaagttctccatcttgggaaagtctggattccagatgacctgaggaagagactaaatatagaaatgcatgccgtagtcaggataactccagtggaagttacccctaaaattccaagatctctaaagttacaacctagagagaatttacctaaagacataagtgaagaagacataaaaactgtattttattcatggctacagcagtctactaccaccatgcttcctttggtaatatcagaggaagaatttattaagctggaaactaaagatggactgaaggaattttctctgagtatagttcattcttgggaaaaagaaaaagataaaaatatttttctgttgagtcccaatttgctgcagaagactacaatacaagtccttctagatcctatggtaaaagaagaaaacagtgaggaaattgactttattcttccttttttaaagctgagctctttgggaggagtgaattccttaggcgtatcctccttggagcacatcactcacagcctcctgggacgccctttgtctcggcagctgatgtctcttgttgcaggacttaggaatggagctcttttactcacaggaggaaagggaagtggaaaatcaactttagccaaagcaatctgtaaagaagcatttgacaaactggatgcccatgtggagagagttgactgtaaagctttacgagctttgaatgatatgataaaagagtttatctccatgggaagtttggttgcactgattgccacaagtcagtctcagcaatctctacatcctttacttgtttctgctcaaggagttcacatatttcagtgcgtccaacacattcagcctcctaatcaggaacaaagatgtgaaattctgtgtaatgtaataaaaaataaattggactgtgatataaacaagttcaccgatcttgacctgcagcatgtagctaaagaaactggcgggtttgtggctagagattttacagtacttgtggatcgagccatacattctcgactctctcgtcagagtatatccaccagagaaaaattagttttaacaacattggacttccaaaaggctctccgcggatttcttcctgcgtctttgcgaagtgtcaacctgcataaacctagagacctgggttgggacaagattggtgggttacatgaagttaggcagatactcatggatactatccagttacctgccaagtatccagaattatttgcaaacttgcccatacgacaaagaacaggaatactgttgtatggtccgcctggaacaggaaaaaccttactagctggggtaattgcacgagagagtagaatgaattttataagtgtcaaggggccagagttactcagcaaatacattggagcaagtgaacaagctgttcgggatatttttattagagcacaggctgcaaagccctgcattcttttctttgatgaatttgaatccattgctcctcggcggggtcatgataatacaggagttacagaccgagtagttaaccagttgctgactcagttggatggagtagaaggcttacagggtgtttatgtattggctgctactagtcgccctgacttgattgaccctgccctgcttaggcctggtcgactagataaatgtgtatactgtcctcctcctgatcaggtgtcacgtcttgaaattttaaatgtcctcagtgactctctacctctggcagatgatgttgaccttcagcatgtagcatcagtaactgactcctttactggagctgatctgaaagctttactttacaatgcccaattggaggccttacatggaatgctgctctcgagtggactccaggatggaagttccagctctgatagtgacctaagtctgtcttcaatggtctttcttaaccatagcagtggctctgacgattcagctggagatggagaatgtggcttagatcagtcccttgtttctttagagatgtccgagatccttccagatgaatcaaaattcaatatgtaccggctctactttggaagctcttatgaatcagaacttggaaatggaacctcttctgatttgagctcacaatgtctctctgcaccaagctccatgactcaggatttgcctggagttcctgggaaagaccagttgttttcacagcctccagtgttaaggacagcttcacaagagggttgccaagaacttacacaagaacaaagagatcaactgagggcagatatcagtattatcaaaggcagataccggagccaaagtggagaggacgaatccatgaaccaaccaggaccaatcaaaaccagactggctattagtcagtcacatttaatgactgcacttggtcacacaagaccatccattagtgaagatgactggaagaattttgctgagctatatgaaagctttcaaaatccaaagaggagaaaaaatcaaagtggaacaatgtttcgacctggacagaaagtaactttagcataa

SEQ ID NO: 21943 - DNA, 1411 bp, Homo sapiens
aaaaaaaaattaggtcagatcataatgaagaagatgagaaggcctgtgtgctacaagtagtctggaatggacttgaagaattgaacaatgccatcaaatataccaaaaatgtagaagttctccatcttgggaaagtctggattccagatgacctgaggaagagactaaatatagaaatgcatgccgtagtcaggataactccagtggaagttacccctaaaattccaagatctctaaagttacaacctagagagaatttacctaaagacataagtgaagaagacataaaaactgtattttattcatggctacagcagtctactaccaccatgcttcctttggtaatatcagaggaagaatttattaagctggaaactaaagatggactgaaggaattttctctgagtatagttcattcttgggaaaaagaaaaagataaaaatatttttctgttgagtcccaatttgctgcagaagactacaatacaaaggagtgaattccttaggcgtatcctccttggagcacatcactcacagcctcctgggacgccctttgtctcggcagctgatgtctcttgttgcaggacttaggaatggagctcttttactcacaggaggaaagggaagtggaaaatcaactttagccaaagcaatctgtaaagaagcatttgacaaactggatgcccatgtggagagagttgactgtaaagctttacgaggaaaaaggcttgaaaacatacaaaaaaccctagaggtggctttctcagaggcagtgtggatgcagccatctgttgtcctgctggatgaccttgacctcattgctggactgcctgctgtcccggaacatgagcacagtcctgatgcggtgcagagccagcggcttgctcatgctttgaatgatatgataaaagagtttatctccatgggaagtttggttgcactgattgccacaagtcagtctcagcaatctctacatcctttacttgtttctgctcaaggagttcacatatttcagtgcgtccaacacattcagcctcctaatcagaattagttttaacaacattggacttccaaaaggctctccgcggatttcttcctgcgtctttgcgaagtgtcaacctgcataaacctagagacctgggttgggacaagattggtgggttacatgaagttaggcagatactcatggatactatccagttacctgccaagtatccagaattatttgcaaacttgcccatacgacaaagaacaggaatactgttgtatggtccgcctggaacaggaaaaaccttactagctggggtaattgcacgagagagtagaatgaattttataagtgtcaaggggccagagttactcagcaaatacattggagcaagtgaacaagctgttcgggatatttttattag

SEQ ID NO: 21944 - DNA, 2593 bp, Homo sapiens
atgtggggcagcgatcgcctggcgggtgctgggggaggcggggcggcagtgactgtggccttcaccaacgctcgcgactgcttcctccacctgccgcggcgtctcgtggcccagctgcatctgctgcagaatcaagctatagaagtggtctggagtcaccagcctgcattcttgagctgggtggaaggcaggcattttagtgatcaaggtgaaaatgtggctgaaattaacagacaagttggtcaaaaacttggactctcaaatgggggacaggtatttctcaagccatgttcccatgtggtatcttgtcaacaagttgaggtggaacccctctcagcagatgattgggagatactggagctgcatgctgtttcccttgaacaacatcttctagatcaaattcgaatagtttttccaaaagccatttttcctgtttgggttgatcaacaaacgtacatatttatccaaattgttgcactaataccagctgcctcttatggaaggctggaaactgacaccaaactccttattcagccaaagacacgccgagccaaagagaatacattttcaaaagctgatgctgaatataaaaaacttcatagttatggaagagaccagaaaggaatgatgaaagaacttcaaaccaagcaacttcagtcaaatactgtgggaatcactgaatctaatgaaaacgagtcagagattccagttgactcatcatcagtagcaagtttatggactatgataggaagcattttttcctttcaatctgagaagaaacaagagacatcttggggtttaactgaaatcaatgcattcaaaaatatgcagtcaaaggttgttcctctagacaatattttcagagtatgcaaatctcaacctcctagtatatataacgcgtcagcaacctctgtttttcataaacactgtgccattcatgtatttccatgggaccaggaatattttgatgtagagcccagctttactgtgacatatggaaagctagttaagctactttctccaaagcaacagcaaagtaaaacaaaacaaaatgtgttatcacctgaaaaagagaagcagatgtcagagccactagatcaaaaaaaaattaggtcagatcataatgaagaagatgagaaggcctgtgtgctacaagtagtctggaatggacttgaagaattgaacaatgccatcaaatataccaaaaatgtagaagttctccatcttgggaaagtctggattccagatgacctgaggaagagactaaatatagaaatgcatgccgtagtcaggataactccagtggaagttacccctaaaattccaagatctctaaagttacaacctagagagaatttacctaaagacataagtgaagaagacataaaaactgtattttattcatggctacagcagtctactaccaccatgcttcctttggtaatatcagaggaagaatttattaagctggaaactaaagatggactgaaggaattttctctgagtatagttcattcttgggaaaaagaaaaagataaaaatatttttctgttgagtcccaatttgctgcagaagactacaatacaagtccttctagatcctatggtaaaagaagaaaacagtgaggaaattgactttattcttccttttttaaagctgagctctttgggaggagtgaattccttaggcgtatcctccttggagcacatcactcacagcctcctgggacgccctttgtctcggcagctgatgtctcttgttgcaggacttaggaatggagctcttttactcacaggaggaaagggaagtggaaaatcaactttagccaaagcaatctgtaaagaagcatttgacaaactggatgcccatgtggagagagttgactgtaaagctttacgaggaaaaaggcttgaaaacatacaaaaaaccctagaggtggctttctcagaggcagtgtggatgcagccatctgttgtcctgctggatgaccttgacctcattgctggactgcctgctgtcccggaacatgagcacagtcctgatgcggtgcagagccagcggcttgctcatgctttgaatgatatgataaaagagtttatctccatgggaagtttggttgcactgattgccacaagtcagtctcagcaatctctacatcctttacttgtttctgctcaaggagttcacatatttcagtgcgtccaacacattcagcctcctaatcagaattagttttaacaacattggacttccaaaaggctctccgcggatttcttcctgcgtctttgcgaagtgtcaacctgcataaacctagagacctgggttgggacaagattggtgggttacatgaagttaggcagatactcatggatactatccagttacctgccaagtatccagaattatttgcaaacttgcccatacgacaaagaacaggaatactgttgtatggtccgcctggaacaggaaaaaccttactagctggggtaattgcacgagagagtagaatgaattttataagtgtcaaggggccagagttactcagcaaatacattggagcaagtgaacaagctgttcgggatatttttattag

SEQ ID NO: 21945 - DNA, 2038 bp, Homo sapiens
ctgctcgggaccacccgaacccgcggccatggccccggccgccgccagccccccggaggtgatccgcgcggcgcagaaggacgagtactaccgcggtgggctgcggagcgcggcgggcggcgccctgcacagcctggcgggtgcgaggaagtggctggagtggaggaaggaggttgagctgctctcagatgtggcctactttggcctcaccacacttgcaggctaccagaccctgggggaggagtacgtcagcatcatccaggtggacccatcgcggatacatgtgccctcctcgctgcgccgtggcgtgctggtgacactgcatgccgtcctgccctacctgctggacaaggccctgctccccctggagcaggagctgcaggctgaccccgacagtgggcgacccttgcaggggagcctggggccaggtgggcgtggctgctcaggggcgcggcgctggatgcgtcaccacacggccaccctgactgagcagcagaggagggcgctgctgcgggcggtcttcgtcctcagacagggcctcgcctgcctccagcggctacatgttgcctggttttacatccacggtgtcttctaccacctggccaagaggctcacggggatcacgtaccaggcgctgaggccagatcccctcagggtcctgatgagtgtggcgccatctgccttacagctccgtgtccgcagcctgcccggagaggacctgagggcccgtgttagctacaggctgctgggggtcatctcactgctgcacctggtgctgtccatggggctgcagctgtacggtttcaggcagcggcagcgagccaggaaggagtggaggctgcaccgcggcctgtctcaccgcagggcctccttggaggagagagccgtttccagaaaccccctgtgcaccctgtgcctggaggagcgcaggcacccaacagccacgccctgcggccacctgttctgctgggagtgcatcaccgcgtggtgcagcagcaaggcggagtgtcccctctgccgggagaagttccctccccagaagctcatctaccttcggcactaccgctgagccggcgcccgggtgggcctggacacagatgacctctacgggagtctgaacgccaagatttagtctcaggattaaccttgcttgcacagaagttagaacactctcagttttttgtcatgtaagatactaacctagccaccctgggagagaacagaaagctgtccctggctgcgctttctcagccctgggaggggcgcctgaacccagaacatttccctaaccccaacctggtaggactcagccacttcttcaggaatttcacttatttggacgggattttaggtttccctcccttccccaaaccatacagttgagaagtaattcagaagtaggccagaagacactttattcgtttatattgtgagaaaacagccccatcaggcttgtgttaaggcaatggactgaatgagtgcgtgctgggtggggtggggcacggaggctggcgggttgcttcagccagtgcagtgagaacagcagccccacggccccatgggaggcggcgctgctctccccgagggcggctgggcagagcacatcccccaggacttgatgaccacacggggcagagagaaaccaaccaaggccagcacctccgtcggaagcatttggcacacacaccttcaatacacgtcaaggtcgcttccagttttagaaaacagaaatctgcatctcagcctgagacgcacagagaggtctcttcctgacccagacgcactcacgagccaggtcctgggggtatgggggctgccaggggcgcccgagccctctcctggggggcctgctgggcaggcgacctgctgacccacggtcactgctgtgttcagcccctcagctcggccccagcctatttcccgcctccatttgatgtttccaggttttcaaaactgcatttaacctgcgccagagagttcaccgtaggcatctttaataaactaactccagcaaaatgtgggtacgttactaacacaa

SEQ ID NO: 21946 - DNA, 1997 bp, Homo sapiens
atcagttctcgcccgtctgggcgtgggcgtggccggcgtggctgctcgggaccacccgaacccgcggccatggccccggccgccgccagccccccggaggtgatccgcgcggcgcagaaggacgagtactaccgcggtgggctgcggagcgcggcgggcggcgccctgcacagcctggcgggtgcgaggaagtggctggagtggaggaaggaggttgagctgctctcagatgtggcctactttggcctcaccacacttgcaggctaccagaccctgggggaggagtacgtcagcatcatccaggtggacccatcgcggatacatgtgccctcctcgctgcgccgtggcgtgctggtgacactgcatgccgtcctgccctacctgctggacaaggccctgctccccctggagcaggagctgcaggctgaccccgacagtgggcgacccttgcaggggagcctggggccaggtgggcgtggctgctcaggggcgcggcgctggatgcgtcaccacacggccaccctgactgagcagcagaggagggcgctgctgcgggcggtcttcgtcctcagacagggcctcgcctgcctccagcggctacatgttgcctggttttacatccacggtgtcttctaccacctggccaagaggctcacggggatcacgtacctccgtgtccgcagcctgcccggagaggacctgagggcccgtgttagctacaggctgctgggggtcatctcactgctgcacctggtgctgtccatggggctgcagctgtacggtttcaggcagcggcagcgagccaggaaggagtggaggctgcaccgcggcctgtctcaccgcagggcctccttggaggagagagccgtttccagaaaccccctgtgcaccctgtgcctggaggagcgcaggcacccaacagccacgccctgcggccacctgttctgctgggagtgcatcaccgcgtggtgcagcagcaaggcggagtgtcccctctgccgggagaagttccctccccagaagctcatctaccttcggcactaccgctgagccggcgcccgggtgggcctggacacagatgacctctacgggagtctgaacgccaagatttagtctcaggattaaccttgcttgcacagaagttagaacactctcagttttttgtcatgtaagatactaacctagccaccctgggagagaacagaaagctgtccctggctgcgctttctcagccctgggaggggcgcctgaacccagaacatttccctaaccccaacctggtaggactcagccacttcttcaggaatttcacttatttggacgggattttaggtttccctcccttccccaaaccatacagttgagaagtaattcagaagtaggccagaagacactttattcgtttatattgtgagaaaacagccccatcaggcttgtgttaaggcaatggactgaatgagtgcgtgctgggtggggtggggcacggaggctggcgggttgcttcagccagtgcagtgagaacagcagccccacggccccatgggaggcggcgctgctctccccgagggcggctgggcagagcacatcccccaggacttgatgaccacacggggcagagagaaaccaaccaaggccagcacctccgtcggaagcatttggcacacacaccttcaatacacgtcaaggtcgcttccagttttagaaaacagaaatctgcatctcagcctgagacgcacagagaggtctcttcctgacccagacgcactcacgagccaggtcctgggggtatgggggctgccaggggcgcccgagccctctcctggggggcctgctgggcaggcgacctgctgacccacggtcactgctgtgttcagcccctcagctcggccccagcctatttcccgcctccatttgatgtttccaggttttcaaaactgcatttaacctgcgccagagagttcaccgtaggcatctttaataaactaactccagcaaaa

SEQ ID NO: 21947 - DNA, 2740 bp, Homo sapiens
agaaagtgtgcccgccccctctggggcggagagactcagcccctccccctcagcggataacctgggactgaccgttccctggggatccgacgggccccagaggacccacgcctgagccccgtgcgactcgtggcctttgggctagaagccatggacgccttcacccgcttcaccaaccagacccagggccgggaccgactcttcagagccactcagtacacatgcatgttgcttagatatttgttagagcccaaagctggcaaagagaaggtggtaatgaagctcaagaaactggagtccagtgtgagcactggtcgtaaatggttcagactaggcaatgtggtacatgctatacaggcaactgagcagagcattcatgccactgacctggtacctcgcttatgcttaacattagccaacctgaaccgtgtgatttatttcatctgtgacaccatcctctgggtgaggagcgtaggtctcacctctggcatcaacaaagagaaatggcgaacgagggctgctcaccactactactattctcttctgctgagcctggtcagggatctgtatgaaatctccctgcagatgaaacgagttacatgtgacagggcaaagaaagagaaatcagcatcccaggatcctctttggttcagcgtggctgaggaggaaacagaatggctccaatcctttctacttcttttattccgatctctgaagcagcatcctcccttgctcctggacacagtgaagaacctttgtgatatcctgaaccctttggaccagctggggatctataaatccaatcctggcatcattggacttggaggtcttgtgtcctctatagcaggcatgatcactgtggcatatcctcagatgaagctgaagacccgttagggtgtttttaggcttggaactagtacctactttaaaagatggcctcttggtgggacagacatttgtataagtcacaggccatgtcatactgtgcttaagttcttgttcatgtgagcatttaacaacctgtgatgtgggcagagatgaggccaagaacggagaagggaggagcatgaagagttgtatgtttttggagtgctggagtgacttgtgaatttctgaatattttcccttcatctaacattgattgaacatctcttatgtgcatagtgggagcttagtatttgctgaatgaataaaaattgaaaggaaaaaatttaaaaagacccaatcgcactgatcattgaacaccagtatacaataactttagggtcatatggatcattggtttcacgattacagtaggtctggtgcatggcactctcagatctagtagaggctctgatgtcagtagcaggatggaggagagctgggcttacagcctctcaacttgttggcccttataccatcactgcactcatgtccttgctctgtgcagaagtagaatcagaaaagcatcaggcaccttcatggtataaattgtgtctatgggtgcagtgaataagcaaaaatcagaagcagaccggagggacttataaaaataggtacagggtcacaatgggtgcctatatgtagcctgtgacagataagaagctgacagtgagacaaacaaaaaactgaggctagagcctcattcctctgactcctaatccagtgttctctccatgctctcccactgtcttcagaattgagtagaaatgtgatcccctcctgaatcctgttttttgcctcttactctcccataatttggaaatttccttgtccagtggtttatattcttttctagaaaaactaaaactgggtggagtgtggtggctcacacctataatcccagcactttgggaggctgaagcggaaggattgcttgaggccaggagttcaagaccagcctgggcaatgtagtgagactccttctctacaacaaagtgttaaaaaattagccaggcatggtggagtatgcctgtagtcccagatactctggaggctgaagcaggaggatcacttgagcccaggagttcaaggctgcagtgagcttccaccgcactccagcccgggtgatagagcaagaccctgtgtcttaaaaaaaaattaagacagtatttagacttatcagttagattgttttatttaaatccttctaacaatttaggcaattctacattaattttcatcaaaatttatccagtcaaaaaaatttcatgaatactccagatgtaagagagtcacaattttctacgataaatcagacatcttatttctagggtgattgagggaggtggaaagcgcaggaggaagccagtgaagaggacaatggaatgctgagtcaatgacattgacttgtgttcctatctgccatcttgggtgtgggtctttatatgtggttacagatcctttagtttgagggaggtgaggtagagaaataggatgccagcaggtaggaggccgatgtcagtcctcccagcaaagctgtgtcatttatctgaatggaaatgagaaaataaatatgtactcaataagtcacatttcccagaaatgtgattgagattctcaaaaaatagactcagattcttggctgtctgtttaaccaatcacgatatgggatttgagaaataaaatttagggaattttaagagacatgaaagctactaggtcagggaaaataaaaagcttaaataactatttttattgtccagatcctctactgtaatagattaactatgttcaataaatttctagacaaaattga

SEQ ID NO: 21948 - DNA, 1062 bp, Homo sapiens
ggagttgccatggcgtcgctgagcggcctggcgtcggcgctggagtcgtacaggggccgggaccgcctgatccgagtgctggggtactgctgccagctggttggtggagttctggttgaacagtgtcccgccaggtccgaagtggggacacgtctgttggtggtgtccacccaactcagccactgcaggaccatcttgcgactctttgatgacctggccatgtttgtctacactaagcaatatggcctgggggcacaggaggaggacgcctttgtccgctgtgtctccgtcctagggaacctggctgaccagctctactacccctgtgagcacgtggcctgggcggctgatgcccgggtcctccacgtggactcttctcggtggtggacgctgagtacaaccctgtgggccctctctctgctcctgggggttgccaggtccctgtggatgctgctgaaactgagacagaggctgcggagccccacggcgcccttcaccagcccgctgccccggggcaagcggagggccatggaggcgcagatgcagtcggaggcgctgtcacttctcagcaacctggccgacctggccaacgccgtgcactggctgccccggggcgtgctgtgggccggccgcttcccgccgtggctagtgggcctcatgggcaccatctcctcaatcctcagcatgtaccaggcggcccgggccggcggccaggccgaggccactaccccctgacactgccggaagagcacagggacacagccagagcccacggagggcccttcccgcaaagcagaagccgccagggcaggggccggggctctcatggagctgcctgtggtgaaacccatgggcagggtgggtggagggactgatgcgaggtcccccaggcctcagcctggagctcctgagccgtgacagttttcaggggccgtgcagggcttcagcagcacctcctgcctgccagctggcgtcttgtatccaaatcaagatgaggaagagggggcctgtcgtgccttgagaaagctggaacgggaatcaattaaacattgtggtgctggc

SEQ ID NO: 21949 - DNA, 806 bp, Homo sapiens
gtacaggggccgggaccgcctgatccgagtgctggggtactgctgccagctggttggtggagttctggttgaacagtgtcccgccaggtccgaagtggggacacgtctgttggtggtgtccacccaactcagccactgcaggaccatcttgcgactctttgatgacctggccatgtttgtctacactaagcaatatggcctgggggcacaggaggaggacgcctttgtccgctgtgtctccgtcctagggaacctggctgaccagctctactacccctgtgagcacgtggcctgggcggctgatgcccgggtcctccacgtggactcttctcggtggtggacgctgagtacaaccctgtgggccctctctctgctcctgggggttgccaggtccctgtggatgctgctgaaactgagacagaggctgcggagccccacggcgcccttcaccagcatgtaccaggcggcccgggccggcggccaggccgaggccactaccccctgacactgccggaagagcacagggacacagccagagcccacggagggcccttcccgcaaagcagaagccgccagggcaggggccggggctctcatggagctgcctgtggtgaaacccatgggcagggtgggtggagggactgatgcgaggtcccccaggcctcagcctggagctcctgagccgtgacagttttcaggggccgtgcagggcttcagcagcacctcctgcctgccagctggcgtcttgtatccaaatcaagatgaggaagagggggcctgtcgtgccttgagaaagctggaacggg

SEQ ID NO: 21950 - DNA, 1739 bp, Homo sapiens
tcaggggtaggagcgggagccgagaggaggcggaggagatggcgtcccagccgccacctccccccaaaccctgggagacccgccgaattccgggagccggaccgggaccaggaccgggccccactttccaatctgctgatttgggtcctactttaatgacaagacctggacaaccagcacttaccagagtgcccccacctattcttccaaggccatcacagcagacaggaagtagcagtgtgaacacttttagacctgcttacagttcattttcttctggatatggtgcctatggaaattcattttatggaggctatagtccttatagttatggatataatgggctgggctacaaccgcctccgtgtagatgatcttccacccagtagatttgttcagcaagctgaagaaagcagcaggggtgcatttcagtccattgaaagtattgtgcatgcatttgcctctgtcagtatgatgatggatgctaccttttcagctgtctataacagtttcagggctgtattggatgtagcaaatcacttttcccgattgaaaatacactttacaaaagtgttttcagcttttgcattggttaggactatacggtatctttacagacggctacagcggatgttaggtttaagaagaggctctgagaatgaagacctctgggcagagagtgaaggaactgtggcatgccttggtgctgaggaccgagcagctacctcagcaaaatcttggccaatattcttgttctttgctgttatccttggtggtccttacctcatttggaaactattgtctactcacagtgatgaagtaacagacagcatcaactgggcaagtggtgaggatgaccatgtagttgccagagcagaatatgattttgctgccgtatctgaagaagaaatttctttccgggctggtgatatgctgaacttagctctcaaagaacaacaacccaaagtgcgtggttggcttctggctagccttgatggccaaacaacaggacttatacctgcgaattatgtcaaaattcttggcaaaagaaaaggtaggaaaacggtggaatcaagtaaagtttccaagcagcaacaatcttttaccaacccaacactaactaaaggagccacggttgctgattctttggatgaacaggaagctgcctttgaatctgtttttgttgaaactaataaggttccagttgcacctgattccattgggaaagatggagaaaagcaagatctttgatatctttcatgtttgcctgcagttgaacaatactttagagtactttttaaaattatttctcacaaagaaatgaatgtacaatccaatgaaaacatttgttattggctatttcaggtgttttgctgctagaaattattaaagttacacactagtatgttggtctggtgacctggttacattttattatacacattattggaccataaggacatttgtttcacctagattttaagattatggagactgctgtcatttttatcttatttaaatctctaggtttattggaagagtaagattgatgaactatagcatgcacagtttggtacagtagagatcattaatacttttaaaagttctgcattaattgacttggaatccttagaaatggagtggtgacatgtcagtatgagaacaggcaaaaggtaaatttttttttttttttacaaccttaagtaatctcaataataaaattttctgatctgtattata

SEQ ID NO: 21951 - DNA, 1985 bp, Homo sapiens
agtctgggcgggagggcgagagcgagggcgcctgggagaaacctcgcccagcggcggttgattagtcaggcctcagaaagatggcgtcctcggagcaggcagagcagccgagccagccaagctctactccaggaagtgaaaatgtgctgcctcgagagccgctgattgccacggcagtgaagtttctacagaattcccgggtccgccagagcccacttgcaaccaggagagcattcctaaagaagaaagggctgacagatgaagagattgatatggccttccagcagtcgggcactgctgccgatgagccttcgtccttgggcccagccacacaggtggttcctgtccagccccctcacctcatatctcagccatacagtcccgcaggctcccgatggcgagattacggcgccctggccatcatcatggcaggcattgcatttggctttcaccagctctacaagaaatacctgctccccctcatcctgggcggccgagaggacagaaagcagctggagaggatggaggccggtctctctgagctgagtggcagcgtggcccagacagtgactcagttacagacgaccctcgcctccgtccaggagctgctgattcagcagcagcagaagatccaggagcttgcccacgagctggccgctgccaaggccaccacatccaccaactggatcctggagtcccagaatatcaacgaactcaagtccgaaattaactccttgaaagggcttcttttaaatcggaggcagttccctccatccccatcagccccgaagatcccctcctggcagatcccagtcaagtcaccgtcaccctccagccctgcggccgtgaaccaccacagcagcagcgacatctcacctgtcagcaacgagtccacgtcgtcctcgcctgggaaggagggccacagccccgagggctccacggtcacctaccacttgctgggcccccaggaggaaggcgagggggtggtggacgtcaagggccaggtgcggatggaggtgcaaggcgaggaggagaagagggaggacaaggaggacgaggaggatgaggaggatgatgatgtgagccatgtggacgaggaggactgcctgggggtgcagagggaggaccgccggggcggggatgggcagatcaacgagcaggtggagaagctgcggcggcccgagggcgccagcaacgagagtgagcgggactagggctgcgcctgctgcctccagccctgaggatggcatctagtgtgcccgtgcgtggccataccctgcctccctctctggccctgggagggcagcttggagcccaggtagggggcagagctgtcctcagctgcactgcggcctggtggcagtgtggggagtcacacttctgtccacctggcctcctctcgcctggccgccagccccagccccagccccagccccaggcccagctgcctttggctttgatctcaagtcaggctgaaggcagcgaagcctcggggcccaagcccctccccagccccctctcccggacagacgccttgcccagggtgtgtttgctgagtgtcttgactaccgtgacaccacgcatggccagagctagcgtccctactgcctcccgactcctcagtggaggaggagctgcggtccctctggtgtctgccatccccctccctccctgggcccggccctggacccgtcaggtgcctgtccccagccccaaccccactcatgccccgtcgtcctcccagacaaatgaaaccacgctgcgcttccgatgcccccgcttgccgtgtaatggttcagctaatcccatggcgagatgggggctcactccggaggaggagccaggcagcagggccttcctgaccaacagccagctctgtccttccccccaggaaacacatgttcatttgtgtgatcatgtatagacctcagaacggaagataggactgtatataattgtaataaataccagttgccactatttaa

SEQ ID NO: 21952 - DNA, 1393 bp, Homo sapiens
gtcaggcctcagaaagatggcgtcctcggagcaggcagagcagccgagccagccaagctctactccaggaagtgaaaatgtgctgcctcgagagccgctgggctgacagatgaagagattgatatggccttccagcagtcgggcactgctgccgatgagccttcgtccttgggcccagccacacaggtggttcctgtccagccccctcacctcatatctcagccatacagtcccgcaggctcccgatggcgagattacggcgccctggccatcatcatggcaggcattgcatttggctttcaccagctctacaagaaatacctgctccccctcatcctgggcggccgagaggacagaaagcagctggagaggatggaggccggtctctctgagctgagtggcagcgtggcccagacagtgactcagttacagacgaccctcgcctccgtccaggagctgctgattcagcagcagcagaagatccaggagcttgcccacgagctggccgctgccaaggccaccacatccaccaactggatcctggagtcccagaatatcaacgaactcaagtccgaaattaactccttgaaagggcttcttttaaatcggaggcagttccctccatccccatcagccccgaagatcccctcctggcagatcccagtcaagtcaccgtcaccctccagccctgcggccgtgaaccaccacagcagcagcgacatctcacctgtcagcaacgagtccacgtcgtcctcgcctgggaaggagggccacagccccgagggctccacggtcacctaccacttgctgggcccccaggaggaaggcgagggggtggtggacgtcaagggccaggtgcggatggaggtgcaaggcgaggaggagaagagggaggacaaggaggacgaggaggatgaggaggatgatgatgtgagccatgtggacgaggaggactgcctgggggtgcagagggaggaccgccggggcggggatgggcagatcaacgagcaggtggagaagctgcggcggcccgagggcgccagcaacgagagtgagcgggactagggctgcgcctgctgcctccagccctgaggatggcatctagtgtgcccgtgcgtggccataccctgcctccctctctggccctgggagggcagcttggagcccaggtagggggcagagctgtcctcagctgcactgcggcctggtggcagtgtggggagtcacacttctgtccacctggcctcctctcgcctggccgccagccccagccccagccccagccccaggcccagctgcctttggctttgatctcaagtcaggctgaaggcagcgaagcctcggggcccaagcccctccccagccccctctcccggacagacgccttgcccag

SEQ ID NO: 21953 - DNA, 1479 bp, Homo sapiens
gtcggtgccgagggcaggatggagaagctgcggctcctgggcctccgctaccaggagtacgtgactcgtcacccggccgccacggcccagctggagacagcagtgcggggcttcagttacctgctggcaggtcgattcgccgattcgcacgagctgtcagagctggtgtactctgcctctaacctgcttgtgctgctcaatgacgggatcctacggaaggagcttcggaaaaagttgcctgtgtcgctgtcccagcagaagctgctgacatggctgagcgtgctggagtgcgtggaggtgttcatggagatgggagctgccaaggtgtggggtgaagtgggccgctggcttgtcatcgccctcgtccagctggccaaggctgtactgcggatgctcctgctgctctggttcaaggctggcctccagacttcaccccctatcgttccactggacagagagacccaggcacagcccccggatggtgaccacagccctggcaaccatgagcagtcctacgtggggaagcggtcaaaccgggtggtgcgaaccctccagaacacgccgtccctgcactccaggcactggggagctccccagcagcgggagggacggcagcagcagcatcacgaggagctgagtgcgacccccacccccctggggctgcaggagaccatcgcagagtttttgtacattgcccggccgctgctgcacttgctcagcctgggcctgtggggtcagaggtcgtggaaaccctggctcttggctggtgttgtggacgtgaccagcctgagcctcctgagtgacagaaagggcctgacccggagggagcggcgggagctgcggcgccggaccatcctgctgctctactacctgctgcgctctcctttctatgaccgcttctccgaggccaggatcctcttcctgctccagttgctggccgaccacgtccctggcgttggcctggtcacaacgtcccagcgtgcggcctctccgtgcctaccggccaggccccacacacagccctggtcgccaccagcgttcctcccaggacacccttgactgcgctctcctgtgacgatgccactgcagcccgcaccttgtcactgctgggccaagaagccttcactaggagtgggatccaggctcctctcccacagaaagcggtgacttcacctcatggagcccgggaagctgctcgcctcggcagccataggagcgaacactgctgctctctcgctggcccctggtgaggacaggaagcctgaacccgggtgatggctgaacgctgcccagcgtgtcttctggctggggccctccgtctgccccttctccgcagggccctgtggctctggcagccccaggccatggcgttgccagcctccctgtgacagagcctggtgaacagtgagcctggctcccacgcaagtggcactttaagccctgcatcctcggttgagagtaaaaggcttttctccctta

SEQ ID NO: 21954 - DNA, 1335 bp, Homo sapiens
acttgagggagtagggggccgggtttgggccctcagttgctaagggctacccgagtgggaagcggttcaagagatggggtgaagggtggttcaccggttcttcaagtcctcagccttctggcccgcggaagttaagcaaccaagaggcgggcctaagaccggaagcaggaaggagggcgcaggaagcagggcgccgcagcctgtcgtacggtccttctgtgggtctgtcggtgccgagggcaggatggagaagctgcggctcctgggcctccgctaccaggagtacgtgactcgtcacccggccgccacggcccagctggagacagcagtgcggggcttcagttacctgctggcaggtcgattcgccgattcgcacgagctgtcagagctggtgtactctgcctctaacctgcttgtgctgctcaatgacgggatcctacggaaggagcttcggaaaaagttgcctgtgtcgctgtcccagcagaagctgctgacatggctgagcgtgctggagtgcgtggaggtgttcatggagatgggagctgccaaggtgtggggtgaagtgggccgctggcttgtcatcgccctcgtccagctggccaaggctgtactgcggatgctcctgctgctctggttcaaggctggcctccagacttcaccccctatcgttccactggacagagagacccaggcacagcccccggatggtgaccacagccctggcaaccatgagcagtcctacgtggggaagcggtcaaaccgggtggtgcgaaccctccagaacacgccgtccctgcactccaggcactggggagctccccagcagcgggagggacggcagcagcagcatcacgaggagctgagtgcgacccccacccccctggggctgcaggagaccatcgcagagtttttgtacattgcccggccgctgctgcacttgctcagcctgggcctgtggggtcagaggtcgtggaaaccctggctcttggctggtgttgtggacgtgaccagcctgagcctcctgagtgacagaaagggcctgacccggagggagcggcgggagctgcggcgccggaccatcctgctgctctactacctgctgcgctctcctttctatgaccgcttctccgaggccaggatcctcttcctgctccagttgctggccgaccacgtccctggcgttggcctggtcacaaggccgctcatggattacttgcccacctggcagaaaatctacttctacagttggggctgacagacctcccggaaggagggtgtggggaggggtggggcagggagcccctcttccctaataaaactgactccggcagcgtc

SEQ ID NO: 21955 - DNA, 3661 bp, Homo sapiens
acggcaagtcggaggtagcaagatggccgccgctgaggaaggctgtagtgtcggggccgaagcggacagggaattggaggagcttctggaaagtgctcttgatgatttcgataaagccaaaccctccccagcacccccttctaccaccacggcccctgatgcttcggggccccagaagagatcgccaggagacactgccaaagatgccctcttcgcttcccaagagaagtttttccaggaactattcgacagtgaactggcttcccaagccactgcggagttcgagaaggcaatgaaggagttggctgaggaagaaccccacctggtggagcagttccaaaagctctcagaggctgcagggagagtgggcagtgatatgacctcccaacaagaattcacttcttgcctaaaggaaacactaagtggattagccaaaaatgccactgaccttcagaactccagcatgtcggaagaagagctgaccaaggccatggaggggctaggcatggacgaaggggatggggaagggaacatcctccccatcatgcagagtattatgcagaacctactctccaaggatgtgctgtacccatcactgaaggagatcacagaaaagtatccagaatggttgcagagtcatcgggaatctctacctccagagcagtttgaaaaatatcaggagcagcacagcgtcatgtgcaaaatatgtgagcagtttgaggcagagacccccacagacagtgaaaccactcaaaaggctcgttttgagatggtgctggatcttatgcagcagctacaagatttaggccatcctccaaaagagctggctggagagatgcctcctggcctcaactttgacctggatgccctcaatctttcgggcccaccaggtgccagtggtgaacagtgtctgatcatgtgaaacacaacacgttttcctctctgagtcccagctatggggaacatctggagtcagcagaaccattgggacctgaggcaggagtgtcacctgcgggagaagtctgcccgctgccctctgtcatcccattcaagattgtgccataccagctgaggtttttcctctgtctctctaggaatagggtctgtttcacaggccatttctgtgaaccctactccattgtggtttctgccactatcaaagttccagctacctgcaaggtgaaggaaggcatcccttttggggcatgcactttctttcctttctcaaaataatgttatatgtggccacactgatgttcacctttacgtccagggtctttgtgccttgtctctactccctctcttggatctggggaggaggggcagagacctgggactctgtatttctatagttctcctggcagagcctttgagaatggggagaaacagcctgggctggggctacaggtctgtcactatgctctcttgccttcagacagaccattctgaattctctaaagggaaagggcttttgcatctaatcacaatagagttgaaagagaggccttaggattctcctctctctaggtgctgagccctcacctccctgttccaggctgagaactcaaatggttaccctgcttcttcctacaatgctgtgtgatatgggtgaacccagcccctgaccttcctctatcccctgcccatcctcccttttacctcctctcttttttaaacacctgtttatcccaacctttttgagctcaagctgtgataaagaagggcccatcctatttcccctcatctagtccatttacgattctcactgactccccgtcttcctggcagacacaaataaacccagtgtcaggtctaggaaattaatggctattcttccccagatacattctggcttatttgagatacatgattctcttagaatcctgtcccttggttcaggaaagtagcttggaaaaggagtaggggtatagcttgggtcccttttcctgcaaggccccatggggcagaatataataaatattctgagtgaggagtgtggtctttttctgatcttcctcagcttccgtaagttgcagagtgaggtatattaggagactagttctacacaatattgtaatgctgggttccatcaacacccaccttccacaactcagtctgcacctcagttggcaaaggagactggatggccatctttcctcatgttcccttgagtatttcaatgtagaaagcccttcaagtggtattatattttaaccttttacattattgttattaatgttagtaatatattgttatgttttctaaattatttttctttaagctgacgtggctttttttctgtggctcccagtgggtctacggaccttggctgacatatgttggtaggtactctggtcagctcagctggctgtcctggttcactcagaagataagtctctccaaagcaaattcacatgcattatgagtcgctttgagcttctgacatgtcacttgccccgaggttaaaacttttcaccccttgaagaccttacatgttttatggtattggtgaggaaggaaatgttctcaaggtctcaggctatttgggaaattccaactcctataccttaccagagcatggaagagcccagatctgaatgtaaaacgtctctgttctgccagagatggaaaaaatacaggtatacttgtgatatagtcatggggcttcagtgtcactattttctccttaaagctccagccaaaaactggacaaggatagagaggaggagggaagaacaaaagagcccttctctatgaaccttgtgccttctgtcctaccagttttcttttacagattctcacttctgctagcctagccagggcttactccaggaatctaaatagatgccctagtccactttatctttgttcccaaggcactcatttttattttgattttgattgaatgtgagcaggttgacctcaggtcacactttgttccaaaaacttttggaattattccaggacttgtggtggagttatggtactctagggcagtctttctcaaactatgtatggtaaaggaccaggttttttgttttccagtccttcacttatcaatatgcattcctattgcccatgacaggtatggagttcacactgtgtgctgccgacccggcaagtttgacagcacccaaactggccagactgttctgtaggttaagtccattgatcatgtacttggatatcacagcaacattgaaatgctaaaaagtttttaaacactctcaatttctaattcaccatgtcacagactggtgaaaaaaaaaaaaaggtgttcactgaccagcacaagtctgcagatcatctttgagtagcactgttttggggccctcggtctctctgaagaccctagcagaactgatacctacctgtatctcttgttctctcctatttgagtttcacttccagagaacttgttcttcagcaagaatgtgtcactagtaaggacatctctagcatttctctagccttccttttctgctgctcaaaaataatcgttacaaagcttaggtttaagctgtatatgaaatatttatgcgactctcaaactttaaaggagttgctcctttgttccaaaattaaatgtgttagataaatttgtgattgtatgggtggcttcatgaattaagaattgaattaatacagactttttgataat

SEQ ID NO: 21956 - DNA, 796 bp, Homo sapiens
ttatctgcagagatcaggccaaagggagctctagaaggttgttggggagcactaaactggagaataagagaagatagtttaatgccgtaccatggagtctggtgctcttgatgatttcgataaagccaaaccctccccagcacccccttctaccaccacggcccctgatgcttcggggccccagaagagatcgccaggagacactgccaaagatgccctcttcgcttcccaagagaagtttttccaggaactattcgacagtgaactggcttcccaagccactgcggagttcgagaaggcaatgaaggagttggctgaggaagaaccccacctggtggagcagttccaaaagctctcagaggctgcagggagagtgggcagtgatatgacctcccaacaagaattcacttcttgcctaaaggaaacactaagtggattagccaaaaatgccactgaccttcagaactccagcatgtcggaagaagagctgaccaaggccatggaggggctaggcatggacgaaggggatggggaagggaacatcctccccatcatgcagagtattatgcagaacctactctccaaggatgtgctgtacccatcactgaaggagatcacagaaaagtatccagaatggttgcagagtcatcgggaatctctacctccagagcagtttgaaaaatatcaggagcagcacagcgtcatgtgcaaaatatgtgagcagtttgaggcagagacccccacagacagtgaaaccactcaaaaggctcgttttgagatggtgctggatcttatg

SEQ ID NO: 21957 - DNA, 1910 bp, Homo sapiens
atggagtctggtgctcttgatgatttcgataaagccaaaccctccccagcacccccttctaccaccacggcccctgatgcttcggggccccagaagagatcgccaggagacactgccaaagatgccctcttcgcttcccaagagaagtttttccaggaactattcgacagtgaactggcttcccaagccactgcggagttcgagaaggcaatgaaggagttggctgaggaagaaccccacctggtggagcagttccaaaagctctcagaggctgcagggagagtgggcagtgatatgacctcccaacaagaattcacttcttgcctaaaggaaacactaagtggattagccaaaaatgccactgaccttcagaactccagcatgtcggaagaagagctgaccaaggccatggaggggctaggcatggacgaaggggatggggaagggaacatcctccccatcatgcagagtattatgcagaacctactctccaaggatgtgctgtacccatcactgaaggagatcacagaaaagtatccagaatggttgcagagtcatcgggaatctctacctccagagcagtttgaaaaatatcaggagcagcacagcgtcatgtgcaaaatatgtgagcagtttgaggcagagacccccacagacagtgaaaccactcaaaaggctcgttttgagatggtgctggatcttatgcagcagctacaagatttaggccatcctccaaaagagctggctggagagatgcctcctggcctcaactttgacctggatgccctcaatctttcgggcccaccaggtgccagtggtgaacagtgtctgatcatgtgaaacacaacacgttttcctctctgagtcccagctatggggaacatctggagtcagcagaaccattgggacctgaggcaggagtgtcacctgcgggagaagtctgcccgctgccctctgtcatcccattcaagattgtgccataccagctgaggtttttcctctgtctctctaggaatagggtctgtttcacaggccatttctgtgaaccctactccattgtggtttctgccactatcaaagttccagctacctgcaaggtgaaggaaggcatcccttttggggcatgcactttctttcctttctcaaaataatgttatatgtggccacactgatgttcacctttacgtccagggtctttgtgccttgtctctactccctctcttggatctggggaggaggggcagagacctgggactctgtatttctatagttctcctggcagagcctttgagaatggggagaaacagcctgggctggggctacaggtctgtcactatgctctcttgccttcagacagaccattctgaattctctaaagggaaagggcttttgcatctaatcacaatagagttgaaagagaggccttaggattctcctctctctaggtgctgagccctcacctccctgttccaggctgagaactcaaatggttaccctgcttcttcctacaatgctgtgtgatatgggtgaacccagcccctgaccttcctctatcccctgcccatcctcccttttacctcctctcttttttaaacacctgtttatcccaacctttttgagctcaagctgtgataaagaagggcccatcctatttcccctcatctagtccatttacgattctcactgactccccgtcttcctggcagacacaaataaacccagtgtcaggtctaggaaattaatggctattcttccccagatacattctggcttatttgagatacatgattctcttagaatcctgtcccttggttcaggaaagtagcttggaaaaggagtaggggtatagcttgggtcccttttcctgcaaggccccatggggcagaatataataaatattctgagtgagg

SEQ ID NO: 21958 - DNA, 1972 bp, Homo sapiens
agatggccgccgctgaggaaggctgtagtgtcggggccgaagcggacagggaattggaggagcttctggaaagtgctcttgatgatttcgataaagccaaaccctccccagcacccccttctaccaccacggcccctgatgcttcggggccccagaagagatcgccaggagacactgccaaagatgccctcttcgcttcccaagagaagtttttccaggaactattcgacagtgaactggcttcccaagccactgcggagttcgagaaggcaatgaaggagttggctgaggaagaaccccacctggtggagcagttccaaaagctctcagaggctgcagggagagtgggcagtgatatgacctcccaacaagaattcacttcttgcctaaaggaaacactaagtggattagccaaaaatgccactgaccttcagaactccagcatgtcggaagaagagctgaccaaggccatggaggggctaggcatggacgaaggggatggggaagggaacatcctccccatcatgcagagtattatgcagaacctactctccaaggatgtgctgtacccatcactgaaggagatcacagaaaagtatccagaatggttgcagagtcatcgggaatctctacctccagagcagtttgaaaaatatcaggagcagcacagcgtcatgtgcaaaatatgtgagcagtttgaggcagagacccccacagacagtgaaaccactcaaaaggctcgttttgagatggtgctggatcttatgcagcagctacaagatttaggccatcctccaaaagagctggctggagagatgcctcctggcctcaactttgacctggatgccctcaatctttcgggcccaccaggtgccagtggtgaacagtgtctgatcatgtgaaacacaacacgttttcctctctgagtcccagctatggggaacatctggagtcagcagaaccattgggacctgaggcaggagtgtcacctgcgggagaagtctgcccgctgccctctgtcatcccattcaagattgtgccataccagctgaggtttttcctctgtctctctaggaatagggtctgtttcacaggccatttctgtgaaccctactccattgtggtttctgccactatcaaagttccagctacctgcaaggtgaaggaaggcatcccttttggggcatgcactttctttcctttctcaaaataatgttatatgtggccacactgatgttcacctttacgtccagggtctttgtgccttgtctctactccctctcttggatctggggaggaggggcagagacctgggactctgtatttctatagttctcctggcagagcctttgagaatggggagaaacagcctgggctggggctacaggtctgtcactatgctctcttgccttcagacagaccattctgaattctctaaagggaaagggcttttgcatctaatcacaatagagttgaaagagaggccttaggattctcctctctctaggtgctgagccctcacctccctgttccaggctgagaactcaaatggttaccctgcttcttcctacaatgctgtgtgatatgggtgaacccagcccctgaccttcctctatcccctgcccatcctcccttttacctcctctcttttttaaacacctgtttatcccaacctttttgagctcaagctgtgataaagaagggcccatcctatttcccctcatctagtccatttacgattctcactgactccccgtcttcctggcagacacaaataaacccagtgtcaggtctaggaaattaatggctattcttccccagatacattctggcttatttgagatacatgattctcttagaatcctgtcccttggttcaggaaagtagcttggaaaaggagtaggggtatagcttgggtcccttttcctgcaaggccccatggggcagaatataataaatattctgagtgagg

SEQ ID NO: 21959 - DNA, 894 bp, Homo sapiens
acggcaagtcggaggtagcaagatggccgccgctgaggaaggctgtagtgtcggggccgaagcggacagggaattggaggagcttctggaaagtgctcttgatgatttcgataaagccaaaccctccccagcacccccttctaccaccacggcccctgatgcttcggggccccagaagagatcgccaggagacactgccaaagatgccctcttcgcttcccaagagaagtttttccaggaactattcgacagtgaactggcttcccaagccactgcggagttcgagaaggcaatgaaggagttggctgaggaagaaccccacctggtggagcagttccaaaagctctcagaggctgcagggagagtggaactccagcatgtcggaagaagagctgaccaaggccatggaggggctaggcatggacgaaggggatggggaagggaacatcctccccatcatgcagagtattatgcagaacctactctccaaggatgtgctgtacccatcactgaaggagatcacagaaaagtatccagaatggttgcagagtcatcgggaatctctacctccagagcagtttgaaaaatatcaggagcagcacagcgtcatgtgcaaaatatgtgagcagtttgaggcagagacccccacagacagtgaaaccactcaaaaggctcgttttgagatggtgctggatcttatgcagcagctacaagatttaggccatcctccaaaagagctggctggagagatgcctcctggcctcaactttgacctggatgccctcaatctttcgggcccaccaggtgccagtggtgaacagtgtctgatcatgtgaaacacaacacgttttcctctctgagtcccagctatggggaacatctggagtcagcaga

SEQ ID NO: 21960 - DNA, 4317 bp, Homo sapiens
tgtcggcgttcgcggttgtttggccatccagtgccttcagcagcgccgctaaagcgcagttctcgttggtgtaactttttcttttttttttcagccacttccggctcctgcgtcgctccggaagcctgcgagttccggaagccttggtaatccagattcggctaggaaaagacaagctttccagagaatgtttcagagaaagttacgtggagcgtgggcgtttcgcagactcctaagtggtctggaacctaacctgcagtgtctctgagcttctggcaagtatgaggcaaggatttcacagaagaacttggagcaaaaattcccactgtcatagctataggctgtccagtcttgagggagctgcaggaacaggaaaaagagaccttcagagaagacatggcttccagaaaagagaatgcgaagagtgcaaacagagtgctaagaataagccagttggatgcacttgaactaaacaaggccctggagcagctagtttggtcccagtttactcagtgctttcatggatttaaacctgggctgttagctcgctttgagccagaggtgaaagcgtgcttatgggttttcttgtggagattcaccatctactccaaaaatgccacagtgggacagtcagttttgaatattaagtacaaaaatgatttttcccctaacctgagatatcagccacccagtaaaaatcaaaaaatctggtatgctgtttgtacaattggtggcaggtggttagaagaacgatgctatgatttgtttcgaaaccatcatttagcatcatttgggaaagtcaagcagtgtgtgaattttgtgattggacttttgaaattaggtgggctgattaattttttgattttccttcagaggggaaagtttgcaactttgacagaacgtctcctaggtattcattctgtattttgcaagcctcaaaacatatgtgaagttggctttgaatacatgaatagggaacttctctggcatggttttgctgaatttctgatttttctcttaccacttatcaatgtccagaagttgaaagccaagctgtcttcatggtgtattcctcttactggtgcacctaatagtgacaatacattagccaccagtggcaaagaatgcgctctatgtggagagtggcccaccatgcctcacaccataggatgtgagcatattttctgttatttctgtgctaagagtagtttcttatttgacgtgtactttacttgtcctaagtgtggcacagaagtacacagtctgcagccactgaaatcaggaatcgagatgtcagaagtaaatgctctttagaaactaaaattgcttcctttgaggaaaaaaatgcaccgtgtttaaattcttaatattagtcatcctaagtataccatttatgtatcctttataaggaatgtgctcctagccactgtcttctcctttccaggcatgactgaaatctaatcactggaaaccatgtgattctaaatatattatgtaaatgttaatgtattatgttttttaaatcattgcattcaatttttaatgtcaagaataatggacagcttttgtcaggtgactactaacaatgctccttcattttactacttcttaaaacaaggttggattctaaagataaagattttggagactctgggatgagtgtgcatttattttcagagttgacataatatgataatgtgacaattatgagactgttttaaaccttaagacctgatgcctcagttgtaacttttttttttttttctgagacggtgtcctgctctgtcacccaggctggagtgcagtggcgcgatctctgctcactgcaacgtccgcctcccgggttcaagcaattctcctgcctcagcctcccgagtagctggcactgcaggtgcatgccaccatgcccgggtaatttttgtatttttagtagagatggggttcactgtgttagccaggatggtctctatctcctgatctggtgatccacctgcgtcagcctcccaaagtgctgagattacagacgtgagccactgtgcttggccgcctcagttgtaatgttatgcttttctctgaagccaatttttaagaagttcagtcctcagctgtctgacccctccacagttggctttatattcagaaagtaaaaattacttaaggcagcttggaagtgaggcctgggaactactgggggcaactagtatgaacagcactatttacaggtctctttctcttgcctttgattcagagctgtcattctcagtaaatattgatagttttattgaaacaaaaggggtctttagcatgggaatagtaacagcagtgcataatcaagataattctgtatccttcactctttttctctgcctttttttacttaaaagtaaattcagactcttaaaatggtatagaattattagcttgaacattgaattatctcgtcttaactagaatgttttttaaaaaacagtttttaaatgtttttaaataaacatcttgctagtatgatggaaatacactgccagttcatttttctcttcacctttcattgaacaagtactcaggtgccaggtactgatgtagccattagaggcacaacagtatattaagcaggaaaaatcaagttaccttcatggagtttacattctgtgattgaatgaactgtaagtttaatttaggttcaatttagtgtaagatactgaagaagttttgtagtttgagttaagagtattttacatcttaagaatttgccttcttttgccttctgtaattttaaaacattattgtagaaaacaccaacaattcaggaaaaaatataaaatcaactttcccacaattttttgagagagatcatcactatattttactatatttgtagatttgttgcacgtacatttcttatttacaaaattattataatgcataaaaaatagcattttttcctatgtataaatattcttcaaaactattttagggctgagcacaatggctcatgcctgtaatcccaggctccctacttagggaggctgagcccaggagtttgagttcgtttctaaaaaaataaaaatatatacaaacgtctttgttttttgtttgtttgtttgtttttggtgagaaagggcctcacccagtcacccaggttggagtgcagtggtgtgatcatggctaaccgcagcctttccctcccagggctcaagcgatcctcccatctgagcctcccaagttgctgggaccacaggcccataccaccatgcctggctaatttttgtagagatgaggtctcactttgttgcccaggctggtcttgaacttctgggctcaagcagtcctcctaccctggcctcccaaagttgtgggattacaggcatgagccactgcacccagccataatatatttttaaaatgctatgtatatgccatcatattcctattcctattattatttaaccaccatcatagagcatttaggttcttttcactttctgttgtgaataatgcaatgttgaatctgagttcattaagtgaagagtccagctgcacactgcaggcccagtctggatgtaggtgctcagatggttctctttgagacaggctttatcctttggctctcatttttttgatgagtgtacatggcatgagggacacagattccgctagaattcaaatcccacttgtgtataacctagggcaatgtgccacatctctgcacatctgttcattgtaaggattacatgtttagtgtatataaagctcttaaaacaatgcctgacacatagtaaatagaatataatagtagtgctttcctttgctgttgtcagtattactctgagtcggtttcattctcacacagaatgatggccgctagaagctcaaggcttataatctgctagctttctgatcccactggcatgagatactcttgcctaatagttacagctaaagtccaggagctcactgttactggtctgccttggattatgtgcacattcctgaaccagccactatagctaggggatggaaaatactgttcctggttacttaaatgtaggtgatgctcctcccatataccacatgaacctaaaggagtcctggaggaggccgttcaccacaggaaactgaggtgttcttagaagggtggatgctggcagatctctactagttagagtctacatttgccttactcatttcaaaagtccacattgcagtctcattttaccagtgatctagcttgataaggacattcataagtaactggatgattctttaacattgcagatttgaaaggattaaataaagtcaacaaaattgttatatcaa

SEQ ID NO: 21961 - DNA, 4386 bp, Homo sapiens
ggaggtaagaactaagacgttcttaaaccctactacgtgctggaatcctgaagtgcctgccatcattcaaacttaagcactaactctctagagagacactgccattcataccacagaacgagaaggcagtggcgatcctcaacggctacatgtcactgcctgccacttccggctcctgcgtcgctccggaagcctgcgagttccggaagccttggtaatccagattcggctaggaaaagacaagctttccagagaatgtttcagagaaagttacgtggagcgtgggcgtttcgcagactcctaaggtcagtgtctgccctagagagccgtgtatgtagcttctggcaagtatgaggcaaggatttcacagaagaacttggagcaaaaattcccactgtcatagctataggctgtccagtcttgagggagctgcaggaacaggaaaaagagaccttcagagaagacatggcttccagaaaagagaatgcgaagagtgcaaacagagtgctaagaataagccagttggatgcacttgaactaaacaaggccctggagcagctagtttggtcccagtttactcagtgctttcatggatttaaacctgggctgttagctcgctttgagccagaggtgaaagcgtgcttatgggttttcttgtggagattcaccatctactccaaaaatgccacagtgggacagtcagttttgaatattaagtacaaaaatgatttttcccctaacctgagatatcagccacccagtaaaaatcaaaaaatctggtatgctgtttgtacaattggtggcaggtggttagaagaacgatgctatgatttgtttcgaaaccatcatttagcatcatttgggaaagtcaagcagtgtgtgaattttgtgattggacttttgaaattaggtgggctgattaattttttgattttccttcagaggggaaagtttgcaactttgacagaacgtctcctaggtattcattctgtattttgcaagcctcaaaacatatgtgaagttggctttgaatacatgaatagggaacttctctggcatggttttgctgaatttctgatttttctcttaccacttatcaatgtccagaagttgaaagccaagctgtcttcatggtgtattcctcttactggtgcacctaatagtgacaatacattagccaccagtggcaaagaatgcgctctatgtggagagtggcccaccatgcctcacaccataggatgtgagcatattttctgttatttctgtgctaagagtagtttcttatttgacgtgtactttacttgtcctaagtgtggcacagaagtacacagtctgcagccactgaaatcaggaatcgagatgtcagaagtaaatgctctttagaaactaaaattgcttcctttgaggaaaaaaatgcaccgtgtttaaattcttaatattagtcatcctaagtataccatttatgtatcctttataaggaatgtgctcctagccactgtcttctcctttccaggcatgactgaaatctaatcactggaaaccatgtgattctaaatatattatgtaaatgttaatgtattatgttttttaaatcattgcattcaatttttaatgtcaagaataatggacagcttttgtcaggtgactactaacaatgctccttcattttactacttcttaaaacaaggttggattctaaagataaagattttggagactctgggatgagtgtgcatttattttcagagttgacataatatgataatgtgacaattatgagactgttttaaaccttaagacctgatgcctcagttgtaacttttttttttttttctgagacggtgtcctgctctgtcacccaggctggagtgcagtggcgcgatctctgctcactgcaacgtccgcctcccgggttcaagcaattctcctgcctcagcctcccgagtagctggcactgcaggtgcatgccaccatgcccgggtaatttttgtatttttagtagagatggggttcactgtgttagccaggatggtctctatctcctgatctggtgatccacctgcgtcagcctcccaaagtgctgagattacagacgtgagccactgtgcttggccgcctcagttgtaatgttatgcttttctctgaagccaatttttaagaagttcagtcctcagctgtctgacccctccacagttggctttatattcagaaagtaaaaattacttaaggcagcttggaagtgaggcctgggaactactgggggcaactagtatgaacagcactatttacaggtctctttctcttgcctttgattcagagctgtcattctcagtaaatattgatagttttattgaaacaaaaggggtctttagcatgggaatagtaacagcagtgcataatcaagataattctgtatccttcactctttttctctgcctttttttacttaaaagtaaattcagactcttaaaatggtatagaattattagcttgaacattgaattatctcgtcttaactagaatgttttttaaaaaacagtttttaaatgtttttaaataaacatcttgctagtatgatggaaatacactgccagttcatttttctcttcacctttcattgaacaagtactcaggtgccaggtactgatgtagccattagaggcacaacagtatattaagcaggaaaaatcaagttaccttcatggagtttacattctgtgattgaatgaactgtaagtttaatttaggttcaatttagtgtaagatactgaagaagttttgtagtttgagttaagagtattttacatcttaagaatttgccttcttttgccttctgtaattttaaaacattattgtagaaaacaccaacaattcaggaaaaaatataaaatcaactttcccacaattttttgagagagatcatcactatattttactatatttgtagatttgttgcacgtacatttcttatttacaaaattattataatgcataaaaaatagcattttttcctatgtataaatattcttcaaaactattttagggctgagcacaatggctcatgcctgtaatcccaggctccctacttagggaggctgagcccaggagtttgagttcgtttctaaaaaaataaaaatatatacaaacgtctttgttttttgtttgtttgtttgtttttggtgagaaagggcctcacccagtcacccaggttggagtgcagtggtgtgatcatggctaaccgcagcctttccctcccagggctcaagcgatcctcccatctgagcctcccaagttgctgggaccacaggcccataccaccatgcctggctaatttttgtagagatgaggtctcactttgttgcccaggctggtcttgaacttctgggctcaagcagtcctcctaccctggcctcccaaagttgtgggattacaggcatgagccactgcacccagccataatatatttttaaaatgctatgtatatgccatcatattcctattcctattattatttaaccaccatcatagagcatttaggttcttttcactttctgttgtgaataatgcaatgttgaatctgagttcattaagtgaagagtccagctgcacactgcaggcccagtctggatgtaggtgctcagatggttctctttgagacaggctttatcctttggctctcatttttttgatgagtgtacatggcatgagggacacagattccgctagaattcaaatcccacttgtgtataacctagggcaatgtgccacatctctgcacatctgttcattgtaaggattacatgtttagtgtatataaagctcttaaaacaatgcctgacacatagtaaatagaatataatagtagtgctttcctttgctgttgtcagtattactctgagtcggtttcattctcacacagaatgatggccgctagaagctcaaggcttataatctgctagctttctgatcccactggcatgagatactcttgcctaatagttacagctaaagtccaggagctcactgttactggtctgccttggattatgtgcacattcctgaaccagccactatagctaggggatggaaaatactgttcctggttacttaaatgtaggtgatgctcctcccatataccacatgaacctaaaggagtcctggaggaggccgttcaccacaggaaactgaggtgttcttagaagggtggatgctggcagatctctactagttagagtctacatttgccttactcatttcaaaagtccacattgcagtctcattttaccagtgatctagcttgataaggacattcataagtaactggatgattctttaacattgcagatttgaaaggattaaataaagtcaacaaaattgttatatcaa

SEQ ID NO: 21962 - DNA, 700 bp, Homo sapiens
ggcagtgtggagaatgcactgaaggaggcagaagcttctggcaagtatgaggcaaggatttcacagaagaacttggagcaaaaattcccactgtcatagctataggctgtccagtcttgagggagctgcaggaacaggaaaaagagaccttcagagaagacatggcttccagaaaagagaatgcgaagagtgcaaacagagtgctaagaataagccagttggatgcacttgaactaaacaaggccctggagcagctagtttggtcccagtttactcagtgctttcatggatttaaacctgggctgttagctcgctttgagccagaggtgaaagcgtgcttatgggttttcttgtggagattcaccatctactccaaaaatgccacagtgggacagtcagttttgaatattaagtacaaaaatgatttttcccctaacctgagatatcagccacccagtaaaaatcaaaaaatctggtatgctgtttgtacaattggtggcaggtggttagaagaacgatgctatgatttgtttcgaaaccatcatttagcatcatttgggaaagtcaagcagtgtgtgaattttgtgattggacttttgaaattaggtgggctgattaattttttgattttccttcagaggggaaagtttgcaactttgacagaacgtctcctaggtattcattctgtattttgcaagcc

SEQ ID NO: 21963 - DNA, 473 bp, Homo sapiens
ggaggtaagaactaagacgttcttaaaccctactacgtgctggaatcctgaagtgcctgccatcattcaaacttaagcactaactctctagagagacactgccattcataccacagaacgagaaggcagtggcgatcctcaacggctacatgtcactgcctgccacttccggctcctgcgtcgctccggaagcctgcgagttccggaagccttggtaatccagattcggctaggaaaagacaagctttccagagaatgtttcagagaaagttacgtggagcgtgggcgtttcgcagactcctaagtggtctggaacctaacctgcagtgtctctgagcttctggcaagtatgaggcaaggatttcacagaagaacttggagcaaaaattcccactgtcatagctataggctgtccagtcttgagggagctgcaggaacaggaaaaagagaccttcagagaagacatggcttcc

SEQ ID NO: 21964 - DNA, 1470 bp, Homo sapiens
actgccattcataccacagaacgagaaggcagtggcgatcctcaacggctacatgtcactgcctgccacttccggctcctgcgtcgctccggaagcctgcgagttccggaagccttggtaatccagattcggctaggaaaagacaagctttccagagaatgtttcagagaaagttacgtggagcgtgggcgtttcgcagactcctaagagaccttcagagaagacatggcttccagaaaagagaatgcgaagagtgcaaacagagtgctaagaataagccagttggatgcacttgaactaaacaaggccctggagcagctagtttggtcccagtttactcagtgctttcatggatttaaacctgggctgttagctcgctttgagccagaggtgaaagcgtgcttatgggttttcttgtggagattcaccatctactccaaaaatgccacagtgggacagtcagttttgaatattaagtacaaaaatgatttttcccctaacctgagatatcagccacccagtaaaaatcaaaaaatctggtatgctgtttgtacaattggtggcaggtggttagaagaacgatgctatgatttgtttcgaaaccatcatttagcatcatttgggaaagtcaagcagtgtgtgaattttgtgattggacttttgaaattaggtgggctgattaattttttgattttccttcagaggggaaagtttgcaactttgacagaacgtctcctaggtattcattctgtattttgcaagcctcaaaacatatgtgaagttggctttgaatacatgaatagggaacttctctggcatggttttgctgaatttctgatttttctcttaccacttatcaatgtccagaagttgaaagccaagctgtcttcatggtgtattcctcttactggtgcacctaatagtgacaatacattagccaccagtggcaaagaatgcgctctatgtggagagtggcccaccatgcctcacaccataggatgtgagcatattttctgttatttctgtgctaagagtagtttcttatttgacgtgtactttacttgtcctaagtgtggcacagaagtacacagtctgcagccactgaaatcaggaatcgagatgtcagaagtaaatgctctttagaaactaaaattgcttcctttgaggaaaaaaatgcaccgtgtttaaattcttaatattagtcatcctaagtataccatttatgtatcctttataaggaatgtgctcctagccactgtcttctcctttccaggcatgactgaaatctaatcactggaaaccatgtgattctaaatatattatgtaaatgttaatgtattatgttttttaaatcattgcattcaatttttaatgtcaagaataatggacagcttttgtcaggtgactactaacaatgctccttcattttactacttcttaaaacaaggttggattctaaagataaagatt

SEQ ID NO: 21965 - DNA, 1627 bp, Homo sapiens
gggtgtccgcttcggcttttcggcccttcggctcttcggcttgtcggcgttcgcggttgtttggccatccagtgccttcagcagcgccgctaaagcgcagttctcgttggtgtaactttttcttttttttttcagccacttccggctcctgcgtcgctccggaagcctgcgagttccggaagccttggtaatccagattcggctaggaaaagacaagctttccagagaatgtttcagagaaagttacgtggagcgtgggcgtttcgcagactcctaagcttctggcaagtatgaggcaaggatttcacagaagaacttggagcaaaaattcccactgtcatagctataggctgtccagtcttgagggagctgcaggaacaggaaaaagagaccttcagagaagacatggcttccagaaaagagaatgcgaagagtgcaaacagagtgctaagaataagccagttggatgcacttgaactaaacaaggccctggagcagctagtttggtcccagtttactcagtgctttcatggatttaaacctgggctgttagctcgctttgagccagaggtgaaagcgtgcttatgggttttcttgtggagattcaccatctactccaaaaatgccacagtgggacagtcagttttgaatattaagtacaaaaatgatttttcccctaacctgagatatcagccacccagtaaaaatcaaaaaatctggtatgctgtttgtacaattggtggcaggtggttagaagaacgatgctatgatttgtttcgaaaccatcatttagcatcatttgggaaagtcaagcagtgtgtgaattttgtgattggacttttgaaattaggtgggctgattaattttttgattttccttcagaggggaaagtttgcaactttgacagaacgtctcctaggtattcattctgtattttgcaagcctcaaaacatatgtgaagttggctttgaatacatgaatagggaacttctctggcatggttttgctgaatttctgatttttctcttaccacttatcaatgtccagaagttgaaagccaagctgtcttcatggtgtattcctcttactggtgcacctaatagtgacaatacattagccaccagtggcaaagaatgcgctctatgtggagagtggcccaccatgcctcacaccataggatgtgagcatattttctgttatttctgtgctaagagtagtttcttatttgacgtgtactttacttgtcctaagtgtggcacagaagtacacagtctgcagccactgaaatcaggaatcgagatgtcagaagtaaatgctctttagaaactaaaattgcttcctttgaggaaaaaaatgcaccgtgtttaaattcttaatattagtcatcctaagtataccatttatgtatcctttataaggaatgtgctcctagccactgtcttctcctttccaggcatgactgaaatctaatcactggaaaccatgtgattctaaatatattatgtaaatgttaatgtattatgttttttaaatcattgcattcaatttttaatgtcaagaataatggacagcttttgtcaggtgactactaacaatgctccttcattttactacttcttaaaacaag

SEQ ID NO: 21966 - DNA, 4519 bp, Homo sapiens
acagaaggcgatgggccgagagctgaggaactacaactcctagagtactccgcgccgccgggacgccgcgcggctgcggggctgggcgagcgcaaagatgtccgcgcccgctgccgggaggcgaggccaactcgggatatcccggagcctctggggaggcggtcactccgacgtctgaggacctgggccttggacccggactcgttatgaagagcgattcttcgacctctgcagcccccctcagggggctcgggggacccctgcgcagcagcgagccggtgcgcgcggtcccggcccgggcgccggccgtggaccttctggaggaggcggccgacctcctggtggtgcacctggacttccgggcggcgctggagacctgcgagcgggcctggcagagtctggccaaccacgccgtggcagaggaacccgcgggcacctcattggaggtgaagtgctccctgtgtgttgtggggatccaggccctggcagaaatggatcggtggcaagaagtcctctcctgggtccttcagtattaccaggtccctgaaaagctaccccccaaagtcctggagctgtgcattcttttatacagcaaaatgcaagagcctggagctgtgctggatgtggtgggtgcctggctccaagacccagccaatcaaaaccttccagaatatggagccttggcagaatttcacgtgcagcgggtgctgctgcctctgggctgcttatcggaggctgaggagctagtggtgggctctgcagcctttggtgaggagcggcgactggatgtacttcaggccattcacacagcgaggcagcagcagaaacaggaacactcaggctctgaggaggcccagaagccaaacctggaaggctctgtctcccacaagttcctgtcactaccgatgttggttcgccagctttgggactctgcggtgagccacttcttttctctgcccttcaaaaagagtctcctggctgccttgatcctctgtctcctggtggtgagatttgatccagcttccccttcctccctgcacttcctctacaagctggcccagctcttccgctggatccggaaggctgcattttctcgcctctaccagctccgcatccgtgactgagggtccctgcgcaccacagcctctctgctcctcacgtccgtggccacagaagcagagcgacagagcgacacatccacaggcgcccctggggaaatgggaccagcctaatctcgcggagtgcactgtgtcttgctgcctgggtgccctctcctttgcaccctacttcggctggtcgcggtagatgatgtggaaacaaagcaggaccagcaggcacagcacctccagaacagtgccccggatgaccagaggccccttgaaaaggaggggtttggggacagggactgtgtccatgaaacattccatcttcttggtgaaggcaaggggttggttcttcaggtcaggatgttaatggagctggaagttcagaaaaagcctggtgaagtgacccttggcctttcacttcttgagaaacatacttctttgctgggcatggtgactcacgcctgtaatcccagcactttggaagggtgaggtgggtggatcacttgtggccaggagttcaaaacctgcctggccaacatggtgaaaccccatctctactaaaaatacaaaaattagctagatgtggtgcacgcctatagtcctagctacttgggaggctgaggcaggagaatcacttgagccagggaggcaaaagttgcagtgagctgagattgtgctaccgcactctctcaaaacaaacaaaaaaacatgccccacaggacagtaccttaattagctagagtagatctgagagggcctcttcttgcctgcactgtgctccccagagctgatctaattctgtatcaataggctgttcccatggtcttgccatgcgcttgaagctgcaggagccttctcactgttcaggctggggtgtggttttcagaaccaccgggttgactactgaaaaccaagtgagccttacagctcttatcgctgggtaaagtgatcttgcctggtgcctcttggtcttcagctcaattttccaggttgtcctggccaagtcttgctctgttacgctcagtgcctctgcccactctttccccgccagcccttccctcccgccctgcaaacttgtcccttggctgtttcaccaggttctgcctgtatccttgcctccttggtacacaccatttcaggttcttccctttctgtgtcccattgtcctagttatgttctgttgtttgtgtaatgcccaaatttttctgctcgtgtggccttgaaaagtaggccagcctcagaggctgctgagctgaaaatggaactgagtaatcaggtgagctggaagggatgtggggggcggggcagacgggagacatgggttttgaaggcagtgaacaataaaaccttagggaggtggcaccgaggccttagcatttgaggagctgaaatgtttcagtgttgttttctcaccagccacaagcatcttatgagtttctgtgcaaggaagcgtagagcactgctgtgctgtcaggatgaagaagggctttctgcaggggctggcctttctctacccagaggccaagcaggctgccctgcactgtgtccttggtgttgatgcccaaaatagagaaggtgcttgctagcttttccttggtacattttcgggggttgcaaggcaacaagttttcttttgttttgtttgtttgtttgtttgtttgtttttgagatggagtctctgtcacccaggctggagtgcagtggcgtgatctcagctcactgcaagctccgcctcccgggttcatgccattctcctgcctcagcctcccgagtagctgggactacaggtgcccaccacctcgcctggctaatatttttgtatttttagtagagtctgggtttcactgtgttagccgggatggtctcgatctcctgaacttgtgatccacccacctaggcctcccaaagtgctgggattacaggtgtgagccatcgcgcccggccaacttttctttagaaaaatgagtaaagtaggtaaacttcacaggccccttagaattaaatccttagggcatggttcaagtctgtaggaagcaaatctatacttttttatatgggcttttaagtaaagcttagaaccctggggggagaaaagcagtcaggtgaggtttgagattccttctatagaatgatttcttaaaatgaaaatctgggcccacttaactaccctagataaaacgcttcaatggcttcccatggctcactggataacatctaaattcttcatggaattgaaggcccctatgtgctggttttggctaagatctcccctttgatgtgggtcccctgttgattatatgtgcggccttccagctgcccaccatcacagctacagctcgctccccttggcctctgtgccttggctcgcactgttcctactgaaggcctagcacctgctcttggcctggtgagcccctccaccttccaggcttactcaaagaattctttctgcccctccctgtgtcccgggacctgtttcatatcgcttctgtggtcgtgaccccatggtcttgtaattgtgaacttctttgctgccccttcgaagctggggagtgcttgttgcagatgcatccaagaggggtaattgcgtatcaacagtggatttgctggttgtttctacagggttctgaagcatgcaacatagaacagatacctttaaatttaggggcgctaaggaaagcaggaaccagtaatcctcttctgtggtgggatgggagggtgggggagaggggtggaatggagaggaaacaggctattgttggccagccctgggtggaggtgggtgcaagcaggacagatagtgcctgggggtgggggcggagggttcgcctctaggaaggggctagaagggatgaggaaatagttcatagcttcgtgcaggtgatccctattctgcgtgtatgtgtttgcacatgagtgtttgtagaccatagaccattaaaaaatacggaattcaaaagttacaaaaagggtattcttggaaaagaaagttgtttttttttagtcttgctgtgttgcccaggctggacctgaactcctgggcttgagcaagtcttcccctcagcctctggagtagctgggcctacagtgtgtgctgccacacccagctaatacagtctttctactcccgctctctattccccagtttcttgcccagaggcaacccttgccagtctgtttatccctccagatacagtctctgatagtaaacttttctttctcttacacaaatgatagtagtcacatacactacacacactgtgccacgtttaaaaagaaaaaaaacaattctcggctgggcgcggtggcgcatgcctgtaatcccagcactttgggaggccaaggtgggtgaatcacctgaagtcaggagttcgagatcagcatggccaacatggtgaaaccccatctctact

SEQ ID NO: 21967 - DNA, 1672 bp, Homo sapiens
gcgagcgcaaagatgtccgcgcccgctgccgggaggcgaggtgagtctttgatcgtaaccaggagcccggagctgaggcagttcctgcacgtgtcgcggggccggagaagctagggccaggtattccagggatgcaagaatcctgcaaatctgacgtgtaaactgcttccccagcctccaggcgagcccagcttttgcctcagataggccccttccttttccttctcggggaatcgacctcgggaaggggtgtgggcaaagagatgaggactctccctcttcgcccaggccaactcgggatatcccggagcctctggggaggcggtcactccgacgtctgaggacctgggccttggacccggactcgttatgaagagcgattcttcgacctctgcagcccccctcagggggctcgggggacccctgcgcagcagcgagccggtgcgcgcggtcccggcccgggcgccggccgtggaccttctggaggaggcggccgacctcctggtggtgcacctggacttccgggcggcgctggagacctgcgagcgggcctggcagagtctggccaaccacgccgtggcagaggaacccgcgggcacctcattggaggtgaagtgctccctgtgtgttgtggggatccaggccctggcagaaatggatcggtggcaagaagtcctctcctgggtccttcagtattaccaggtccctgaaaagctaccccccaaagtcctggagctgtgcattcttttatacagcaaaatgcaagagcctggagctgtgctggatgtggtgggtgcctggctccaagacccagccaatcaaaaccttccagaatatggagccttggcagaatttcacgtgcagcgggtgctgctgcctctgggctgcttatcggaggctgaggagctagtggtgggctctgcagcctttggtgaggagcggcgactggatgtacttcaggccattcacacagcgaggcagcagcagaaacaggaacactcaggctctgaggaggcccagaagccaaacctggaaggctctgtctcccacaagttcctgtcactaccgatgttggttcgccagctttgggactctgcggtgagccacttcttttctctgcccttcaaaaagagtctcctggctgccttgatcctctgtctcctggtggtgagatttgatccagcttccccttcctccctgcacttcctctacaagctggcccagctcttccgctggatccggaaggctgcattttctcgcctctaccagctccgcatccgtgactgagggtccctgcgcaccacagcctctctgctcctcacgtccgtggccacagaagcagagcgacagagcgacacatccacaggcgcccctggggaaatgggaccagcctaatctcgcggagtgcactgtgtcttgctgcctgggtgccctctcctttgcaccctacttcggctggtcgcggtagatgatgtggaaacaaagcaggaccagcaggcacagcacctccagaacagtgccccggatgaccagaggccccttgaaaaggaggggtttggggacagggactgtgtccatgaaacattccatcttcttggtgaaggcaaggggttggttcttcaggtcaggatgttaatggagctggaagttcagaaaaagcctggtgaagtga

SEQ ID NO: 21968 - DNA, 1098 bp, Homo sapiens
atgaagagcgattcttcgacctctgcagcccccctcagggggctcgggggacccctgcgcagcagcgagccggtgcgcgcggtcccggcccgggcgccggccgtggaccttctggaggaggcggccgacctcctggtggtgcacctggacttccgggcggcgctggagacctgcgagcgggcctggcagagtctggccaaccacgccgtggcagaggaacccgcgggcacctcattggaggtgaagtgctccctgtgtgttgtggggatccaggccctggcagaaatggatcggtggcaagaagtcctctcctgggtccttcagtattaccaggtccctgaaaagctaccccccaaagtcctggagctgtgcattcttttatacagcaaaatgcaagagcctggagctgtgctggatgtggtgggtgcctggctccaagacccagccaatcaaaaccttccagaatatggagccttggcagaatttcacgtgcagcgggtgctgctgcctctgggctgcttatcggaggctgaggagctagtggtgggctctgcagcctttggtgaggagcggcgactggatgtacttcaggccattcacacagcgaggcagcagcagaaacaggaacactcaggctctgaggaggcccagaagccaaacctggaaggctctgtctcccacaagttcctgtcactaccgatgttggttcgccagctttgggactctgcggtgagccacttcttttctctgcccttcaaaaagagtctcctggctgccttgatcctctgtctcctggtggtgagatttgatccagcttccccttcctccctgcacttcctctacaagctggcccagctcttcgctggatccggaaggctgcattttctcgcctctaccagctccgcatccgtgactgagggtccctgcgcaccacagcctctctgctcctcacgtccgtggccacagaagcagagcgacagagcgacacatccacaggcgcccctggggaaatgggaccagcctaatctcgcggagtgcactgtgtcttgctgcctgggtgccctctcctttgcaccctacttcggctggtcgcggtag

SEQ ID NO: 21969 - DNA, 815 bp, Homo sapiens
atgaagagcgattcttcgacctctgcagcccccctcagggggctcgggggacccctgcgcagcagcgagccggtgcgcgcggtcccggcccgggcgccggccgtggaccttctggaggaggcggccgacctcctggtggtgcacctggacttccgggcggcgctggagacctgcgagcgggcctggcagagtctggccaaccacgccgtggcagaggaacccgcgggcacctcattggaggtgaagtgctccctgtgtgttgtggggatccaggccctggcagaaatggatcggtggcaagaagtcctctcctgggtccttcagtattaccaggtccctgaaaagctaccccccaaagtcctggagctgtgcattcttttatacagcaaaatgcaagagcctggagctgtgctggatgtggtgggtgcctggctccaagacccagccaatcaaaaccttccagaatatggagccttggcagaatttcacgtgcagcgggtgctgctgcctctgggctgcttatcggaggctgaggagctagtggtgggctctgcagcctttggtgaggagcggcgactggatgtacttcaggccattcacacagcgaggcagcagcagaaacaggaacactcaggctctgaggaggcccagaagccaaacctggaagcttccccttcctccctgcacttcctctacaagctggcccagctcttccgctggatccggaaggctgcattttctcgcctctaccagctccgcatccgtgactgagggtccctgcgcaccacagcctctctgctcctcacgtccgtggc

SEQ ID NO: 21970 - DNA, 2642 bp, Homo sapiens
gaacggacctgggcttgtcggaccagtgagcggcggcggctgcgcggcggcagcggcagaaagcgtagctgctttgctgtagtccacgcccccttgccgctccggtgacagtctctgcggaaagtcacgtttgtgatttcgggagagcacagaacgggacgacggcgctcttgctgggtcatctgggccaggtgacgaagaaacagtttcctggtgaagcagtccctcacccctagtcagcccacacccctagggcctaaagatgctgaggtctgtatggaattttctgaaacgccacaaaaagaaatgcatcttcctgggcacggtccttggagtgctgtccatgcttccaacactgagagaggccttaatgcagcaactgaattccgagagcctcacagctctgctaaaaaacaggccttcaaacaagctagaaatatgggaggatctgaagataataagtttcacaagaagtactgtggctgtatacagtacctgtatgctggttgttcttttgcgggtccagttaaacataattggtggatatatttacctggataatgcagcagttggcaaaaatggcactacaattcttgctcccccagatgtccaacagcagtatttatcaagtattcagcacctacttggagatggcctgacagaattgatcactgtcattaaacaagctgtgcagaaggttttaggaagtgtttctcttaaacattctttgtcccttttggacttggagcaaaaactaaaagaaatcagaaatctcgttgagcagcataagtcttcttcttggattaataaagatggatccaaacctttattatgccattatatgatgccagatgaagaaactccattagcagtgcaggcctgtggactttctcctcgagacattaccactattaaacttctcaatgaaactagagacatgttggaaagcccagattttagtacagttttgaatacctgtttaaaccgaggttttagtagacttctagacaatatggctgagttctttcgacctactgaacaggacctgcaacatggtaactctatgaatagtctttccagtgtcagcctgcctttagctaagataattccaatagtaaacggacagatccattcagtttgcagtgaaacacctagtcattttgttcaggatctgttgacaatggagcaagtgaaagactttgctgctaatgtgtatgaagcttttagtacccctcagcaactggagaaatgatttttccttcaagaaaaactacagtgggattcatttactttttaaaatacactgggtaaatcacctatacttagagtaacagtttgttatcaaaatgcctgataaaatatattcttaataaaagtcttcatttcataatgaaatcaatttatttggcatcttaatatatttttttagattcatcaacagaccagtttttgtgggcatatatatatacacgtgcaaatatcagaattgttaataatttgttacacatggacatttgttccaaactgactaaaaatcaatatagatattttatatacatatatatatataaaaatacaaaattcagtgtactttaccatattaatactgaggaaaaatctgttggagacataggtctaggatgtgtgaagtttggaaaaatatgctatttaattataatgttccctagactgctgtaaacagaagtgaatcagacttttctccagctacctttcaaaataataaattatttgtctcaaatataccttgatggaggacttttttattcttatggaaatagtgaattccaacaactatgatgaactatgttctttgctatttcttcactatattttttaaggttttattaaaaagccttagaaagttacatattggtttagaggctaaaattgtgttgatgctgtttactcacctaattacatagttttaatcatttgtacataattttaaaaacttactttgtattgattttgaatacagtgaaaatcttattgcaataaactattttagtaaaatattattttgttgagttaatatttttcagctattaatttacttatcccatagcatttttgttattatttcggaagagagagcatgctagtttaagtttcattttaattggtcgtgtacttggtgcttttttgttgttgttaacttgttcatttagtaaaaagcaaatagctttactttctgaaaaagaaataattcattatctctagtaatacatctgtaattcttcatttagaagggtaattagggcaaaagtaaataaatcattatatatcattagtatgttgacatatattttcagtaacattgttttatgttcctccagcgtaacatgtagctgaacagtagaaggtagaaaataaattatgacatctcttctaaggcctggctaggcctgaagctcactgccagggagtttgtgtctagaatgtttttaaaaataggtagtggagccatagccctcaccatagacacctctgagcccactggcattgtctctgagcagaagatggctgtgccactcacatatgctaatcttggcaaatctgccaagcatgtcttcaccaagggatatggatttggcttaataaaacctgatttgaaaacaaaa

SEQ ID NO: 21971 - DNA, 1969 bp, Homo sapiens
gaaacagtttcctggtgaagcagtccctcacccctagtcagcccacacccctagggcctaaagatgctgaggtctgtatggaattttctgaaacgccacaaaaagaaatgcatcttcctgggcacggtccttggaggagtatatattctggggaaatatggacagaagaaaatcagagaaatacaggaaagggaggctgcagaatacattgcccaagcacgacgacaatatcattttgaaagtaaccagaggacttgcaatatgacagtgctgtccatgcttccaacactgagagaggccttaatgcagcaactgaattccgagagcctcacagctctgctaaaaaacaggccttcaaacaagctagaaatatgggaggatctgaagataataagtttcacaagaagtactgtggctgtatacagtacctgtatgctggttgttcttttgcgggtccagttaaacataattggtggatatatttacctggataatgcagcagttggcaaaaatggcactacaattcttgctcccccagatgtccaacagcagtatttatcaagtattcagcacctacttggagatggcctgacagaattgatcactgtcattaaacaagctgtgcagaaggttttaggaagtgtttctcttaaacattctttgtcccttttggacttggagcaaaaactaaaagaaatcagaaatctcgttgagcagcataagtcttcttcttggattaataaagatggatccaaacctttattatgccattatatgatgccagatgaagaaactccattagcagtgcaggcctgtggactttctcctcgagacattaccactattaaacttctcaatgaaactagagacatgttggaaagcccagattttagtacagttttgaatacctgtttaaaccgaggttttagtagacttctagacaatatggctgagttctttcgacctactgaacaggacctgcaacatggtaactctatgaatagtctttccagtgtcagcctgcctttagctaagataattccaatagtaaacggacagatccattcagtttgcagtgaaacacctagtcattttgttcaggatctgttgacaatggagcaagtgaaagactttgctgctaatgtgtatgaagcttttagtacccctcagcaactggagaaatgatttttccttcaagaaaaactacagtgggattcatttactttttaaaatacactgggtaaatcacctatacttagagtaacagtttgttatcaaaatgcctgataaaatatattcttaataaaagtcttcatttcataatgaaatcaatttatttggcatcttaatatatttttttagattcatcaacagaccagtttttgtgggcatatatatatacacgtgcaaatatcagaattgttaataatttgttacacatggacatttgttccaaactgactaaaaatcaatatagatattttatatacatatatatatataaaaatacaaaattcagtgtactttaccatattaatactgaggaaaaatctgttggagacataggtctaggatgtgtgaagtttggaaaaatatgctatttaattataatgttccctagactgctgtaaacagaagtgaatcagacttttctccagctacctttcaaaataataaattatttgtctcaaatataccttgatggaggacttttttattcttatggaaatagtgaattccaacaactatgatgaactatgttctttgctatttcttcactatattttttaaggttttattaaaaagccttagaaagttacatattggtttagaggctaaaattgtgttgatgctgtttactcacctaattacatagttttaatcatttgtacataattttaaaaacttactttgtattgattttgaatacagtgaaaatcttattgcaataaactattttagtaaaata

SEQ ID NO: 21972 - DNA, 784 bp, Homo sapiens
tgagcggcggcggctgcgcggcggcagcggcagaaagcgtagctgctttgctgtagtccacgcccccttgccgctccggtgacagtctctgcggaaagtcacgtttgtgatttcgggagagcacagaacgggacgacggcgctcttgctgggtcatctgggccaggtgacgaagaaacagtttcctggtgaagcagtccctcacccctagtcagcccacacccctagggcctaaagatgctgaggtctgtatggaattttctgaaacgccacaaaaagaaatgcatcttcctgggcacggtccttggagtgctgtccatgcttccaacactgagagaggccttaatgcagcaactgaattccgagagcctcacagctctgctaaaaaacaggccttcaaacaagctagaaatatgggaggatctgaagataataagtttcacaagaagtactgtggctgtatacagtacctgtatgctggttgttcttttgcgggtccagttaaacataattggtggatatatttacctggataatgcagcagttggcaaaaatggcactacaattcttgctcccccagatgtccaacagcagtatttatcaagtattcagcacctacttggagatggcctgacagaattgatcactgtcattaaacaagctgtgcagaaggttttaggaagtgtttctcttaaacattctttgtcccttttggacttggagcaaaaactaaaagaaatcagaaatctcgttgagcagcataagtcttcttcttggattaataa

SEQ ID NO: 21973 - DNA, 3252 bp, Homo sapiens
cttaaggccccgccttttcagacagcttccgctgggcctgggccgctgcggggcggtcacggcccctttaagcctgagccccgccccctggctccccgccccctcttctcccctcccccaagccagcacctggtgccccggcgggtcgtgcggcgcggcgctccgcgagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcagcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggctccccagagagcccctggtgtggcagacttggccttgtctgagaactgggcccaggagtttcttgcagctggagatgctgtggatgtaactcaggattataatgagactgactggtcccaagaattcatctctgaagttacagaccccttgtctgtgtcccctgcccgctgggctgaggaatatttggagcaatcagaggagaagctgtggctgggagaacctgagggaacagccaccgatcgctggtatgatgaatatcatcctgaggaggatctgcagcacacggccagtgactttgtggccaaagtggatgaccccaaattggctaattctgagggtacatcagatgcctgggttgaccagttcacaagaccagtaaacacatctgcccttgatatggagtttgaacgagccaagtcagctatagagtctgatgtcgatttctgggacaagttgcaggcagagttggaggagatggcaaaacgggatgctgaggcccacccctggctttctgactatgatgaccttacgtcagctacctatgataaggggtaccagtttgaggaggagaaccccttgcgtgatcaccctcagccttttgaagaagggctgcggcgccttcaggagggggacctgccaaatgctgtgctgctttttgaggcagctgtgcagcaggatcctaagcacatggaagcttggcagtatctgggtaccacccaggcagagaatgaacaagaactattagccatcagtgcattgcggaggtgtctggagctaaagccagataaccagacagcactgatggcgctggctgtgagcttcaccaacgagtccctgcagcgacaggcctgtgaaaccctacgagactggctgcggtacacaccagcctatgcccatctggtgacacctgctgaagaaggggctggtggggcaggactgggccccagcaagcgtatcctgggatctctcttgtctgactccctgtttcttgaagtgaaagagctcttcctggcagctgtgcggctggaccctacctccattgaccctgatgtgcagtgtggcttgggagtccttttcaacctgagtggggagtatgacaaggccgtggactgcttcacagctgccctcagcgttcgtcccaatgactatttgctgtggaataagctaggcgccaccctggccaatggaaaccagagtgaagaagcagtagctgcgtaccgccgggccctcgagctccagcctggctatatccggtcccgctataacctgggcatcagctgcatcaacctcggggctcaccgggaggctgtggagcactttctggaggccctgaacatgcagaggaaaagccggggcccccggggtgaaggaggtgccatgtcggagaacatctggagcaccctgcgtttggcattgtctatgttaggccagagcgatgcctatggggcagccgacgcgcgggatctgtccaccctcctaactatgtttggcctgccccagtgacagtgggacgggctgccctgtgagtgtccacctggagggatccccgctttggatgtgattccctctccccaaatgggcctaccaagggggcgggctgatgaccataagcggtacggcctttcaggagctgcctcaacgtaggggtgggtagtctgtgttctagttcctacataattgtaggaaaatgagctgtgtcatctctgagtcccttggtaattcaagggctgtacatccagctacagatctctctgctcatcatgccctttcttggtgctgctttttgggtaggaccccacgatttagggtaactgttatcatcagctgccatttctgatagggtctaccacatctgtaatgtctgtcctttcccccacttttactgggaattgatagtccagcttccttgggcagtgtaagtaggaggttcatctgctgtgcgcctctaatgtctgtctggatgggatgtgttaggagttggcctgttgggttgaattgttgatttggctgagcagagctgagttttggtaggagtgctcatggttctgtcattcttggacctctcctggctgagctctgattccctgtgagcacgatgctgatgcaatagtcctgtgtcatcactgcagcggtcctcaggagctgccagggccaattgctacagagtgtctgggtgtgtggcataggaggaaggtttgcttgtgaaatgaggctgggtgggagcggggagggactagatcagaagagatcaagggctctattcaggaacgttggtgggaggacagagcaagtgggaagggggtatggtgagtgcggcaatccctcatcctcttagaagcacctgtgaatgggaattgagccaactgttatagaaaattggttcagaaagtgcaatcttgccagatttctagcaaataggttcagtgttaccataagcctttgctgtacttcttgaaatgtttctaggggagagcattggaaaatccccttcccccatctagatcgaaggaagatgagggagcagcttggattcttctcagttgtcccctgcatggggagatacactaacccccagaaatgactgctaagcctcttgccttgtctttagtagctaatgatcagagagattttttttttaaactaccatggtcccaggattccatcctgaaatttatttttctttgtatgaatatgtgtaaatgatttaaaaataaaactgtaaaatatttgtacgaagaataaatggaactgatgtgggtatga

SEQ ID NO: 21974 - DNA, 3170 bp, Homo sapiens
gagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcagcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggctccccagagagcccctggtgtggcagacttggccttgtctgagaactgggcccaggagtttcttgcagctggagatgctgtggatgtaactcaggattataatgagactgactggtcccaagaattcatctctgaagttacagaccccttgtctgtgtcccctgcccgctgggctgaggaatatttggagcaatcagaggagaagctgtggctgggagaacctgagggaacagccaccgatcgctggtatgatgaatatcatcctgaggaggatctgcagcacacggccagtgactttgtggccaaagtggatgaccccaaattggctaattctgagttcctgaaattcgtgcggcagattggcgaagggcaggtgtccctggagtccggtgcagggtcgggccgagctcaggcagaacagtgggcagcagagtttatacagcagcagggtacatcagatgcctgggttgaccagttcacaagaccagtaaacacatctgcccttgatatggagtttgaacgagccaagtcagctatagagttgcaggcagagttggaggagatggcaaaacgggatgctgaggcccacccctggctttctgactatgatgaccttacgtcagctacctatgataaggggtaccagtttgaggaggagaaccccttgcgtgatcaccctcagccttttgaagaagggctgcggcgccttcaggagggggacctgccaaatgctgtgctgctttttgaggcagctgtgcagcaggatcctaagcacatggaagcttggcagtatctgggtaccacccaggcagagaatgaacaagaactattagccatcagtgcattgcggaggtgtctggagctaaagccagataaccagacagcactgatggcgctggctgtgagcttcaccaacgagtccctgcagcgacaggcctgtgaaaccctacgagactggctgcggtacacaccagcctatgcccatctggtgacacctgctgaagaaggggctggtggggcaggactgggccccagcaagcgtatcctgggatctctcttgtctgactccctgtttcttgaagtgaaagagctcttcctggcagctgtgcggctggaccctacctccattgaccctgatgtgcagtgtggcttgggagtccttttcaacctgagtggggagtatgacaaggccgtggactgcttcacagctgccctcagcgttcgtcccaatgactatttgctgtggaataagctaggcgccaccctggccaatggaaaccagagtgaagaagcagtagctgcgtaccgccgggccctcgagctccagcctggctatatccggtcccgctataacctgggcatcagctgcatcaacctcggggctcaccgggaggctgtggagcactttctggaggccctgaacatgcagaggaaaagccggggcccccggggtgaaggaggtgccatgtcggagaacatctggagcaccctgcgtttggcattgtctatgttaggccagagcgatgcctatggggcagccgacgcgcgggatctgtccaccctcctaactatgtttggcctgccccagtgacagtgggacgggctgccctgtgagtgtccacctggagggatccccgctttggatgtgattccctctccccaaatgggcctaccaagggggcgggctgatgaccataagcggtacggcctttcaggagctgcctcaacgtaggggtgggtagtctgtgttctagttcctacataattgtaggaaaatgagctgtgtcatctctgagtcccttggtaattcaagggctgtacatccagctacagatctctctgctcatcatgccctttcttggtgctgctttttgggtaggaccccacgatttagggtaactgttatcatcagctgccatttctgatagggtctaccacatctgtaatgtctgtcctttcccccacttttactgggaattgatagtccagcttccttgggcagtgtaagtaggaggttcatctgctgtgcgcctctaatgtctgtctggatgggatgtgttaggagttggcctgttgggttgaattgttgatttggctgagcagagctgagttttggtaggagtgctcatggttctgtcattcttggacctctcctggctgagctctgattccctgtgagcacgatgctgatgcaatagtcctgtgtcatcactgcagcggtcctcaggagctgccagggccaattgctacagagtgtctgggtgtgtggcataggaggaaggtttgcttgtgaaatgaggctgggtgggagcggggagggactagatcagaagagatcaagggctctattcaggaacgttggtgggaggacagagcaagtgggaagggggtatggtgagtgcggcaatccctcatcctcttagaagcacctgtgaatgggaattgagccaactgttatagaaaattggttcagaaagtgcaatcttgccagatttctagcaaataggttcagtgttaccataagcctttgctgtacttcttgaaatgtttctaggggagagcattggaaaatccccttcccccatctagatcgaaggaagatgagggagcagcttggattcttctcagttgtcccctgcatggggagatacactaacccccagaaatgactgctaagcctcttgccttgtctttagtagctaatgatcagagagattttttttttaaactaccatggtcccaggattccatcctgaaatttatttttctttgtatgaatatgtgtaaatgatttaaaaataaaactgtaaaatatttgtacgaagaataaatggaactgatgtgggta

SEQ ID NO: 21975 - DNA, 1508 bp, Homo sapiens
gcgtgctggggctgcgcggggctaggtatggtcgggctgttttcccactgtcccttcttcgggcagtgtcgccgtccagcctggttgttgaagcgtccccgtggtcccccggggtccaggcccctttgtggaggcagctgctggcccccagcccatgggaccgtagtcgcggaggcctctgcagaggcgcaggctggaagcggtggcctttgaggggggcggcaggagagagtaccgacctccctcgaactcctggcagagagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcagtgagtgttcttgaggtggaaagcccaggtgcagcctctgaggcagcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggctccccagagagcccctggtgtggcagacttggccttgtctgagaactgggcccaggagtttcttgcagctggagatgctgtggatgtaactcaggattataatgagactgactggtcccaagaattcatctctgaagttacagaccccttgtctgtgtcccctgcccgctgggctgaggaatatttggagcaatcagaggagaagctgtggctgggagaacctgagggaacagccaccgatcgctggtatgatgaatatcatcctgaggaggatctgcagcacacggccagtgactttgtggccaaagtggatgaccccaaattggctaattctgagggtacatcagatgcctgggttgaccagttcacaagaccagtaaacacatctgcccttgatatggagtttgaacgagccaagtcagctatagagttgcaggcagagttggaggagatggcaaaacgggatgctgaggcccacccctggctttctgactatgatgaccttacgtcagctacctatgataaggggtaccagtttgaggaggagaaccccttgcgtgatcaccctcagccttttgaagaagggctgcggcgccttcaggagggggacctgccaaatgctgtgctgctttttgaggcagctgtgcagcaggatcctaagcacatggaagcttggcagtatctgggtaccacccaggcagagaatgaacaagaactattagccatcagtgcattgcggaggtgtctggagctaaagccagataaccagacagcactgatggcgctggctgtgagcttcaccaacgagtccctgcagcgacaggcctgtgaaaccctacgagactggctgcggtacacaccagcctatgcccatctggtga

SEQ ID NO: 21976 - DNA, 2105 bp, Homo sapiens
ggcagcagggccggggagatgggcggtggggagcgcgggagggaccgggccgagccgggggaagggctccggtgacttaaggggagggaatgctcctctgccgtgctcaccgcgtgctggggctgcgcggggctagagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcagcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggctccccagagagcccctggtgtggcagacttggccttgtctgagaactgggcccaggagtttcttgcagctggagatgctgtggatgtaactcaggattataatgagactgactggtcccaagaattcatctctgaagttacagaccccttgtctgtgtcccctgcccgctgggctgaggaatatttggagcaatcagaggagaagctgtggctgggagaacctgagggaacagccaccgatcgctggtatgatgaatatcatcctgaggaggatctgcagcacacggccagtgactttgtggccaaagtggatgaccccaaattggctaattctgagttcctgaaattcgtgcggcagattggcgaagggcaggtgtccctggagtccggtgcagggtcgggccgagctcaggcagaacagtgggcagcagagtttatacagcagcagggtacatcagatgcctgggttgaccagttcacaagaccagtaaacacatctgcccttgatatggagtttgaacgagccaagtcagctatagagtctgatgtcgatttctgggacaagttgcaggcagagttggaggagatggcaaaacgggatgctgaggcccacccctggctttctgactatgatgaccttacgtcagctacctatgataaggggtaccagtttgaggaggagaaccccttgcgtgatcaccctcagccttttgaagaagggctgcggcgccttcaggagggggacctgccaaatgctgtgctgctttttgaggcagctgtgcagcaggatcctaagcacatggaagcttggcagtatctgggtaccacccaggcagagaatgaacaagaactattagccatcagtgcattgcggaggtgtctggagctaaagccagataaccagacagcactgatggcgctggctgtgagcttcaccaacgagtccctgcagcgacaggcctgtgaaaccctacgagactggctgcggtacacaccagcctatgcccatctggtgacacctgctgaagaaggggctggtggggcaggactgggccccagcaagcgtatcctgggatctctcttgtctgactccctgtttcttgaagtgaaagagctcttcctggcagctgtgcggctggaccctacctccattgaccctgatgtgcagtgtggcttgggagtccttttcaacctgagtggggagtatgacaaggccgtggactgcttcacagctgccctcagcgttcgtcccaatgactatttgctgtggaataagctaggcgccaccctggccaatggaaaccagagtgaagaagcagtagctgcgtaccgccgggccctcgagctccagcctggctatatccggtcccgctataacctgggcatcagctgcatcaacctcggggctcaccgggaggctgtggagcactttctggaggccctgaacatgcagaggaaaagccggggcccccggggtgaaggaggtgccatgtcggagaacatctggagcaccctgcgtttggcattgtctatgttaggccagagcgatgcctatggggcagccgacgcgcgggatctgtccaccctcctaactatgtttggcctgccccagtgacagtgggacgggctgccctgtgagtgtccacct

SEQ ID NO: 21977 - DNA, 2477 bp, Homo sapiens
ggtgccccggcgggtcgtgcggcgcggcgctccgcggtgagcgcctgaccccgagggggcccggggccgcgtccctgggccctccccacccttgcggtggcctcgcgggtcccaggggcggggctggagcggcagcagggccggggagatgggcggtggggagcgcgggagggaccgggccgagccgggggaagggctccggtgacttaaggggagggaatgctcctctgccgtgctcaccgcgtgctggggctgcgcggggctaggtatggtcgggctgttttcccactgtcccttcttcgggcagtgtcgccgtccagcctggttgttgaagcgtccccgtggtcccccggggtccaggcccctttgtggaggcagctgctggcccccagcccatgggaccgtagtcgcggaggcctctgcagaggcgcaggctggaagcggtggcctttgaggggggcggcaggagagagtaccgacctccctcgaactcctggcagagagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcagcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggctccccagagagcccctggtgtggcagacttggccttgtctgagaactgggcccaggagtttcttgcagctggagatgctgtggatgtaactcaggattataatgagactgactggtcccaagaattcatctctgaagttacagaccccttgtctgtgtcccctgcccgctgggctgaggaatatttggagcaatcagaggagaagctgtggctgggagaacctgagggaacagccaccgatcgctggtatgatgaatatcatcctgaggaggatctgcagcacacggccagtgactttgtggccaaagtggatgaccccaaattggctaattctgagttcctgaaattcgtgcggcagattggcgaagggcaggtgtccctggagtccggtgcagggtcgggccgagctcaggcagaacagtgggcagcagagtttatacagcagcagggtacatcagatgcctgggttgaccagttcacaagaccagtaaacacatctgcccttgatatggagtttgaacgagccaagtcagctatagagtctgatgtcgatttctgggacaagttgcaggcagagttggaggagatggcaaaacgggatgctgaggcccacccctggctttctgactatgatgaccttacgtcagctacctatgataaggggtaccagtttgaggaggagaaccccttgcgtgatcaccctcagccttttgaagaagggctgcggcgccttcaggagggggacctgccaaatgctgtgctgctttttgaggcagctgtgcagcaggatcctaagcacatggaagcttggcagtatctgggtaccacccaggcagagaatgaacaagaactattagccatcagtgcattgcggaggtgtctggagctaaagccagataaccagacagcactgatggcgctggctgtgagcttcaccaacgagtccctgcagcgacaggcctgtgaaaccctacgagactggctgcggtacacaccagcctatgcccatctggtgacacctgctgaagaaggggctggtggggcaggactgggccccagcaagcgtatcctgggatctctcttgtctgactccctgtttcttgaagtgaaagagctcttcctggcagctgtgcggctggaccctacctccattgaccctgatgtgcagtgtggcttgggagtccttttcaacctgagtggggagtatgacaaggccgtggactgcttcacagctgccctcagcgttcgtcccaatgactatttgctgtggaataagctaggcgccaccctggccaatggaaaccagagtgaagaagcagtagctgcgtaccgccgggccctcgagctccagcctggctatatccggtcccgctataacctgggcatcagctgcatcaacctcggggctcaccgggaggctgtggagcactttctggaggccctgaacatgcagaggaaaagccggggcccccggggtgaaggaggtgccatgtcggagaacatctggagcaccctgcgtttggcattgtctatgttaggccagagcgatgcctatggggcagccgacgcgcgggatctgtccaccctcctaactatgtttggcctgccccagtgacagtgggacgggctgccctgtgagtgtccacctggaggg

SEQ ID NO: 21978 - DNA, 2253 bp, Homo sapiens
tcttctcccctcccccaagccagcacctggtgccccggcgggtcgtgcggcgcggcgctccgcgagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcagtgagtgttcttgaggtggaaagcccaggtgcagcctctgaggcagcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggctccccagagagcccctggtgtggcagacttggccttgtctgagaactgggcccaggagtttcttgcagctggagatgctgtggatgtaactcaggattataatgagactgactggtcccaagaattcatctctgaagttacagaccccttgtctgtgtcccctgcccgctgggctgaggaatatttggagcaatcagaggagaagctgtggctgggagaacctgagggaacagccaccgatcgctggtatgatgaatatcatcctgaggaggatctgcagcacacggccagtgactttgtggccaaagtggatgaccccaaattggctaattctgagttcctgaaattcgtgcggcagattggcgaagggcaggtgtccctggagtccggtgcagggtcgggccgagctcaggcagaacagtgggcagcagagtttatacagcagcagggtacatcagatgcctgggttgaccagttcacaagaccagtaaacacatctgcccttgatatggagtttgaacgagccaagtcagctatagagtctgatgtcgatttctgggacaagttgcaggcagagttggaggagatggcaaaacgggatgctgaggcccacccctggctttctgactatgatgaccttacgtcagctacctatgataaggggtaccagtttgaggaggagaaccccttgcgtgatcaccctcagccttttgaagaagggctgcggcgccttcaggagggggacctgccaaatgctgtgctgctttttgaggcagctgtgcagcaggatcctaagcacatggaagcttggcagtatctgggtaccacccaggcagagaatgaacaagaactattagccatcagtgcattgcggaggtgtctggagctaaagccagataaccagacagcactgatggcgctggctgtgagcttcaccaacgagtccctgcagcgacaggcctgtgaaaccctacgagactggctgcggtacacaccagcctatgcccatctggtgacacctgctgaagaaggggctggtggggcaggactgggccccagcaagcgtatcctgggatctctcttgtctgactccctgtttcttgaagtgaaagagctcttcctggcagctgtgcggctggaccctacctccattgaccctgatgtgcagtgtggcttgggagtccttttcaacctgagtggggagtatgacaaggccgtggactgcttcacagctgccctcagcgttcgtcccaatgactatttgctgtggaataagctaggcgccaccctggccaatggaaaccagagtgaagaagcagtagctgcgtaccgccgggccctcgagctccagcctggctatatccggtcccgctataacctgggcatcagctgcatcaacctcggggctcaccgggaggctgtggagcactttctggaggccctgaacatgcagaggaaaagccggggcccccggggtgaaggaggtgccatgtcggagaacatctggagcaccctgcgtttggcattgtctatgttaggccagagcgatgcctatggggcagccgacgcgcgggatctgtccaccctcctaactatgtttggcctgccccagtgacagtgggacgggctgccctgtgagtgtccacctggagggatccccgctttggatgtgattccctctccccaaatgggcctaccaagggggcgggctgatgaccataagcggtacggcctttcaggagctgcctcaacgtaggggtgggtagtctgtgttctagttcctacataattgtaggaaaatgagctgtgtcatctctgagtcc

SEQ ID NO: 21979 - DNA, 2689 bp, Homo sapiens
gacgctaccccgctaggggttatttggaagcggggcaggcctaggaggctgaagaaggcttcggactggactccccagcccctggtgttagggcttttctctttcttgggcttgggaacattagccagccccattttagaggggaaaactgaggctcagaaagggcactgaatccccttaggtcacaatgcgcccaagggaagaggcaggatcgactgagcctaggatctcgcgtcttcggctttcccccagagcctgggaagcccttcttagctccactcttctttgagctttccgtcaaacaaatcctagggcccgtggccttttcgagcgctcctaaaggcgactctccaagacccgctctctaagtgtcgccgtccagcctggttgttgaagcgtccccgtggtcccccggggtccaggcccctttgtggaggcagctgctggcccccagcccatgggaccgtagtcgcggaggcctctgcagaggcgcaggctggaagcggtggcctttgaggggggcggcaggagagagtaccgacctccctcgaactcctggcagagagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcagcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggctccccagagagcccctggtgtggcagacttggccttgtctgagaactgggcccaggagtttcttgcagctggagatgctgtggatgtaactcaggattataatgagactgactggtcccaagaattcatctctgaagttacagaccccttgtctgtgtcccctgcccgctgggctgaggaatatttggagcaatcagaggagaagctgtggctgggagaacctgagggaacagccaccgatcgctggtatgatgaatatcatcctgaggaggatctgcagcacacggccagtgactttgtggccaaagtggatgaccccaaattggctaattctgagttcctgaaattcgtgcggcagattggcgaagggcaggtgtccctggagtccggtgcagggtcgggccgagctcaggcagaacagtgggcagcagagtttatacagcagcagggtacatcagatgcctgggttgaccagttcacaagaccagtaaacacatctgcccttgatatggagtttgaacgagccaagtcagctatagagtctgatgtcgatttctgggacaagttgcaggcagagttggaggagatggcaaaacgggatgctgaggcccacccctggctttctgactatgatgaccttacgtcagctacctatgataaggggtaccagtttgaggaggagaaccccttgcgtgatcaccctcagccttttgaagaagggctgcggcgccttcaggagggggacctgccaaatgctgtgctgctttttgaggcagctgtgcagcaggatcctaagcacatggaagcttggcagtatctgggtaccacccaggcagagaatgaacaagaactattagccatcagtgcattgcggaggtgtctggagctaaagccagataaccagacagcactgatggcgctggctgtgagcttcaccaacgagtccctgcagcgacaggcctgtgaaaccctacgagactggctgcggtacacaccagcctatgcccatctggtgacacctgctgaagaaggggctggtggggcaggactgggccccagcaagcgtatcctgggatctctcttgtctgactccctgtttcttgaagtgaaagagctcttcctggcagctgtgcggctggaccctacctccattgaccctgatgtgcagtgtggcttgggagtccttttcaacctgagtggggagtatgacaaggccgtggactgcttcacagctgccctcagcgttcgtcccaatgactatttgctgtggaataagctaggcgccaccctggccaatggaaaccagagtgaagaagcagtagctgcgtaccgccgggccctcgagctccagcctggctatatccggtcccgctataacctgggcatcagctgcatcaacctcggggctcaccgggaggctgtggagcactttctggaggccctgaacatgcagaggaaaagccggggcccccggggtgaaggaggtgccatgtcggagaacatctggagcaccctgcgtttggcattgtctatgttaggccagagcgatgcctatggggcagccgacgcgcgggatctgtccaccctcctaactatgtttggcctgccccagtgacagtgggacgggctgccctaaatatacagcctctgcagacactgcttctgaatgaacgggctggagtttccttgggatcctgaactcatattggattctctacctaccatcttggacaattcatgtaggaaaacaaatcctcatttgttcaaacaatagatgaaaattattaaagttttgacacatatt

SEQ ID NO: 21980 - DNA, 567 bp, Homo sapiens
aagcggtggcctttgaggggggcggcaggagagagtaccgacctccctcgaactcctggcagaggtgggggtcgcagcaaaagcactggggtggagggcggccagtgtggggcagacgcctgtgtgccttcctcagatacgggcagagttgtggatgtgagaagggtctggcttgggtacctcagttccaaacctcctgtgtccatcagagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcagcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggctccccagagagcccctggtgtggcagacttggccttg

SEQ ID NO: 21981 - DNA, 641 bp, Homo sapiens
gaagaaggcttcggactggactccccagcccctggtgttagggcttttctctttcttgggcttgggaacattagccagccccattttagaggggaaaactgaggctcagaaagggcactgaatccccttaggtcacaatgcgcccaagggaagaggcaggatcgactgagcctaggatctcgcgtcttcggctttcccccagagcctgggaagcccttcttagctccactcttctttgagctttccgtcaaacaaatcctagggcccgtggccttttcgagcgctcctaaaggcgactctccaagacccgctctctaagagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcagcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggct

SEQ ID NO: 21982 - DNA, 848 bp, Homo sapiens
attattgcccttggtcatttaccggcagccctgggcccctccttgctcttctccatgacactaggactcccttggtcttgaagctggagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcagcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggctccccagagagcccctggtgtggcagacttggccttgtctgagaactgggcccaggagtttcttgcagctggagatgctgtggatgtaactcaggattataatgagactgactggtcccaagaattcatctctgaagttacagaccccttgtctgtgtcccctgcccgctgggctgaggaatatttggagcaatcagaggagaagctgtggctgggagaacctgagggaacagccaccgatcgctggtatgatgaatatcatcctgaggaggatctgcagcacacggccagtgactttgtggccaaagtggatgaccccaaattggctaattctgagttcctgaaattcgtgcggcagattggcgaagggcaggtgtccctggagtccggtgcagggtcgggccgagctcaggcagaacagtgggcagcagagtttatac

SEQ ID NO: 21983 - DNA, 579 bp, Homo sapiens
tcccccaagccagcacctggtgccccggcgggtcgtgcggcgcggcgctccgcgtgtcgccgtccagcctggttgttgaagcgtccccgtggtcccccggggtccaggcccctttgtggaggcagctgctggcccccagcccatgggaccgtagtcgcggaggcctctgcagaggcgcaggctggaagcggtggcctttgaggggggcggcaggagagagtaccgacctccctcgaactcctggcagagagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcagcctccaagcctttgggagtagcttctgaagatgagttggtggctgaattcctgcaggaccagaatgcaccccttgtgtcccgtgcccctcagaccttcaagatggatgacctcctggctgagatgcagcagattgagcagtcaaacttccgccaggctccccagag

SEQ ID NO: 21984 - DNA, 2818 bp, Homo sapiens
cagcgctgccgagtggccgccggccggccgagtacccggagctccagggggctcaggagcaccctctgagaacccgctgtgcacccaccttttcccctcttttggtgggcaagtaagcacgggggaaaagcatccggtggcctcagggagccctgaagaaaccgaagcagaatgtaccagggacacatgcaggtagtaggtgtaaccttgaagaaaaagtggcactgtcttcaaaaaagtgacctgaccctggctttgggaaaaggctctagggcggcagataaggctgttgccatggtgatgaaggagataccgagggaggagtctgctgaagaaaagcccctccttactatgacatcacagctggtgaatgagcaacaagaaagcagacccctcctgagtccctccatcgatgactttctctgtgaaaccaaatcggaagcaatagcaaggccagtaacatccaatacagctgtattgaccactggcttagatctcctcgacctgagtgaaccagtctctcaaacccaaaccaaagccaagaagtcagagccctcatcaaaaacctcatccctcaagaaaaaggccgatggatctgacctcatcagcacggatgctgagcagagaggccagcctctcagagtcccggagacttcatccttagatctagacattcaaacacaactggaaaaatgggacgatgttaagtttcatggagatcgaaataccaagggacatccaatggcagagagaaaatcatcctcatctagaactggatcaaaagagctcttatggtcctcagaacacagatctcaaccagaactgagtggtggaaaaagcgccctcaactctgagtcggcttcagaattggaattagtggctccgactcaggctcgactgaccaaagaacatcgctggggaagcgcattactttctagaaaccactccttagaagaagagtttgaaagggcaaaagcagcagtggagtcagatacagagttttgggataagatgcaagcagaatgggaagaaatggctcggaggaactggatatctgagaaccaagaagcccagaaccaagtaaccatctcggctagtgagaagggatattactttcacactgaaaaccccttcaaggactggcctggagcatttgaagaaggcttaaaaaggctgaaggaaggggatctgccagtcaccatcctgttcatggaagcagcaattcttcaggaccctggagatgcagaggcatggcagttcctcgggataacccaggcggagaatgaaaatgaacaagcagctattgtcgccctccagaggtgcttagaattacagcccaacaacttaaaagctttgatggccttggctgtgagttatactaacactggccatcagcaggatgcctgtgacgctctgaagaattggattaagcaaaatccaaagtacaaataccttgtgaaaagcaagaagggatctccaggcctcacccggcggatgtctaagtccccagttgatagctctgttctggaaggggtgaaggaattatatctggaagctgcccaccaaaatggagatatgatcgacccagacctgcagacaggtctaggggttctgttccacctgagtggagaatttaatagagcaatagatgcatttaacgctgccttaactgttcggccagaggactattcactatggaaccgcctcggggcgaccttggcgaacggagaccgcagcgaggaagccgtggaggcctatacgcgagcactggagattcagccaggattcatccggtccagatacaacctaggaataagctgcatcaacctgggcgcctacagagaagcggtcagcaattttctcactgccctcagtttgcaaagaaagagcaggaatcagcagcaagttcctcatcctgcaatctctgggaatatctgggctgccctcagaattgcgctctctctgatggaccaaccagaactcttccaggcggctaatcttggtgacctggatgtcctcttaagagctttcaacttggatccttgaagaaagaataataccagtactaataatccctgatctgtgtgattgtactgaaaaatcaaaaactattttattatgaatttcaaaaggataaatcaaatattcaaaaggccatggtcatatagcccaaggaaattaattcctgtggacaatgcccagtctctgttcagatccaaaagcacaaaatgttgtatatagagtcaaagtcaggctcaaaagaagaattaagagactcaagacaaaccaagataaagtaactgtgtgttgaatactctttccacaagttgcaagcatattgcaacacatgttctttgggttttttgtctccccttgcagctgatgacacatctgaggaacttgttcatgggaaacatggaaaaagcactgcctcagattgggaaattctgactgtttctgaactgtcttcttttgcaagactgaacatagtttgggccattggtgcatgcacatatattaacttgtgactaaagacagacattgcttaaacctgttccaattttaacttttactgtagccctttgattccagagagggagctttgctggcaaaagcagtttttgcactagaaatttttgctgttcccaatctaaacttttctggtattgtatatatgcactttaatatcttatttatgccttgctggagttttgttttgttgctccaatttttaacttgggggtgaaagatttaagaactcagcctcactagatcaacggaccaaataaacaattcctgaagacagtttttcatagtg

SEQ ID NO: 21985 - DNA, 2637 bp, Homo sapiens
atgcaccaaaacggatctcaagtagtaggtgtaaccttgaagaaaaagtggcactgtcttcaaaaaagtgacctgaccctggctttgggaaaaggctctagggcggcagataaggctgttgccatggtgatgaaggagataccgagggaggagtctgctgaagaaaagcccctccttactatgacatcacagctggtgaatgagcaacaagaaagcagacccctcctgagtccctccatcgatgactttctctgtgaaaccaaatcggaagcaatagcaaggccagtaacatccaatacagctgtattgaccactggcttagatctcctcgacctgagtgaaccagtctctcaaacccaaaccaaagccaagaagtcagagccctcatcaaaaacctcatccctcaagaaaaaggccgatggatctgacctcatcagcacggatgctgagcagagaggccagcctctcagagtcccggagacttcatccttagatctagacattcaaacacaactggaaaaatgggacgatgttaagtttcatggagatcgaaataccaagggacatccaatggcagagagaaaatcatcctcatctagaactggatcaaaagagctcttatggtcctcagaacacagatctcaaccagaactgagtggtggaaaaagcgccctcaactctgagtcggcttcagaattggaattagtggctccgactcaggctcgactgaccaaagaacatcgctggggaagcgcattactttctagaaaccactccttagaagaagagtttgaaagggcaaaagcagcagtggagtcagatacagagttttgggataagatgcaagcagaatgggaagaaatggctcggaggaactggatatctgagaaccaagaagcccagaaccaagtaaccatctcggctagtgagaagggatattactttcacactgaaaaccccttcaaggactggcctggagcatttgaagaaggcttaaaaaggctgaaggaaggggatctgccagtcaccatcctgttcatggaagcagcaattcttcaggaccctggagatgcagaggcatggcagttcctcgggataacccaggcggagaatgaaaatgaacaagcagctattgtcgccctccagaggtgcttagaattacagcccaacaacttaaaagctttgatggccttggctgtgagttatactaacactggccatcagcaggatgcctgtgacgctctgaagaattggattaagcaaaatccaaagtacaaataccttgtgaaaagcaagaagggatctccaggcctcacccggcggatgtctaagtccccagttgatagctctgttctggaaggggtgaaggaattatatctggaagctgcccaccaaaatggagatatgatcgacccagacctgcagacaggtctaggggttctgttccacctgagtggagaatttaatagagcaatagatgcatttaacgctgccttaactgttcggccagaggactattcactatggaaccgcctcggggcgaccttggcgaacggagaccgcagcgaggaagccgtggaggcctatacgcgagcactggagattcagccaggattcatccggtccagatacaacctaggaataagctgcatcaacctgggcgcctacagagaagcggtcagcaattttctcactgccctcagtttgcaaagaaagagcaggaatcagcagcaagttcctcatcctgcaatctctgggaatatctgggctgccctcagaattgcgctctctctgatggaccaaccagaactcttccaggcggctaatcttggtgacctggatgtcctcttaagagctttcaacttggatccttgaagaaagaataataccagtactaataatccctgatctgtgtgattgtactgaaaaatcaaaaactattttattatgaatttcaaaaggataaatcaaatattcaaaaggccatggtcatatagcccaaggaaattaattcctgtggacaatgcccagtctctgttcagatccaaaagcacaaaatgttgtatatagagtcaaagtcaggctcaaaagaagaattaagagactcaagacaaaccaagataaagtaactgtgtgttgaatactctttccacaagttgcaagcatattgcaacacatgttctttgggttttttgtctccccttgcagctgatgacacatctgaggaacttgttcatgggaaacatggaaaaagcactgcctcagattgggaaattctgactgtttctgaactgtcttcttttgcaagactgaacatagtttgggccattggtgcatgcacatatattaacttgtgactaaagacagacattgcttaaacctgttccaattttaacttttactgtagccctttgattccagagagggagctttgctggcaaaagcagtttttgcactagaaatttttgctgttcccaatctaaacttttctggtattgtatatatgcactttaatatcttatttatgccttgctggagttttgttttgttgctccaatttttaacttgggggtgaaagatttaagaactcagcctcactagatcaacggaccaaataaacaattcctgaagacagtt

SEQ ID NO: 21986 - DNA, 2319 bp, Homo sapiens
atggtgatgaaggagataccgagggaggagtctgctgaagaaaagcccctccttactatgacatcacagctggtgaatgagcaacaagaaagcagacccctcctgagtccctccatcgatgactttctctgtgaaaccaaatcggaagcaatagcaaggccagtaacatccaatacagctgacattcaaacacaactggaaaaatgggacgatgttaagtttcatggagatcgaaataccaagggacatccaatggcagagagaaaatcatcctcatctagaactggatcaaaagagctcttatggtcctcagaacacagatctcaaccagaactgagtggtggaaaaagcgccctcaactctgagtcggcttcagaattggaattagtggctccgactcaggctcgactgaccaaagaacatcgctggggaagcgcattactttctagaaaccactccttagaagaagagtttgaaagggcaaaagcagcagtggagtcagatacagagttttgggataagatgcaagcagaatgggaagaaatggctcggaggaactggatatctgagaaccaagaagcccagaaccaagtaaccatctcggctagtgagaagggatattactttcacactgaaaaccccttcaaggactggcctggagcatttgaagaaggcttaaaaaggctgaaggaaggggatctgccagtcaccatcctgttcatggaagcagcaattcttcaggaccctggagatgcagaggcatggcagttcctcgggataacccaggcggagaatgaaaatgaacaagcagctattgtcgccctccagaggtgcttagaattacagcccaacaacttaaaagctttgatggccttggctgtgagttatactaacactggccatcagcaggatgcctgtgacgctctgaagaattggattaagcaaaatccaaagtacaaataccttgtgaaaagcaagaagggatctccaggcctcacccggcggatgtctaagtccccagttgatagctctgttctggaaggggtgaaggaattatatctggaagctgcccaccaaaatggagatatgatcgacccagacctgcagacaggtctaggggttctgttccacctgagtggagaatttaatagagcaatagatgcatttaacgctgccttaactgttcggccagaggactattcactatggaaccgcctcggggcgaccttggcgaacggagaccgcagcgaggaagccgtggaggcctatacgcgagcactggagattcagccaggattcatccggtccagatacaacctaggaataagctgcatcaacctgggcgcctacagagaagcggtcagcaattttctcactgccctcagtttgcaaagaaagagcaggaatcagcagcaagttcctcatcctgcaatctctgggaatatctgggctgccctcagaattgcgctctctctgatggaccaaccagaactcttccaggcggctaatcttggtgacctggatgtcctcttaagagctttcaacttggatccttgaagaaagaataataccagtactaataatccctgatctgtgtgattgtactgaaaaatcaaaaactattttattatgaatttcaaaaggataaatcaaatattcaaaaggccatggtcatatagcccaaggaaattaattcctgtggacaatgcccagtctctgttcagatccaaaagcacaaaatgttgtatatagagtcaaagtcaggctcaaaagaagaattaagagactcaagacaaaccaagataaagtaactgtgtgttgaatactctttccacaagttgcaagcatattgcaacacatgttctttgggttttttgtctccccttgcagctgatgacacatctgaggaacttgttcatgggaaacatggaaaaagcactgcctcagattgggaaattctgactgtttctgaactgtcttcttttgcaagactgaacatagtttgggccattggtgcatgcacatatattaacttgtgactaaagacagacattgcttaaacctgttccaattttaacttttactgtagccctttgattccagagagggagctttgctggcaaaagcagtttttgcactagaaatttttgctgttcccaatctaaacttttctggtattgtatatatgcactttaatatcttatttatgccttgctggagttttgttttgttgctccaatttttaacttgggggtgaaagatttaagaactcagcctcactagatcaacggaccaaataaacaattcctgaagacagtt

SEQ ID NO: 21987 - DNA, 2147 bp, Homo sapiens
aagagttcggcgaagaaggagtgagttctagagacgccccgcgagcaggacccgcgcctgcaggagagcctggccgacccggctcctcgccttctctgcgcgctctcccgcgtccgctttcagcaccccgagcggagaacagttcccggcagcccgcagcgctgccgagtggccgccggccggccgagtacccggagctccagggggctcaggagcaccctctgagaacccgctgtgcacccaccttttcccctcttttggtgggcaagtaagcacgggggaaaagcatccggtggcctcagggagccctgaagaaaccgaagcagaatgtaccagggacacatgcagggaaaaggctctagggcggcagataaggctgttgccatggtgatgaaggagataccgagggaggagtctgctgaagaaaagcccctccttactatgacatcacagctggtgaatgagcaacaagaaagcagacccctcctgagtccctccatcgatgactttctctgtgaaaccaaatcggaagcaatagcaaggccagtaacatccaatacagctgtattgaccactggcttagatctcctcgacctgagtgaaccagtctctcaaacccaaaccaaagccaagaagtcagagccctcatcaaaaacctcatccctcaagaaaaaggccgatggatctgacctcatcagcacggatgctgagcagagaggccagcctctcagagtcccggagacttcatccttagatctagacattcaaacacaactggaaaaatgggacgatgttaagtttcatggagatcgaaataccaagggacatccaatggcagagagaaaatcatcctcatctagaactggatcaaaagagctcttatggtcctcagaacacagatctcaaccagaactgagtggtggaaaaagcgccctcaactctgagtcggcttcagaattggaattagtggctccgactcaggctcgactgaccaaagaacatcgctggggaagcgcattactttctagaaaccactccttagaagaagagtttgaaagggcaaaagcagcagtggagtcagatacagagttttgggataagatgcaagcagaatgggaagaaatggctcggaggaactggatatctgagaaccaagaagcccagaaccaagtaaccatctcggctagtgagaagggatattactttcacactgaaaaccccttcaaggactggcctggagcatttgaagaaggcttaaaaaggctgaaggaaggggatctgccagtcaccatcctgttcatggaagcagcaattcttcaggaccctggagatgcagaggcatggcagttcctcgggataacccaggcggagaatgaaaatgaacaagcagctattgtcgccctccagaggtgcttagaattacagcccaacaacttaaaagctttgatggccttggctgtgagttatactaacactggccatcagcaggatgcctgtgacgctctgaagaattggattaagcaaaatccaaagtacaaataccttgtgaaaagcaagaagggatctccaggcctcacccggcggatgtctaagtccccagttgatagctctgttctggaaggggtgaaggaattatatctggaagctgcccaccaaaatggagatatgatcgacccagacctgcagacaggtctaggggttctgttccacctgagtggagaatttaatagagcaatagatgcatttaacgctgccttaactgttcggccagaggactattcactatggaaccgcctcggggcgaccttggcgaacggagaccgcagcgaggaagccgtggaggcctatacgcgagcactggagattcagccaggattcatccggtccagatacaacctaggaataagctgcatcaacctgggcgcctacagagaagcggtcagcaattttctcactgccctcagtttgcaaagaaagagcaggaatcagcagcaagttcctcatcctgcaatctctgggaatatctgggctgccctcagaattgcgctctctctgatggaccaaccagaactcttccaggcggctaatcttggtgacctggatgtcctcttaagagctttcaacttggatccttgaagaaagaataa

SEQ ID NO: 21988 - DNA, 1739 bp, Homo sapiens
agtgctaaccagaacatgtcatctttgagtctgaagccactggtccaggtctcagtaggagcttttgtccagctggtgaatgagcaacaagaaagcagacccctcctgagtccctccatcgatgactttctctgtgaaaccaaatcggaagcaatagcaaggccagtaacatccaatacagctgacattcaaacacaactggaaaaatgggacgatgttaagtttcatggagatcgaaataccaagggacatccaatggcagagagaaaatcatcctcatctagaactggatcaaaagagctcttatggtcctcagaacacagatctcaaccagaactgagtggtggaaaaagcgccctcaactctgagtcggcttcagaattggaattagtggctccgactcaggctcgactgaccaaagaacatcgctggggaagcgcattactttctagaaaccactccttagaagaagagtttgaaagggcaaaagcagcagtggagtcagatacagagttttgggataagatgcaagcagaatgggaagaaatggctcggaggaactggatatctgagaaccaagaagcccagaaccaagtaaccatctcggctagtgagaagggatattactttcacactgaaaaccccttcaaggactggcctggagcatttgaagaaggcttaaaaaggctgaaggaaggggatctgccagtcaccatcctgttcatggaagcagcaattcttcaggaccctggagatgcagaggcatggcagttcctcgggataacccaggcggagaatgaaaatgaacaagcagctattgtcgccctccagaggtgcttagaattacagcccaacaacttaaaagctttgatggccttggctgtgagttatactaacactggccatcagcaggatgcctgtgacgctctgaagaattggattaagcaaaatccaaagtacaaataccttgtgaaaagcaagaagggatctccaggcctcacccggcggatgtctaagtccccagttgatagctctgttctggaaggggtgaaggaattatatctggaagctgcccaccaaaatggagatatgatcgacccagacctgcagacaggtctaggggttctgttccacctgagtggagaatttaatagagcaatagatgcatttaacgctgccttaactgttcggccagaggactattcactatggaaccgcctcggggcgaccttggcgaacggagaccgcagcgaggaagccgtggaggcctatacgcgagcactggagattcagccaggattcatccggtccagatacaacctaggaataagctgcatcaacctgggcgcctacagagaagcggtcagcaattttctcactgccctcagtttgcaaagaaagagcaggaatcagcagcaagttcctcatcctgcaatctctgggaatatctgggctgccctcagaattgcgctctctctgatggaccaaccagaactcttccaggcggctaatcttggtgacctggatgtcctcttaagagctttcaacttggatccttgaagaaagaataataccagtactaataatccctgatctgtgtgattgtactgaaaaatcaaaaactattttattatgaatttcaaaaggataaatcaaatattcaaaaggccatggtcatatagcccaaggaaattaattcctgtggacaatgcccagtctctgttcagatccaaaagcac

SEQ ID NO: 21989 - DNA, 9082 bp, Homo sapiens
gagaaagagttcggcgaagaaggagtgagttctagagacgccccgcgagcaggacccgcgcctgcaggagagcctggccgacccggctcctcgccttctctgcgcgctctcccgcgtccgctttcagcaccccgagcggagaacagttcccggcagcccgcagcgctgccgagtggccgccggccggccgagtacccggagctccagggggctcaggagcaccctctgagaacccgctgtgcacccaccttttcccctcttttggtgggcaagtaagcacgggggaaaagcatccggtggcctcagggagccctgaagaaaccgaagcagaatgtaccagggacacatgcagaaaagtaaagaacaaggatatggaaaactaagcagtgatgaagacctcgaaataattgttgatcaaaagcagggaaaaggctctagggcggcagataaggctgttgccatggtgatgaaggagataccgagggaggagtctgctgaagaaaagcccctccttactatgacatcacagctggtgaatgagcaacaagaaagcagacccctcctgagtccctccatcgatgactttctctgtgaaaccaaatcggaagcaatagcaaggccagtaacatccaatacagctgtattgaccactggcttagatctcctcgacctgagtgaaccagtctctcaaacccaaaccaaagccaagaagtcagagccctcatcaaaaacctcatccctcaagaaaaaggccgatggatctgacctcatcagcacggatgctgagcagagaggccagcctctcagagtcccggagacttcatccttagatctagacattcaaacacaactggaaaaatgggacgatgttaagtttcatggagatcgaaataccaagggacatccaatggcagagagaaaatcatcctcatctagaactggatcaaaagagctcttatggtcctcagaacacagatctcaaccagaactgagtggtggaaaaagcgccctcaactctgagtcggcttcagaattggaattagtggctccgactcaggctcgactgaccaaagaacatcgctggggaagcgcattactttctagaaaccactccttagaagaagagtttgaaagggcaaaagcagcagtggagtcagatacagagttttgggataagatgcaagcagaatgggaagaaatggctcggaggaactggatatctgagaaccaagaagcccagaaccaagtaaccatctcggctagtgagaagggatattactttcacactgaaaaccccttcaaggactggcctggagcatttgaagaaggcttaaaaaggctgaaggaaggggatctgccagtcaccatcctgttcatggaagcagcaattcttcaggaccctggagatgcagaggcatggcagttcctcgggataacccaggcggagaatgaaaatgaacaagcagctattgtcgccctccagaggtgcttagaattacagcccaacaacttaaaagctttgatggccttggctgtgagttatactaacactggccatcagcaggatgcctgtgacgctctgaagaattggattaagcaaaatccaaagtacaaataccttgtgaaaagcaagaagggatctccaggcctcacccggcggatgtctaagtccccagttgatagctctgttctggaaggggtgaaggaattatatctggaagctgcccaccaaaatggagatatgatcgacccagacctgcagacaggtctaggggttctgttccacctgagtggagaatttaatagagcaatagatgcatttaacgctgccttaactgttcggccagaggactattcactatggaaccgcctcggggcgaccttggcgaacggagaccgcagcgaggaagccgtggaggcctatacgcgagcactggagattcagccaggattcatccggtccagatacaacctaggaataagctgcatcaacctgggcgcctacagagaagcggtcagcaattttctcactgccctcagtttgcaaagaaagagcaggaatcagcagcaagttcctcatcctgcaatctctgggaatatctgggctgccctcagaattgcgctctctctgatggaccaaccagaactcttccaggcggctaatcttggtgacctggatgtcctcttaagagctttcaacttggatccttgaagaaagaataataccagtactaataatccctgatctgtgtgattgtactgaaaaatcaaaaactattttattatgaatttcaaaaggataaatcaaatattcaaaaggccatggtcatatagcccaaggaaattaattcctgtggacaatgcccagtctctgttcagatccaaaagcacaaaatgttgtatatagagtcaaagtcaggctcaaaagaagaattaagagactcaagacaaaccaagataaagtaactgtgtgttgaatactctttccacaagttgcaagcatattgcaacacatgttctttgggttttttgtctccccttgcagctgatgacacatctgaggaacttgttcatgggaaacatggaaaaagcactgcctcagattgggaaattctgactgtttctgaactgtcttcttttgcaagactgaacatagtttgggccattggtgcatgcacatatattaacttgtgactaaagacagacattgcttaaacctgttccaattttaacttttactgtagccctttgattccagagagggagctttgctggcaaaagcagtttttgcactagaaatttttgctgttcccaatctaaacttttctggtattgtatatatgcactttaatatcttatttatgccttgctggagttttgttttgttgctccaatttttaacttgggggtgaaagatttaagaactcagcctcactagatcaacggaccaaataaacaattcctgaagacagtttttcatagtgtaggattttgaagaagtgtttttcttaaagcagatacgatgacataaggcgtaaatatggcaaacagatcttttcattcacgtgctttctgggtctgtatgaacataagtaagacacaaggtactgtctcttcatgcattctctgcaggaagaaagtttgatggtatcgtgatttctattgagttcaaattaacttgcttaagtgtcatactttactggctttgccctgcacaccaatattccttttaaaccataaatattttaaataatatttcttaagagtgataaataacattttttcctaaaaattatgttttcttagtttcataataatctgcactgttcatccccttgcattctaagtgatagaagagcaacactttcaaaccaaatctcactgaatgccagtgatttcatatgaaagatgcatgcctctttggctctttgaacatttagcaagtattgggaattttctattagcagtggtgttttaattggttgaattccacttagttctccacagtgttttgtatgtgtttggggcttggtgattattttgaaagatacattttttaaagaattaggaacattttttgcaaaatgctaatcagaatataattttcccaatgtcaggtatagaagttatcccattcttctttacctggtctccttccttcgtctagaaccttccccacagtagctaatcctaacaactttttatttatgttctttgataataatagctcatcccgctcatgattatagctacccacaaaaaataaaacaacaacaacaaaaaagactccacagaattgggatcaaaacagtctaattggctggggaataagcttctactgaggagtaaatgtgcacacgtgcttatcaattgaatgcgaggtacaggaataaaatcctctcctctgttacatctgaagtccttgggttgtgagagggcctcaagttaacagaaaccacaagtccttgaggcttacatatgttataacctattctagtttataaagacaaaaagctgaggccactgtgaggagtgccaggttttgatagtcattgtcaaagttgacttgggccaggtggtagctccagctggtcagcagaaggcagaggcattcaggcactcatcatgggtagcagcgaccacccagtctcagaccgtgcttctctacagtctcagcagcaaagtaaagctcaacaatgctttcaagaatggtattgtaagaattgtagaattcgagaaacccagtctggtaaggactcttggggccagcctccaagccatggcagggcctgcttgaatatgcctgattaagcatcctttccttccctgctccttcctcctgccatctctgtaccttgaccagaaagtcggcatgaatagttcatggacaaaggattgaatagcctctgaacaaaggattcaaagcaaactttgtaagtgttctgtgatgccattctatactttgagcagcagctgaatctgcagcctggatttaaagcctgaaactagtataaatgtcaaataattaatttgttgctaaatggtggcaaattttgtggcccaagttttattttgctattggaacacaaactccaaggagctgttttagggaagactaaacaatcttccattcttaccattatttggcaatttgcagagcatttagtagtactttctctagtgtatgtagtatctgtcagatctaagatttttataggctgtcaagaagtccagaattacggcccaagaggaaaagagttgcatttttcaataatattttttataaaattaagttaaaaccattattaaaacatgagtgacaggccaggtgcggtggctcacgcctgtaatcctagcactttgggaggcagaggcgggcagaccacgaggtcaggagttcgagaccagcctgaccaacatggtgaaaccccgtctttattaagaatacaaaaattagccgggtgtagtggtatgcacctgtaataccagctactcaggaggctgaggcaggagaatcacttgaaccagggaggcggaggttgcagtgagccgagattgcaccgctgcactccagtctgggtgacagagcgagactccgtctcaaaaaaaacaaaaaagtgacagtttataggaatagagcaccaccaagaaatcagtagcaagactttagaacagtctttttgtataaatcatatacagtaaatgttttgtttcttagaagtgcatctactttattttttggcagaacaatttttggcatcttatcttcatggcatgaaattgtcatttaaattactctttccgtttgaaaggggagggtatccttatttcccttctgaggtactctgagaaggctttgagtttcctttttcatgtattaatgtataacagcctaacagctcctagaagagggtattcttactagaatggctacatacgggtgacttcagttacatacaggtgacttccagggactgacttcgcctgtagattggatgaaaataaagagaaagccagtgattattgctgagtttcaaaatataaccatttctagtaggctacttctacatgctgttgtaccttcctggtgaggaggagacagagggataggggagaggaggaggaataaaaatccctctcactgggccaatcatactgattcattccctttacttcctccaaaactcactccccatgactcctgaaaaatgggtagatctcgtccaccaggaaattttaatagaatactatgcaccgtgctttctcagtcaatctggattcctactagaacagaaaagtaaggaaacataactgggtaggaatgtccacttacgtttcacaaactcacttttagagtttcatgccactttcctcattcttctctttaagatactattatattgaacgtgggacccatgtctaaatacttgtatagataaatatttcttgtatattcttcccatacaagcaagacttgaatacagttgtagctagtcccacttttataataaaagcttccaaactctttatcataaactttgtctgtgagcttgggaatacagagaaagcaagttgatcattctgagacccttcctcatttgccctgaatcagttccccaagattggactgtactttaagctagttgttgtagcagtggtggttgttgttttatatcttgagatacttctagaacattctagaaacagggtattctaaaggcttactttatatgccatcctttttgaaccctcttattttagaaattattacacgtgcacacttatgatttcaaccttgtaaaataatttcaaattcatttcgtatccacattttactgcagtttccctatcatcatctcaatagttatagaactggttgaaattaaactgttttgaactaagaagtagatatatatatatatatatatatatatttttttttttttttttaaagagtgttcatagataaactctggcataaagtttgtaaaaaagcaattttttaaaagcaaaacgtataacctcaggtacaaaaatattgcatgcattagtattgcaaatttgcctactcaaatattaaccaaagcatgcaagataacttgactgaatttaaatttacacagtgcatgattaagtctcataggttagcctgttgttccttgcctctatacaagggagcatttttatgaactttgtgttacagtttttctatttgcttttcttatcctatccttgagattgttttcatgctatcacactgaactttacagatattcacacatctggtttctacagtgttaccagtgccaaactaatcctctgaagaatctgggacatctaaacactttttcaaaaaccagttgaggcacaacagatcccaaacttaaacaaatccaagtgtctgaatgctactaaactaaatcatgttgactgcctcagcacataaaggtttcgactttaaattcttaataatgcatttcaaaatttttctaaaagtttgggaataaattagaaaaactgatattctaaataaggcgaggaggttggggtaatgtcaggcacatcaaaatcatcacacaacgaagtagatatggggccttaattttcataaatgtcacatagcaagtgtgtggggtatcacaacattgttctgatacagccctgtttgtatggtagttgagctgcttgggctaaatgtcccttgagaaactggacttgatcaacaggtctaaaaacactgatatttagggagtgatgaggtgatttcacggtcactcagaaccaactctgaaatcttctcactgccttttcccataacccctattttatgaggagaccagaaagggagagagcaaagctcagtgagaccatgtggtcttacattagtaacagctttgttactcactccatataccccggtaccctcacacacataccatgaactcaaagacagaattctacacataacacacatagcaaagacgattgtggggaggcattaaacagttaagaggaaaaaaaaaaacacagaaaattaaactgtgaggtttaacaacctctcatgtggtattttgccttgaacgaagtttccactacctgcagcttctgcagaaataccaaaataacacagtctagagacaagtgtcccaatgtcagaactgttttctcaggaccttctctataagagaaaactaacttgcaatgctgcagaatgtcagagcaaaaccctgatgagctccgtgggatacttaatagaagcctgcactcaaaataatattaagatggaaacaacaacaacaattaggcagttctttgctcaactataaaatgtgtatcattcattgggggagggggaggggtcgtgttctttggatttcttggaaagggaaatggtataacacaaaaagactaagaggtatacacactcagctcggtaattcgagcatttggcattttcactgagatatatagcatttctgcatggataccatacaagaattctgccatgtgagaaatgtgttcatgatggactacattaccagtagttaagggaaatacagcaaacttaagtttttaccaacttcctttcatgttccctatatatcatctaacccaaactttcaatttacattgcccaaatttgtttacattggttgaaaaaaaactgattaatttattaaactttttacaaactgtaacaaacatttaactatttagaaaagacatttctacatattttatatatctatgaatattgcatctctaatctaatctaaaaatgttgttttgagacaattcttctgtgatgcttcctcctcatgctcataaatgtttaaagtcttgggatttcattttcaggctgaaatagataacaagaaaaaaatttaagtttaaatgtttacattgcgttactaaattaataccaattcaaattaagtgacctatagtaaattaatggcaatgggggggaggggattttaaagtgattggcatattatgtgatactgtatcagtgatttagtgaaataatatgtatcatagcacaactctgttgggtattaaggcttcatcttagtatttccctgcgttgctctttgaaataaaattactaccataaaaataacctcttatcatattgatgtgtttaatttactcagttggcttctaatttgcgtaacaagattaaggtagtatttttgtactattattggaagcatgccttccctttttcacattattaaattgtatttatatttgtgcaattttaaactatgttttcaaataaactttgtctgcggcttcgaggtcttttcaggaatctttcaaaatgggatttggggatcagaactccttctgatcaaatggaatccaatttgtactactggctaaaggtccttttattaaatattgaatatcactacatatgattttgcatgagctatctggaaatcaggaatgcatttttggatataaaacaaaactttaaaaatcttcctcctttgttaattttttaagactaaaatattatttaacctgaaattgaattttgtgattctttttagaataaaaatattaaaataaa

SEQ ID NO: 21990 - DNA, 2361 bp, Homo sapiens
ctttggctactgtgaaagaccacgcagaagctgtggacttgctttttgtgcttgacaaaagtgcatagatagaagacagggattcccggctgggaggagggaggagagctgaagatccctgcctgggctggctgagctaagcaaagtgggaagctgagtgcttgaaagaggattatgctcgcactagaaataagcaaaaagtaaagaacaaggatatggaaaactaagcagtgatgaagacctcgaaataattgttgatcaaaagcagggaaaaggctctagggcggcagataaggctgttgccatggtgatgaaggagataccgagggaggagtctgctgaagaaaagcccctccttactatgacatcacagctggtgaatgagcaacaagaaagcagacccctcctgagtccctccatcgatgactttctctgtgaaaccaaatcggaagcaatagcaaggccagtaacatccaatacagctgtattgaccactggcttagatctcctcgacctgagtgaaccagtctctcaaacccaaaccaaagccaagaagtcagagccctcatcaaaaacctcatccctcaagaaaaaggccgatggatctgacctcatcagcacggatgctgagcagagaggccagcctctcagagtcccggagacttcatccttagatctagacattcaaacacaactggaaaaatgggacgatgttaagtttcatggagatcgaaataccaagggacatccaatggcagagagaaaatcatcctcatctagaactggatcaaaagagctcttatggtcctcagaacacagatctcaaccagaactgagtggtggaaaaagcgccctcaactctgagtcggcttcagaattggaattagtggctccgactcaggctcgactgaccaaagaacatcgctggggaagcgcattactttctagaaaccactccttagaagaagagtttgaaagggcaaaagcagcagtggagtcagatacagagttttgggataagatgcaagcagaatgggaagaaatggctcggaggaactggatatctgagaaccaagaagcccagaaccaagtaaccatctcggctagtgagaagggatattactttcacactgaaaaccccttcaaggactggcctggagcatttgaagaaggcttaaaaaggctgaaggaaggggatctgccagtcaccatcctgttcatggaagcagcaattcttcaggaccctggagatgcagaggcatggcagttcctcgggataacccaggcggagaatgaaaatgaacaagcagctattgtcgccctccagaggtgcttagaattacagcccaacaacttaaaagctttgatggccttggctgtgagttatactaacactggccatcagcaggatgcctgtgacgctctgaagaattggattaagcaaaatccaaagtacaaataccttgtgaaaagcaagaagggatctccaggcctcacccggcggatgtctaagtccccagttgatagctctgttctggaaggggtgaaggaattatatctggaagctgcccaccaaaatggagatatgatcgacccagacctgcagacaggtctaggggttctgttccacctgagtggagaatttaatagagcaatagatgcatttaacgctgccttaactgttcggccagaggactattcactatggaaccgcctcggggcgaccttggcgaacggagaccgcagcgaggaagccgtggaggcctatacgcgagcactggagattcagccaggattcatccggtccagatacaacctaggaataagctgcatcaacctgggcgcctacagagaagcggtcagcaattttctcactgccctcagtttgcaaagaaagagcaggaatcagcagcaagttcctcatcctgcaatctctgggaatatctgggctgccctcagaattgcgctctctctgatggaccaaccagaactcttccaggcggctaatcttggtgacctggatgtcctcttaagagctttcaacttggatccttgaagaaagaataataccagtactaataatccctgatctgtgtgattgtactgaaaaatcaaaaactattttattatgaatttcaaaaggataaatcaaatattcaaaaggccatggtcatatagcccaaggaaattaattcctgtggacaatgcccagtctctgttcagatccaaaagcacaaaatgttgtatatagagtcaaagtcaggctcaaaagaagaattaagagactcaagacaaaccaagataaagtaactgtgtgttgaatactctttccacaagttgcaagcatattgcaacacatgt

SEQ ID NO: 21991 - DNA, 2992 bp, Homo sapiens
gagaacggcgcgcgccccgctcggcagctgcggcggcggctggtgtaggcgctcacgtcagggctgggaggagggggttcgcagctcagagagagagagacatgaggcaacctggcaggaagcgagaaagagttcggcgaagaaggagtgagttctagagacgccccgcgagcaggacccgcgcctgcaggagagcctggccgacccggctcctcgccttctctgcgcgctctcccgcgtccgctttcagcaccccgagcggagaacagttcccggcagcccgcagcgctgccgagtggccgccggccggccgagtacccggagctccagggggctcaggagcaccctctgagaacccgctgtgcacccaccttttcccctcttttggtgggcaagtaagcacgggggaaaagcatccggtggcctcagggagccctgaagaaaccgaagcagaatgtaccagggacacatgcagaaaagtaaagaacaaggatatggaaaactaagcagtgatgaagacctcgaaataattgttgatcaaaagcagctggtgaatgagcaacaagaaagcagacccctcctgagtccctccatcgatgactttctctgtgaaaccaaatcggaagcaatagcaaggccagtaacatccaatacagctgtattgaccactggcttagatctcctcgacctgagtgaaccagtctctcaaacccaaaccaaagccaagaagtcagagccctcatcaaaaacctcatccctcaagaaaaaggccgatggatctgacctcatcagcacggatgctgagcagagaggccagcctctcagagtcccggagacttcatccttagatctagacattcaaacacaactggaaaaatgggacgatgttaagtttcatggagatcgaaataccaagggacatccaatggcagagagaaaatcatcctcatctagaactggatcaaaagagctcttatggtcctcagaacacagatctcaaccagaactgagtggtggaaaaagcgccctcaactctgagtcggcttcagaattggaattagtggctccgactcaggctcgactgaccaaagaacatcgctggggaagcgcattactttctagaaaccactccttagaagaagagtttgaaagggcaaaagcagcagtggagtcagatacagagttttgggataagatgcaagcagaatgggaagaaatggctcggaggaactggatatctgagaaccaagaagcccagaaccaagtaaccatctcggctagtgagaagggatattactttcacactgaaaaccccttcaaggactggcctggagcatttgaagaaggcttaaaaaggctgaaggaaggggatctgccagtcaccatcctgttcatggaagcagcaattcttcaggaccctggagatgcagaggcatggcagttcctcgggataacccaggcggagaatgaaaatgaacaagcagctattgtcgccctccagaggtgcttagaattacagcccaacaacttaaaagctttgatggccttggctgtgagttatactaacactggccatcagcaggatgcctgtgacgctctgaagaattggattaagcaaaatccaaagtacaaataccttgtgaaaagcaagaagggatctccaggcctcacccggcggatgtctaagtccccagttgatagctctgttctggaaggggtgaaggaattatatctggaagctgcccaccaaaatggagatatgatcgacccagacctgcagacaggtctaggggttctgttccacctgagtggagaatttaatagagcaatagatgcatttaacgctgccttaactgttcggccagaggactattcactatggaaccgcctcggggcgaccttggcgaacggagaccgcagcgaggaagccgtggaggcctatacgcgagcactggagattcagccaggattcatccggtccagatacaacctaggaataagctgcatcaacctgggcgcctacagagaagcggtcagcaattttctcactgccctcagtttgcaaagaaagagcaggaatcagcagcaagttcctcatcctgcaatctctgggaatatctgggctgccctcagaattgcgctctctctgatggaccaaccagaactcttccaggcggctaatcttggtgacctggatgtcctcttaagagctttcaacttggatccttgaagaaagaataataccagtactaataatccctgatctgtgtgattgtactgaaaaatcaaaaactattttattatgaatttcaaaaggataaatcaaatattcaaaaggccatggtcatatagcccaaggaaattaattcctgtggacaatgcccagtctctgttcagatccaaaagcacaaaatgttgtatatagagtcaaagtcaggctcaaaagaagaattaagagactcaagacaaaccaagataaagtaactgtgtgttgaatactctttccacaagttgcaagcatattgcaacacatgttctttgggttttttgtctccccttgcagctgatgacacatctgaggaacttgttcatgggaaacatggaaaaagcactgcctcagattgggaaattctgactgtttctgaactgtcttcttttgcaagactgaacatagtttgggccattggtgcatgcacatatattaacttgtgactaaagacagacattgcttaaacctgttccaattttaacttttactgtagccctttgattccagagagggagctttgctggcaaaagcagtttttgcactagaaatttttgctgttcccaatctaaacttttctggtattgtatatatgcactttaatatcttatttatgccttgctggagttttgttttgttgctccaatttttaacttgggggtgaaagatttaagaactcagcctcactagatcaacggaccaaataaacaattcctgaagacagtt

SEQ ID NO: 21992 - DNA, 2696 bp, Homo sapiens
atggcgctggctgtcttgcgggtcctggagccctttccgaccgagacacccccgttggcagtgctgctgccacccgggggcccgtggccggcggcggagctgggcctggtgctggccctgaggcctgcaggggagagcccggcagggccggcgctgctggtggcagccctggaggggccggacgcgggcaccgaagagcagggtcccgggccgccgcagctactggttagccgcgcgctgctgcggctcctggcactgggctccggggcctgggtgcgggcgcgggcggtgcggcggcccccggcgctaggttgggcactgcttggcacctcgctggggcctgggctcggaccgcgagtcgggccgctgctggtgaggcgcggagagaccctcccagtgcccggaccgcgggtgctggagacgcggccggcgttgcaagggctgctgggcccagggactcggctggctgtgactgagctccgcgggcgggccagactgtgtccagagtctggggacagcagtcggcccccacccccgcccgtggtgtcctcctttgcggtttctggcacagtgcggcgactccagggagttctgggagggactggagattcactaggggtgagccggagctgtctccgtggccttggcctcttccagggcgaatgggtgtgggtggcccaggccagagagtcatcgaacacttcacagccgcacttggctagggtgcaggtcctagaacctcgctgggacctctctgatagactgggacccggctctggaccgctgggagagcccctcgctgacggactggcgcttgtccctgccactttggcttttaatcttggctgtgaccccctggaaatgggagagctcagaattcagaggtacttggaaggctccatcgcccctgaagacaaaggaagctgctcattgctgcctgggcctccatttgccagagagttacacatcgaaattgtgtcttctccccactacagcactaatggaaattatgacggtgttctttaccggcactttcagatacccagggtagtccaggaaggggatgttctatgtgtgccaacaattgggcaagtagagatcctggaaggaagtccagagaaactgcccaggtggcgggaaatgttttttaaagtgaagaaaacagttggggaagctccagatggaccagccagtgcctacttggccgacaccacccatacctccttgtacatggtgggttctaccctgagccctgttccatggctcccttcagaggaatccactctctggagcagtttgtctcctccaggcctggaggccttggtgtctgaactctgtgctgtcctgaagcctcgcctccagccagggggtgccctgctgacaggaactagcagtgtccttctacggggccccccaggctgtgggaagaccacagtagttgctgctgcctgtagtcaccttgggctccacttactgaaggtgccctgctccagcctctgtgcagaaagtagtggggctgtggagacaaaactgcaggccatcttctcccgggcccgccgttgccggcctgcagtcctgttgctcacagctgtggaccttctgggccgggaccgtgatgggctgggtgaggatgcccgtgtgatggctgtgctgcgtcacctcctcctcaatgaggaccccctcaacagctgccctcccctcatggttgtggccaccacaagccgggcccaggacctgcctgctgatgtgcagacagcatttcctcatgagctcgaggtgcctgctctgtcagaggggcagcggctcagcatcctgcgggccctcactgcccaccttcccctgggccaggaggtgaacttggcacagctagcacggcggtgtgcaggctttgtggtaggggatctctatgcccttctgacccacagcagccgggcagcctgcaccaggatcaagaactcaggtttggcaggtggcttgactgaggaggatgagggggagctgtgtgctgccggctttcctctcctggctgaggactttgggcaggcactggagcaactgcagacagctcactcccaggccgttggagcccccaaggtggagaccaagtccttggagtgtttgccagggccagggctgcagctccatgcattatcttctttgatgaactggactctttggccccaagccgggggcgaagtggagattctggaggagtgatggacagggtggtgtctcagctccttgccgagctagatgggctgcacagcactcaggatgtgtttgtgattggagccaccaacagaccagatctcctggaccctgcccttctgcggcctggcagatttgacaagctggtgtttgtgggggcaaatgaggaccgggcctcccagctacgcgttctaagtgccatcacacgcaaattcaagctagagccatctgtgagcctggtaaacgtgctagattgctgccctccccagctgacgggcgcggacctctactctctctgctctgatgctatgacagctgccctcaaacgcagggttcatgacctggaggaagggctggagccaggtagctcagcactgatgctcaccatggaggacttgctgcaggctgccgcccggctgcaaccctcagtcagtgagcaggagctgctccggtacaagcgcatccagcgcaagtttgctgcctgctag

SEQ ID NO: 21993 - DNA, 3478 bp, Homo sapiens
acactagtcgtctggctctctggctccggaagctgcgctccttcaccctcctcgttggtgtcctgtcaccatggcgctggctgtcttgcgggtcctggagccctttccgaccgagacacccccgttggcagtgctgctgccacccgggggcccgtggccggcggcggagctgggcctggtgctggccctgaggcctgcaggggagagcccggcagggccggcgctgctggtggcagccctggaggggccggacgcgggcaccgaagagcagggtcccgggccgccgcagctactggttagccgcgcgctgctgcggctcctggcactgggctccggggcctgggtgcgggcgcgggcggtgcggcggcccccggcgctaggttgggcactgcttggcacctcgctggggcctgggctcggaccgcgagtcgggccgctgctggtgaggcgcggagagaccctcccagtgcccggaccgcgggtgctggagacgcggccggcgttgcaagggctgctgggcccagggactcggctggctgtgactgagctccgcgggcgggccagactgtgtccagagtctggggacagcagtcggcccccacccccgcccgtggtgtcctcctttgcggtttctggcacagtgcggcgactccagggagttctgggagggactggagattcactaggggtgagccggagctgtctccgtggccttggcctcttccagggcgaatgggtgtgggtggcccaggccagagagtcatcgaacacttcacagccgcacttggctagggtgcaggtcctagaacctcgctgggacctctctgatagactgggacccggctctggaccgctgggagagcccctcgctgacggactggcgcttgtccctgccactttggcttttaatcttggctgtgaccccctggaaatgggagagctcagaattcagaggtacttggaaggctccatcgcccctgaagacaaaggaagctgctcattgctgcctgggcctccatttgccagagagttacacatcgaaattgtgtcttctccccactacagcactaatggaaattatgacggtgttctttaccggcactttcagatacccagggtagtccaggaaggggatgttctatgtgtgccaacaattgggcaagtagagatcctggaaggaagtccagagaaactgcccaggtggcgggaaatgttttttaaagtgaagaaaacagttggggaagctccagatggaccagccagtgcctacttggccgacaccacccatacctccttgtacatggtgggttctaccctgagccctgttccatggctcccttcagaggaatccactctctggagcagtttgtctcctccaggcctggaggccttggtgtctgaactctgtgctgtcctgaagcctcgcctccagccagggggtgccctgctgacaggaactagcagtgtccttctacggggccccccaggctgtgggaagaccacagtagttgctgctgcctgtagtcaccttgggctccacttactgaaggtgccctgctccagcctctgtgcagaaagtagtggggctgtggagacaaaactgcaggccatcttctcccgggcccgccgttgccggcctgcagtcctgttgctcacagctgtggaccttctgggccgggaccgtgatgggctgggtgaggatgcccgtgtgatggctgtgctgcgtcacctcctcctcaatgaggaccccctcaacagctgccctcccctcatggttgtggccaccacaagccgggcccaggacctgcctgctgatgtgcagacagcatttcctcatgagctcgaggtgcctgctctgtcagaggggcagcggctcagcatcctgcgggccctcactgcccaccttcccctgggccaggaggtgaacttggcacagctagcacggcggtgtgcaggctttgtggtaggggatctctatgcccttctgacccacagcagccgggcagcctgcaccaggatcaagaactcaggtttggcaggtggcttgactgaggaggatgagggggagctgtgtgctgccggctttcctctcctggctgaggactttgggcaggcactggagcaactgcagacagctcactcccaggccgttggagcccccaagatcccctcagtgtcctggcatgatgtgggtgggctgcaggaggtgaagaaggagatcctggagaccattcagctccccctggagcaccctgagctactgagcctgggcctgagacgctcaggccttctgctccatgggccccctggcaccggcaagacccttctggccaaggcagtagccactgagtgcagccttaccttcctcagcgtgaaggggccagagctcattaacatgtatgtgggccaaagtgaggagaatgtgcgggaagtgtttgccagggccagggctgcagctccatgcattatcttctttgatgaactggactctttggccccaagccgggggcgaagtggagattctggaggagtgatggacagggtggtgtctcagctccttgccgagctagatgggctgcacagcactcaggatgtgtttgtgattggagccaccaacagaccagatctcctggaccctgcccttctgcggcctggcagatttgacaagctggtgtttgtgggggcaaatgaggaccgggcctcccagctacgcgttctaagtgccatcacacgcaaattcaagctagagccatctgtgagcctggtaaacgtgctagattgctgccctccccagctgacgggcgcggacctctactctctctgctctgatgctatgacagctgccctcaaacgcagggttcatgacctggaggaagggctggagccaggtagctcagcactgatgctcaccatggaggacttgctgcaggctgccgcccggctgcaaccctcagtcagtgagcaggagctgctccggtacaagcgcatccagcgcaagtttgctgcctgctaggagccccccagggtctgggaccccgctcagcatggctgcaggtaccttgatagcccacagagagatctgggaaggaagggctcctcctcaggctgctgccaacccacctggaggccacctccctccaggagatcccagggtgcaaagtggcattgagacagcagcaacagctcaagagatatctcctgcctacttgcccctccttccaggccggctctaagagaaaggcccatctactcaggaagagggccagggccttgggttctggggattgggccctgagagggctagttctgtggctgaaaataaagcatgtcccgccccctactggtgttgtggcatgaaaggttggagtgagaaagagcagggttgtgggaggagtaagccctgggagagggtgggggggtgggcagcatgggagcctgatccttctgacataaataaacacaatgcatgcaggaactg

SEQ ID NO: 21994 - DNA, 1448 bp, Homo sapiens
tctctctaaccgcgccagtgtgcctccgactcggaacggcttccgcggccggggcagcgagggccgggggcggcgggcgggatgagtgcggtgtgcggtggagcggcgcggatgctgcggacgccgggacgccacggctacgccgccgagttctccccgtacctgccgggccgcctggcctgcgccaccgcgcagcactacggcatcgcgggctgtggaaccctactaatattggatccagatgaagctgggctaaggctttttagaagctttgactggaatgatggtttgtttgatgtgacttggagtgagaacaacgaacatgtcctcatcacctgtagtggcgatggctcgctgcagctctgggacactgccaaagctgcagggccactgcaagtctataaagaacacgctcaggaggtgtatagtgttgattggagccaaaccagaggtgaacagcttgtggtgtctggctcatgggatcaaactgtcaaattgtgggatccaactgttggaaagtctctgtgcacctttagaggccatgaaagtattatttatagcacaatctggtctccccacatccctggttgttttgcttcagcctcaggtgatcagactctgagaatatgggatgtgaaggcagcaggagtaagaatcgtgattcctgcacatcaggcagaaatcttgagttgtgactggtgtaaatacaatgagaatttgctggtgaccggggcggttgactgtagtttgagaggctgggacttaaggaatgtacgacaaccagtgtttgaacttcttggtcatacctatgctattaggagggtgaaattttcaccatttcatgcttctgtgctggcctcttgctcgtatgattttactgtaagattctggaacttttcaaagcctgactctcttcttgaaacagtggagcatcatacagagtttacttgtggtttagacttcagtcttcagagccccactcaggtggctgactgttcttgggatgaaacaataaagatctatgaccctgcttgtcttactattcctgcttgagatacactactttggtcagaaacagaggatgttggctgaagaactgcctaacagcaaataaattaactatggaaaacatagacattatgcttttatatgctattcagatttcaaatctttccaatttaccctggaatcagttttgagggagctgataaagactttagctgactcgttaagcctgatacataagccatatttaaaattctaagaaataattaatgttatgatatatcttgtagtatctattaaaatgtctctgggtcataaaatggattaaaatatgggagatcagtaggttatacttatatagatagtgatatatttcatttttaatttgtcatttttgatgtaaaatataatcactgctgtgataaataaactatctattgatc

SEQ ID NO: 21995 - DNA, 680 bp, Homo sapiens
gcctggtctctctaaccgcgccagtgtgcctccgactcggaacggcttccgcggccggggcagcgagggccgggggcggcgggcgggatgagtgcggtgtgcggtggagcggcgcggatgctgcggacgccgggacgccacggctacgccgccgagttctccccgtacctgccgggccgcctggcctgcgccaccgcgcagcactacggcatcgcgggctgtggaaccctactaatattggatccagatgaagctgggctaaggctttttagaagctttgactggaatgatggtttgtttgatgtgacttggagtgagaacaacgaacatgtcctcatcacctgtagtggcgatggctcgctgcagctctgggacactgccaaagctgcagggccactgcaagtctataaagaacacgctcaggagtatgttcagggaagctgtgttgtgaaatagaagagcaactaatgggtcattttcttctgtggaagagagtatataataaagacgtatagcatggttttagtcaatcttggatttgaatcccagctttgtaagttacctgttgtgagaccttgcgtatgtcacatatttttcctaaacttgagtgtttttatttgcaaactaagtttattagtagtctgtatcacagaccagcattgaataaatatgagctagta

SEQ ID NO: 21996 - DNA, 1539 bp, Homo sapiens
cctggtctctctaaccgcgccagtgtgcctccgactcggaacggcttccgcggccggggcagcgagggccgggggcggcgggcgggatgagtgcggtgtgcggtggagcggcgcggatgctgcggacgccgggacgccacggctacgccgccgagttctccccgtacctgccgggccgcctggcctgcgccaccgcgcagcactacggcatcgcgggctgtggaaccctactaatattggatccagatgaagctgggctaaggctttttagaagctttgactggaatgatggtttgtttgatgtgacttggagtgagaacaacgaacatgtcctcatcacctgtagtggcgatggctcgctgcagctctgggacactgccaaagctgcagggccactgcaagtctataaagaacacgctcaggaggtgtatagtgttgattggagccaaaccagaggtgaacagcttgtggtgtctggctcatgggatcaaactgtcaaattgtgggatccaactgttggaaagtctctgtgcacctttagaggccatgaaagtattatttatagcacaatctggtctccccacatccctggttgttttgcttcagcctcaggtgatcagactctgagaatatgggatgtgaaggcagcaggagtaagaatcgtgattcctgcacatcaggcagaaatcttgagttgtgactggtgtaaatacaatgagaatttgctggtgaccggggcggttgactgtagtttgagaggctgggacttaaggaatgtacgacaaccagtgtttgaacttcttggtcatacctatgctattaggagggtgaaaatggagtcttgccctgtcacccagacacgatctcagctcactgcaacctctgccttctgggttcaagctgttctcctgcctcagcctactgagtagctgggactacagttttcaccatttcatgcttctgtgctggcctcttgctcgtatgattttactgtaagattctggaacttttcaaagcctgactctcttcttgaaacagtggagcatcatacagagtttacttgtggtttagacttcagtcttcagagccccactcaggtggctgactgttcttgggatgaaacaataaagatctatgaccctgcttgtcttactattcctgcttgagatacactactttggtcagaaacagaggatgttggctgaagaactgcctaacagcaaataaattaactatggaaaacatagacattatgcttttatatgctattcagatttcaaatctttccaatttaccctggaatcagttttgagggagctgataaagactttagctgactcgttaagcctgatacataagccatatttaaaattctaagaaataattaatgttatgatatatcttgtagtatctattaaaatgtctctgggtcataaaatggattaaaatatgggagatcagtaggttatacttatatagatagtgatatatttcatttttaatttgtcatttttgatgtaaaatataatcactgctgtg

SEQ ID NO: 21997 - DNA, 1853 bp, Homo sapiens
tccgcccgcccgcctcgaatgtccctgagacccagaagggcctgcgctcagctgctctggcaccccgctgcagggatggcctcctgggctaagggcaggagctacctggcgcctggtttgctgcagggccaagtggccatcgtcaccggcggggccacgggcatcggaaaagccatcgtgaaggagctcctggagctggggagtaatgtggtcattgcatcccgtaagttggagagattgaagtctgcggcagatgaactgcaggccaacctacctcccacaaagcaggcacgagtcattcccatacaatgcaacatccggaatgaggaggaggtgaataatttggtcaaatctaccttagatacttttggtaagatcaatttcttggtgaacaatggaggaggccagtttctttcccctgctgaacacatcagttctaagggatggcacgctgtgcttgagaccaacctgacgggtaccttctacatgtgcaaagcagtttacagctcctggatgaaagagcatggaggatctatcgtcaatatcattgtccctactaaagctggatttccattagctgtgcattctggagctgcaagagcaggtgtttacaacctcaccaaatctttagctttggaatgggcctgcagtggaatacggatcaattgtgttgcccctggagttatttattcccagactgctgtggagaactatggttcctggggacaaagcttctttgaagggtcttttcagaaaatccccgctaaacgaattggtgttcctgaggaggtctcctctgtggtctgcttcctactgtctcctgcagcttccttcatcactggacagtcggtggatgtggatgggggccggagtctctatactcactcgtatgaggtaccagatcatgacaactggcccaagggagcaggggacctttctgttgtcaaaaagatgaaggagacctttaaggagaaagctaagctctgagctgaggaaacaaggtgtcctccatcccccagtgccttcacatcttgaggatatgcttctgtactttttaaaagcttatagttggtatggaaaacatttttcttatttttaagtgttattaattatatctatggaaaaactattcctgaaatatatacagtcttatgtcccaatcagagtcttttaacctatgatttaaaaatgtataagtaacagaaattaacatattttaatgactttactttttatttctaagaaaagtatttgaaaaatggaataattttaaatcaatgataattctagggatcatgaactcccagaagattttattatttaattgtaaaggtagaggccagacgcagtggctcacgcctgtaattccagcactttgggaggccgaggtaggcgggtcagttgaggtcaggagttcaagaccaggctggccaacatggtaaaaccctgtctctactgaaaaacaacaaaaacaaaaacacaaattagtcgggtgtggtggcacacacctgtagtcccaggtacttgggaggctgaggcaggaggatcgcttgaacccaggaagcagaggttgcagtgagctgagatcatgctactgcagtccagcctgggctacagagtgagactgcatctcaaaaaaaacccaaaaaacaaaaacaaacaacaacaacaaaattataaaggtagaaaataaacctaaattgtgtcgtaattaagattattaaaattagaattatacaatgacttatttttggtggcaaatactttaggagcaataatgccttatggtaattattgatgtatagtttcttttgtttatgaagtcaaatttgtataaattctcttaattcaaa

SEQ ID NO: 21998 - DNA, 9965 bp, Homo sapiens
gcgccgcctccttcggcgttcgccccacggaccggcaggcggcggaccgcggcccaggctgaagctcagggccctgtctgctctgtggactcaacagtttgtggcaagacaagctcagaactgagaagctgtcaccacagtagcttggagctcggcggcacaaccagcaccatctggtcgcgatggtggacacggaaagcccactctgccccctctccccactcgaggccggcgatctagagagcccgttatctgaagagttcctgcaagaaatgggaaacatccaagagatttcgcaatccatcggcgaggatagttctggaagctttggctttacggaataccagtatttaggaagctgtcctggctcagatggctcggtcatcacggacacgctttcaccagcttcgagcccctcctcggtgacttatcctgtggtccccggcagcgtggacgagtctcccagtggagcattgaacatcgaatgtagaatctgcggggacaaggcctcaggctatcattacggagtccacgcgtgtgaaggctgcaagggcttctttcggcgaacgattcgactcaagctggtgtatgacaagtgcgaccgcagctgcaagatccagaaaaagaacagaaacaaatgccagtattgtcgatttcacaagtgcctttctgtcgggatgtcacacaacgcgattcgttttggacgaatgccaagatctgagaaagcaaaactgaaagcagaaattcttacctgtgaacatgacatagaagattctgaaactgcagatctcaaatctctggccaagagaatctacgaggcctacttgaagaacttcaacatgaacaaggtcaaagcccgggtcatcctctcaggaaaggccagtaacaatccaccttttgtcatacatgatatggagacactgtgtatggctgagaagacgctggtggccaagctggtggccaatggcatccagaacaaggaggcggaggtccgcatctttcactgctgccagtgcacgtcagtggagaccgtcacggagctcacggaattcgccaaggccatcccaggcttcgcaaacttggacctgaacgatcaagtgacattgctaaaatacggagtttatgaggccatattcgccatgctgtcttctgtgatgaacaaagacgggatgctggtagcgtatggaaatgggtttataactcgtgaattcctaaaaagcctaaggaaaccgttctgtgatatcatggaacccaagtttgattttgccatgaagttcaatgcactggaactggatgacagtgatatctccctttttgtggctgctatcatttgctgtggagatcgtcctggccttctaaacgtaggacacattgaaaaaatgcaggagggtattgtacatgtgctcagactccacctgcagagcaaccacccggacgatatctttctcttcccaaaacttcttcaaaaaatggcagacctccggcagctggtgacggagcatgcgcagctggtgcagatcatcaagaagacggagtcggatgctgcgctgcacccgctactgcaggagatctacagggacatgtactgagttccttcagatcagccacaccttttccaggagttctgaagctgacagcactacaaaggagacgggggagcagcacgattttgcacaaatatccaccactttaaccttagagcttggacagtctgagctgtaggtaaccggcatattattccatatctttgttttaaccagtacttctaagagcatagaactcaaatgctgggggtaggtggctaatctcaggactgggaagattacggcgaattatgctcaatggtctgattttaactcacccgatgttaatcaatgcacattgctttagatcacattcgtgatttaccatttaattaactggtaacctcaaaattcgtggcctgtcttcccattcaccccgcttttgactattgtgctcctttataattctgaaaactaatcagcactttttaacaatgtttataatcctataagtctagatgtatccaaaggtgaagtatgtaaaaagcagcaaaatatttatttcaaagacttcacttctgtttcctgaatctaaagaaagacaacatgctgctttttaatcataggatggagaattttaaagaactgtttgggccaggcacagtcgctcatacttgtaatcccagcactttgggaggccgaggcgggtggatcacaaggtcagcagatcgagaccatcctggccaacatggtgaaaccctgtctctactaaaaatacaaaaattagccgggtgtggtggcacatgcctgtaatcccagctactcgggaagctgaggcaggagaattgcttgaaccagggagttggaggttgcagtgagctaagactgcaccactgcactccagcctggtgacagaacgagactctgtcttaaaaacaaacaaacaaaaaaaaaatctgttagataagctatcaaaatgcagctgttgttttgtttttggctcactgttttcgtggttgtaactaatatgtggaaaggcccatttccaggtttgcgtagaagagcccagaaaacagagtctcaagacccccgctctggactgtcataagctagcacccgtggtaagcgggacgagacaagctcccgaagcccgccagcttcctgctccactcagctccgtccagtcaacctgaacccacccagtccagctgtctgtgggaatggtggtgttcttagggacagactgacaccttacttgtcagtgttcctccgggccccatttggcagctcccgtatcttttgttatgttgcttttaaagatatgatgttttattgttttaactcttggtgacagtagatgctctctggagcgcagacgaggcacatgtgtcttcatagcctgggctgggtgggagccagtcaccctgcggatcgagagagggggtagagtcttcttcaaatggcagttttacttcaaatggcagatttcacaagagttggttattttttacaatggtttaggttgttaagtctcctttgtatgtaaggtagttttttcaacatctaaaatttttgttttagccttcaaaaccaacttaccaacctcagtccagctgggaaggcagcgttgattatggtagtttgtcaagaatatatggacctggaaacactttctctctctgtccacctggtagataaattgtcctgttgagaatttttagatctggactggaactgccaggaccaccgcctccagggagtcgctgggcacctggaggtatcgtcgatgcctctcccccatctttagaaaatttggctcttctgaggtcattattattttaagaatgattaggattgataagggtcccatgaccagcattatgaaaatgcgagagtgggaaggacacagtgtgagacttccactagaaaaaagtgaaagttagggttaggacatccttttttaaaaattacaaatttagtccgttttggtttttgtaatcaggctaggcacagtggctcacacatggaatcccagcactttgggaggccgaggtgggaggatcacttgagcccaggagttcgagaccagcctaggcaacatagcaagaccctgtctgtacacaaaatttaaaaattagttcatcggggtggcacacatcagtagtcccagctactctgcaggctgaggtgggaggattgcttgaacccaggaggtcgaggctgcagtgagctgtgatctcaccactgcattccagcctgggtgacagagttagattccaccctctcccaccccggcaaaaaaaaaaaaaaaagatgcaatcaaaggggctgttggccagcaatggcagcagcagcggcgggcagtctgcccaagtgtcttaggaaccaaaagcaaataaaagtgtttccatatatgccaccagccaagtggccatcctaattcagaaagaagctagcctttgagtgtctgtcatggtgcatccgtttcagtattatttcctaaaatgagaagcccctgtgtcaacaagatccaggggctggagcccaatgccaagcctgtgttgtccccagcgaccctgcagctgctcgctctgatgtaccctgtgccattcaaggagatgtggtccaggaaagtgagcctcatggttttcagagaagtcattgttctgtttacattttcataaaacctgtttaaaatagctccccgtctcaggctttcagcagtaacagtgagctgactggcaagttcgatgttagctcccgggacactcagcagcgatggtgagcattttggtttccttaaggcccagcaagacttccagggacatctctggtgaagccagaatggagacacccgtgacctcaggctgaaagtcactcgacattggtctcttgtgttgatagggaaggaaatcaggcattcctatttctttaaataacaaaaccactaattgccactcaatgctggaatattttgggtcacctaatcatagatttctcagggcatcaatactcaaatataggctgattatgccccagttcaaatgggaactattaacagagtgcatttcttgcttgctgggtttcaacagacatcagccaaaagaacaaaagagatgtcaggacagattccaggagtgtcggagcacatgtgtggcacccgctccctctggcagcgaatgtaggaagtcgccaaatttacccactcttcaacaagtcattgtttaaacacggtttttcattttctcaacttttaatagcaaaaagtgccaaagtcctcagagacctaacagccttggtctaccgtgctgaccagggtgaaggcacggcgagggactcctcccagacgtgcctcttgtgtgccagctggctgtggctcgggagcagacgcaggcctctccattgtccaggggagcctggcggcgcatccctcctctcccacctcctggcacttccagctgggtgtcccacatgttggattccgtccccaccacacttccagagaccggagaactgtgcagggcctaaggccgtttggatgaattgtcaaaacaagatgcttccagttacagcggcaggagcgggactgggagcacgggctgacggctgctggtgcctttcttcccacctcgcttgcctgtttccgcttgacccttcctccagctccgatgagaagagtataaagcatcttcctaacgggtgtgtttgctatacgaacataatggacgtgaagtggggcagaaacccagaactcagcattcaaggatgcccaggagagctgtccctgttttaaagagctgtgttttgttttgtttcgcatttagagagcagacaaggcacccttctgctgcgctgatacgtttcttacactgggccattttagacccccagggaaacagccttcctggagcgttgtctggaggttccagggacagggcagcctcccagagccgagcaagagctcaaggtacaaatgagagatttgctataccgtgagaagtcaacaacttagccaccacttccccgcaatggaccatgtaacaaatacctcagcaggccctgcaaaaggccatgctagagctgaggcgcacagcctgtggcctctgtagttagggcaggtgggatggagactccttgagtgcacacacctgagcctgcccacacacaggggagcagcatctcgtatgacgtctggaaggaacttcggttgtgtaaagggagccttgaagatacgtgcaaaaggtgctaccccaatttggtgaaactgacattgggcacgtcttgggcttaggagaagcggccgatggtcccggcctgcagtgacaaacccccctccccgcaccgcccccagcaccccctctcctcttcacctcttcctgctggccacgaggaagccacttcctcagagagaccctaccagatgcggatggaaacagatgcaccaaagcaagccctgatgaaaccgcgacttcctaaggtctgtctcctctgaacttgcacctgggcctctctgtgtttggttccaagcacttcccacctcaaactcccattttcaaaccactgtatctctgcgcacatctgctacttaccagccgcatacatgatggagggttttttggtcctgatccagtggccacacctgtctttgaaatgtctcactgaactccagttttaaaatagattcattgcttcaacacagcaagcccaatgcacccagctaagactggcttgaccgacagcctggcctttggtggggggcttcctggggcctggggaaagctggccaccttcaacagctggtacctcttcaacagtgtggcctttcaaaatgcagatgccaccaggagaacatgcccacagctcaccacctatggatgccatggctctgggcagctttcaaagcaggttcctgtggtctcctcagctgtttgagggggtaacagcaaatcagcctccattttaaaatgaaaacaccagcctccagatgtagggcctgctgggtgttgctagccgctggtccccaggcacggtgcactttctccacctcctgcagcctccctgttgtttctagactcttgcacctggtgagtgcaaggataggtgacccaggggcctgcagccttgtcctcagctcccatctcctggactgccagcctcaccctctgcagttagcatggttggcctgatgcagggatcccgagggattactttttagaccttctttcacattcagaaaagtagtatagattcaggagaggcaagaaaattatgctgtccatagaagtcacccatgaagactgatgccaccacctgaaggctcatgattgttaaaaatgtccacgggaacctctcgtccacaggaggtttgtctcaacacttcccatttttacggcattggcattgccaagcatggggaagtatctgctcttctcatgttaaaagtggcccagcttttcttaactcagtccaagctgacttgtttagctgcactggaatttcttaccaaccaaatatttgcatcgagcaaagggggctgtgtgcacctccctaatggcagcgatgatggctgctgtcattcaagcccatcttcagacgtcacagtctggaagtgaaatgtccacaaacatctgtggcagaaaaggctatacggaccacccagttgtgctgcagctttacagagcaaggaagggttgtggcaaataaatgattaacctgcctcgactgtgctgagggcaacaaaggccatctcaccaaaggattattcgatgccattaaatcatcccgtgaccttcctgcttccgagtccatggcctttgcccagggcatgtactcccctgagaggccttctgcctagaaagatctatgactgggttccaaagttgaggcctaggtttttgctgggatttagatattttcaggcaccattttgacagcattcaggaaaacggttattgaccccatagactagggtaagaataaaggcaataaatttggtctgactcagaatataggagatccatatatttctctggaaaccacagtgtacactaaaatgtgaaattgaaggttttgttaaaaagaaaaagataatgagcttcatgctttgtttaattacataatgatttccattacgctatttctgtgaaatgcagcaggttcttaaacgttatttcagtggcatgggctggaagcttatcacaaaaagccatgtgtgtggccttatcagaacagaaagagacaggctggtgcccaaggctgctgcctgctccaccttttgccagctctggacatctgaggacgtcccggcagatctggaatggggccctcaactgaccatttgcttctcagaatttcagtttgagacatgagaggtataatcagttacttttctccccccagagaaacccttttgtgaggggagaggagctatggtatgtggttcagctgaaacacatacaactgcatccttttggagtcctttgccaacaaaaacagaccaacagaccagatggtgtccatgttcaatatcatgtcttgatggacgcagctgatgacctcaaatacttgagtggtctcatggctgttagatggattatttgaaaaaaaaaaaaaaaaaagagagaaaaaataattgatttttacatcagagatagcaaactaagacctggggaggggggtcagcttttattttattttattttttttaagtttgctagttgggtcaaatgtgaggaggagggagtctacctgccacctcttctcttgcccctcttctgcccacacatccagcatccaaaatccattcatttaatgaattgataaagtgccgtgcaaactggtgcacaaacaggcccccagtccacgcagcctggctcctaggaaaagtggtgaccgggcgtgggggggcatgccgcagccctgggacacagtcgggcaccttccccggacccccaggccttggctgtgcctcaagtcagagagggtcagccttcaggccccggagacgagtgactggccgatcatttcacaataaaatcactcacttttggcaacttcactttttttaaggcacagtcagttccttttctcatgtacctcacaaaagatgaagaccatgtagtactctttttggtaaagttacagtgttcatgttaaatatcacttttttctacattgtgtggtaaaaagaactacgttaatagctatatcttaaatactgtgatttgactttttgaaaaatatcctaatacaaatattttactaacttacaatcactcatttaataagaaacatttggattcttttgaaatcagtgttaattgactcatattcttaaaagcctggctcttgaccctattggaaacacaaaggaagctgaaatcaaacatctaaaatacactgcgtacacgtgtgcgtgcacacacacacacacacacacacacacacagctcttcatttctcctgagccatgcagaatttactttcaatgtggaaatctgttccctttaccacactgtatatgcacagagcacaagagaggctatctctagtcacttccaccagcgaggccttagactccgtattagaggccaccgatttcatacaacagtgtttcgctaaagacccttcactattcttgtttagtaaatagctgtctgctcttcagggaactgttacctatgggttattaccaaagaacgctggcaattggaaatgtcctgatggaaattctttgcacgtgccggttctctggcatcctccaggtggcccaacccaaagcagaaagcagaaaccacagaccccgtgagtctccccataccttgtttccaataacttggcaaaacttcttggtgcatattggttacaccctctgggattcataatgccattaggctaaaaccctaagagagagggttgacagaaacacacgcgagaatgaggcagatcccagagcaaggactgggcccagactctccacatgtgctctactagtgagtgccttatactctcagtattttggggcttacagcttcttatttgtgctaaaaaggtgcagttccaaagtaggaactgccacacaggccccagcatcctctctccaacttcatacctctctcctggtggggggagcgggcatccaggacctccggaatcaaggatgtgcagagaagagcgaaagtaatttttctagtcacatgaactgattggttccaggcaattagaaaatggctataaaataaccttaattttaaaaaaaaatcttgggtcttcgttttcctattaggagactgaactgaccacatgtattgatttatatcctgaatatatgggaacttctgtgtttgggatgtcctactgtaagactgatgaatgtacagagttaatttcagggtacagttttgccttaatggttttaaaaaataaactattttttaaaatttt

SEQ ID NO: 21999 - DNA, 10048 bp, Homo sapiens
gcgccgcctccttcggcgttcgccccacggaccggcaggcggcggaccgcggcccaggctgaagctcagggccctgtctgctctgtggactcaacagtttgtggcaagacaagctcagaactgagaagctgtcaccacaggtaaatagaaggtttaatttactgtttccagatggaaatatttaagtgttttcagtgtttacttctgttgcactacagaccagtagcttggagctcggcggcacaaccagcaccatctggtcgcgatggtggacacggaaagcccactctgccccctctccccactcgaggccggcgatctagagagcccgttatctgaagagttcctgcaagaaatgggaaacatccaagagatttcgcaatccatcggcgaggatagttctggaagctttggctttacggaataccagtatttaggaagctgtcctggctcagatggctcggtcatcacggacacgctttcaccagcttcgagcccctcctcggtgacttatcctgtggtccccggcagcgtggacgagtctcccagtggagcattgaacatcgaatgtagaatctgcggggacaaggcctcaggctatcattacggagtccacgcgtgtgaaggctgcaagggcttctttcggcgaacgattcgactcaagctggtgtatgacaagtgcgaccgcagctgcaagatccagaaaaagaacagaaacaaatgccagtattgtcgatttcacaagtgcctttctgtcgggatgtcacacaacgcgattcgttttggacgaatgccaagatctgagaaagcaaaactgaaagcagaaattcttacctgtgaacatgacatagaagattctgaaactgcagatctcaaatctctggccaagagaatctacgaggcctacttgaagaacttcaacatgaacaaggtcaaagcccgggtcatcctctcaggaaaggccagtaacaatccaccttttgtcatacatgatatggagacactgtgtatggctgagaagacgctggtggccaagctggtggccaatggcatccagaacaaggaggcggaggtccgcatctttcactgctgccagtgcacgtcagtggagaccgtcacggagctcacggaattcgccaaggccatcccaggcttcgcaaacttggacctgaacgatcaagtgacattgctaaaatacggagtttatgaggccatattcgccatgctgtcttctgtgatgaacaaagacgggatgctggtagcgtatggaaatgggtttataactcgtgaattcctaaaaagcctaaggaaaccgttctgtgatatcatggaacccaagtttgattttgccatgaagttcaatgcactggaactggatgacagtgatatctccctttttgtggctgctatcatttgctgtggagatcgtcctggccttctaaacgtaggacacattgaaaaaatgcaggagggtattgtacatgtgctcagactccacctgcagagcaaccacccggacgatatctttctcttcccaaaacttcttcaaaaaatggcagacctccggcagctggtgacggagcatgcgcagctggtgcagatcatcaagaagacggagtcggatgctgcgctgcacccgctactgcaggagatctacagggacatgtactgagttccttcagatcagccacaccttttccaggagttctgaagctgacagcactacaaaggagacgggggagcagcacgattttgcacaaatatccaccactttaaccttagagcttggacagtctgagctgtaggtaaccggcatattattccatatctttgttttaaccagtacttctaagagcatagaactcaaatgctgggggtaggtggctaatctcaggactgggaagattacggcgaattatgctcaatggtctgattttaactcacccgatgttaatcaatgcacattgctttagatcacattcgtgatttaccatttaattaactggtaacctcaaaattcgtggcctgtcttcccattcaccccgcttttgactattgtgctcctttataattctgaaaactaatcagcactttttaacaatgtttataatcctataagtctagatgtatccaaaggtgaagtatgtaaaaagcagcaaaatatttatttcaaagacttcacttctgtttcctgaatctaaagaaagacaacatgctgctttttaatcataggatggagaattttaaagaactgtttgggccaggcacagtcgctcatacttgtaatcccagcactttgggaggccgaggcgggtggatcacaaggtcagcagatcgagaccatcctggccaacatggtgaaaccctgtctctactaaaaatacaaaaattagccgggtgtggtggcacatgcctgtaatcccagctactcgggaagctgaggcaggagaattgcttgaaccagggagttggaggttgcagtgagctaagactgcaccactgcactccagcctggtgacagaacgagactctgtcttaaaaacaaacaaacaaaaaaaaaatctgttagataagctatcaaaatgcagctgttgttttgtttttggctcactgttttcgtggttgtaactaatatgtggaaaggcccatttccaggtttgcgtagaagagcccagaaaacagagtctcaagacccccgctctggactgtcataagctagcacccgtggtaagcgggacgagacaagctcccgaagcccgccagcttcctgctccactcagctccgtccagtcaacctgaacccacccagtccagctgtctgtgggaatggtggtgttcttagggacagactgacaccttacttgtcagtgttcctccgggccccatttggcagctcccgtatcttttgttatgttgcttttaaagatatgatgttttattgttttaactcttggtgacagtagatgctctctggagcgcagacgaggcacatgtgtcttcatagcctgggctgggtgggagccagtcaccctgcggatcgagagagggggtagagtcttcttcaaatggcagttttacttcaaatggcagatttcacaagagttggttattttttacaatggtttaggttgttaagtctcctttgtatgtaaggtagttttttcaacatctaaaatttttgttttagccttcaaaaccaacttaccaacctcagtccagctgggaaggcagcgttgattatggtagtttgtcaagaatatatggacctggaaacactttctctctctgtccacctggtagataaattgtcctgttgagaatttttagatctggactggaactgccaggaccaccgcctccagggagtcgctgggcacctggaggtatcgtcgatgcctctcccccatctttagaaaatttggctcttctgaggtcattattattttaagaatgattaggattgataagggtcccatgaccagcattatgaaaatgcgagagtgggaaggacacagtgtgagacttccactagaaaaaagtgaaagttagggttaggacatccttttttaaaaattacaaatttagtccgttttggtttttgtaatcaggctaggcacagtggctcacacatggaatcccagcactttgggaggccgaggtgggaggatcacttgagcccaggagttcgagaccagcctaggcaacatagcaagaccctgtctgtacacaaaatttaaaaattagttcatcggggtggcacacatcagtagtcccagctactctgcaggctgaggtgggaggattgcttgaacccaggaggtcgaggctgcagtgagctgtgatctcaccactgcattccagcctgggtgacagagttagattccaccctctcccaccccggcaaaaaaaaaaaaaaaagatgcaatcaaaggggctgttggccagcaatggcagcagcagcggcgggcagtctgcccaagtgtcttaggaaccaaaagcaaataaaagtgtttccatatatgccaccagccaagtggccatcctaattcagaaagaagctagcctttgagtgtctgtcatggtgcatccgtttcagtattatttcctaaaatgagaagcccctgtgtcaacaagatccaggggctggagcccaatgccaagcctgtgttgtccccagcgaccctgcagctgctcgctctgatgtaccctgtgccattcaaggagatgtggtccaggaaagtgagcctcatggttttcagagaagtcattgttctgtttacattttcataaaacctgtttaaaatagctccccgtctcaggctttcagcagtaacagtgagctgactggcaagttcgatgttagctcccgggacactcagcagcgatggtgagcattttggtttccttaaggcccagcaagacttccagggacatctctggtgaagccagaatggagacacccgtgacctcaggctgaaagtcactcgacattggtctcttgtgttgatagggaaggaaatcaggcattcctatttctttaaataacaaaaccactaattgccactcaatgctggaatattttgggtcacctaatcatagatttctcagggcatcaatactcaaatataggctgattatgccccagttcaaatgggaactattaacagagtgcatttcttgcttgctgggtttcaacagacatcagccaaaagaacaaaagagatgtcaggacagattccaggagtgtcggagcacatgtgtggcacccgctccctctggcagcgaatgtaggaagtcgccaaatttacccactcttcaacaagtcattgtttaaacacggtttttcattttctcaacttttaatagcaaaaagtgccaaagtcctcagagacctaacagccttggtctaccgtgctgaccagggtgaaggcacggcgagggactcctcccagacgtgcctcttgtgtgccagctggctgtggctcgggagcagacgcaggcctctccattgtccaggggagcctggcggcgcatccctcctctcccacctcctggcacttccagctgggtgtcccacatgttggattccgtccccaccacacttccagagaccggagaactgtgcagggcctaaggccgtttggatgaattgtcaaaacaagatgcttccagttacagcggcaggagcgggactgggagcacgggctgacggctgctggtgcctttcttcccacctcgcttgcctgtttccgcttgacccttcctccagctccgatgagaagagtataaagcatcttcctaacgggtgtgtttgctatacgaacataatggacgtgaagtggggcagaaacccagaactcagcattcaaggatgcccaggagagctgtccctgttttaaagagctgtgttttgttttgtttcgcatttagagagcagacaaggcacccttctgctgcgctgatacgtttcttacactgggccattttagacccccagggaaacagccttcctggagcgttgtctggaggttccagggacagggcagcctcccagagccgagcaagagctcaaggtacaaatgagagatttgctataccgtgagaagtcaacaacttagccaccacttccccgcaatggaccatgtaacaaatacctcagcaggccctgcaaaaggccatgctagagctgaggcgcacagcctgtggcctctgtagttagggcaggtgggatggagactccttgagtgcacacacctgagcctgcccacacacaggggagcagcatctcgtatgacgtctggaaggaacttcggttgtgtaaagggagccttgaagatacgtgcaaaaggtgctaccccaatttggtgaaactgacattgggcacgtcttgggcttaggagaagcggccgatggtcccggcctgcagtgacaaacccccctccccgcaccgcccccagcaccccctctcctcttcacctcttcctgctggccacgaggaagccacttcctcagagagaccctaccagatgcggatggaaacagatgcaccaaagcaagccctgatgaaaccgcgacttcctaaggtctgtctcctctgaacttgcacctgggcctctctgtgtttggttccaagcacttcccacctcaaactcccattttcaaaccactgtatctctgcgcacatctgctacttaccagccgcatacatgatggagggttttttggtcctgatccagtggccacacctgtctttgaaatgtctcactgaactccagttttaaaatagattcattgcttcaacacagcaagcccaatgcacccagctaagactggcttgaccgacagcctggcctttggtggggggcttcctggggcctggggaaagctggccaccttcaacagctggtacctcttcaacagtgtggcctttcaaaatgcagatgccaccaggagaacatgcccacagctcaccacctatggatgccatggctctgggcagctttcaaagcaggttcctgtggtctcctcagctgtttgagggggtaacagcaaatcagcctccattttaaaatgaaaacaccagcctccagatgtagggcctgctgggtgttgctagccgctggtccccaggcacggtgcactttctccacctcctgcagcctccctgttgtttctagactcttgcacctggtgagtgcaaggataggtgacccaggggcctgcagccttgtcctcagctcccatctcctggactgccagcctcaccctctgcagttagcatggttggcctgatgcagggatcccgagggattactttttagaccttctttcacattcagaaaagtagtatagattcaggagaggcaagaaaattatgctgtccatagaagtcacccatgaagactgatgccaccacctgaaggctcatgattgttaaaaatgtccacgggaacctctcgtccacaggaggtttgtctcaacacttcccatttttacggcattggcattgccaagcatggggaagtatctgctcttctcatgttaaaagtggcccagcttttcttaactcagtccaagctgacttgtttagctgcactggaatttcttaccaaccaaatatttgcatcgagcaaagggggctgtgtgcacctccctaatggcagcgatgatggctgctgtcattcaagcccatcttcagacgtcacagtctggaagtgaaatgtccacaaacatctgtggcagaaaaggctatacggaccacccagttgtgctgcagctttacagagcaaggaagggttgtggcaaataaatgattaacctgcctcgactgtgctgagggcaacaaaggccatctcaccaaaggattattcgatgccattaaatcatcccgtgaccttcctgcttccgagtccatggcctttgcccagggcatgtactcccctgagaggccttctgcctagaaagatctatgactgggttccaaagttgaggcctaggtttttgctgggatttagatattttcaggcaccattttgacagcattcaggaaaacggttattgaccccatagactagggtaagaataaaggcaataaatttggtctgactcagaatataggagatccatatatttctctggaaaccacagtgtacactaaaatgtgaaattgaaggttttgttaaaaagaaaaagataatgagcttcatgctttgtttaattacataatgatttccattacgctatttctgtgaaatgcagcaggttcttaaacgttatttcagtggcatgggctggaagcttatcacaaaaagccatgtgtgtggccttatcagaacagaaagagacaggctggtgcccaaggctgctgcctgctccaccttttgccagctctggacatctgaggacgtcccggcagatctggaatggggccctcaactgaccatttgcttctcagaatttcagtttgagacatgagaggtataatcagttacttttctccccccagagaaacccttttgtgaggggagaggagctatggtatgtggttcagctgaaacacatacaactgcatccttttggagtcctttgccaacaaaaacagaccaacagaccagatggtgtccatgttcaatatcatgtcttgatggacgcagctgatgacctcaaatacttgagtggtctcatggctgttagatggattatttgaaaaaaaaaaaaaaaaaagagagaaaaaataattgatttttacatcagagatagcaaactaagacctggggaggggggtcagcttttattttattttattttttttaagtttgctagttgggtcaaatgtgaggaggagggagtctacctgccacctcttctcttgcccctcttctgcccacacatccagcatccaaaatccattcatttaatgaattgataaagtgccgtgcaaactggtgcacaaacaggcccccagtccacgcagcctggctcctaggaaaagtggtgaccgggcgtgggggggcatgccgcagccctgggacacagtcgggcaccttccccggacccccaggccttggctgtgcctcaagtcagagagggtcagccttcaggccccggagacgagtgactggccgatcatttcacaataaaatcactcacttttggcaacttcactttttttaaggcacagtcagttccttttctcatgtacctcacaaaagatgaagaccatgtagtactctttttggtaaagttacagtgttcatgttaaatatcacttttttctacattgtgtggtaaaaagaactacgttaatagctatatcttaaatactgtgatttgactttttgaaaaatatcctaatacaaatattttactaacttacaatcactcatttaataagaaacatttggattcttttgaaatcagtgttaattgactcatattcttaaaagcctggctcttgaccctattggaaacacaaaggaagctgaaatcaaacatctaaaatacactgcgtacacgtgtgcgtgcacacacacacacacacacacacacacacagctcttcatttctcctgagccatgcagaatttactttcaatgtggaaatctgttccctttaccacactgtatatgcacagagcacaagagaggctatctctagtcacttccaccagcgaggccttagactccgtattagaggccaccgatttcatacaacagtgtttcgctaaagacccttcactattcttgtttagtaaatagctgtctgctcttcagggaactgttacctatgggttattaccaaagaacgctggcaattggaaatgtcctgatggaaattctttgcacgtgccggttctctggcatcctccaggtggcccaacccaaagcagaaagcagaaaccacagaccccgtgagtctccccataccttgtttccaataacttggcaaaacttcttggtgcatattggttacaccctctgggattcataatgccattaggctaaaaccctaagagagagggttgacagaaacacacgcgagaatgaggcagatcccagagcaaggactgggcccagactctccacatgtgctctactagtgagtgccttatactctcagtattttggggcttacagcttcttatttgtgctaaaaaggtgcagttccaaagtaggaactgccacacaggccccagcatcctctctccaacttcatacctctctcctggtggggggagcgggcatccaggacctccggaatcaaggatgtgcagagaagagcgaaagtaatttttctagtcacatgaactgattggttccaggcaattagaaaatggctataaaataaccttaattttaaaaaaaaatcttgggtcttcgttttcctattaggagactgaactgaccacatgtattgatttatatcctgaatatatgggaacttctgtgtttgggatgtcctactgtaagactgatgaatgtacagagttaatttcagggtacagttttgccttaatggttttaaaaaataaactattttttaaaatttt

SEQ ID NO: 22000 - DNA, 1558 bp, Homo sapiens
cacagttctggaggctgggaagttcaagatcaaagtgccagcagattcagtgtcatgtgaggacgtgcttcctgcttcatagataagagcttggagctcggcggcacaaccagcaccatctggtcgcgatggtggacacggaaagcccactctgccccctctccccactcgaggccggcgatctagagagcccgttatctgaagagttcctgcaagaaatgggaaacatccaagagatttcgcaatccatcggcgaggatagttctggaagctttggctttacggaataccagtatttaggaagctgtcctggctcagatggctcggtcatcacggacacgctttcaccagcttcgagcccctcctcggtgacttatcctgtggtccccggcagcgtggacgagtctcccagtggagcattgaacatcgaatgtagaatctgcggggacaaggcctcaggctatcattacggagtccacgcgtgtgaaggctgcaagggcttctttcggcgaacgattcgactcaagctggtgtatgacaagtgcgaccgcagctgcaagatccagaaaaagaacagaaacaaatgccagtattgtcgatttcacaagtgcctttctgtcgggatgtcacacaacgcgattcgttttggacgaatgccaagatctgagaaagcaaaactgaaagcagaaattcttacctgtgaacatgacatagaagattctgaaactgcagatctcaaatctctggccaagagaatctacgaggcctacttgaagaacttcaacatgaacaaggtcaaagcccgggtcatcctctcaggaaaggccagtaacaatccaccttttgtcatacatgatatggagacactgtgtatggctgagaagacgctggtggccaagctggtggccaatggcatccagaacaaggaggcggaggtccgcatctttcactgctgccagtgcacgtcagtggagaccgtcacggagctcacggaattcgccaaggccatcccaggcttcgcaaacttggacctgaacgatcaagtgacattgctaaaatacggagtttatgaggccatattcgccatgctgtcttctgtgatgaacaaagacgggatgctggtagcgtatggaaatgggtttataactcgtgaattcctaaaaagcctaaggaaaccgttctgtgatatcatggaacccaagtttgattttgccatgaagttcaatgcactggaactggatgacagtgatatctccctttttgtggctgctatcatttgctgtggagatcgtcctggccttctaaacgtaggacacattgaaaaaatgcaggagggtattgtacatgtgctcagactccacctgcagagcaaccacccggacgatatctttctcttcccaaaacttcttcaaaaaatggcagacctccggcagctggtgacggagcatgcgcagctggtgcagatcatcaagaagacggagtcggatgctgcgctgcacccgctactgcaggagatctacagggacatgtactgagttccttcagatcagccacacct

SEQ ID NO: 22001 - DNA, 9995 bp, Homo sapiens
ccaggctgaagctcagggccctgtctgctctgtggactcaacagtttgtggcaagacaagctcagaactgagaagctgtcaccacagttctggaggctgggaagttcaagatcaaagtgccagcagattcagtgtcatgtgaggacgtgcttcctgcttcatagataagagtagcttggagctcggcggcacaaccagcaccatctggtcgcgatggtggacacggaaagcccactctgccccctctccccactcgaggccggcgatctagagagcccgttatctgaagagttcctgcaagaaatgggaaacatccaagagatttcgcaatccatcggcgaggatagttctggaagctttggctttacggaataccagtatttaggaagctgtcctggctcagatggctcggtcatcacggacacgctttcaccagcttcgagcccctcctcggtgacttatcctgtggtccccggcagcgtggacgagtctcccagtggagcattgaacatcgaatgtagaatctgcggggacaaggcctcaggctatcattacggagtccacgcgtgtgaaggctgcaagggcttctttcggcgaacgattcgactcaagctggtgtatgacaagtgcgaccgcagctgcaagatccagaaaaagaacagaaacaaatgccagtattgtcgatttcacaagtgcctttctgtcgggatgtcacacaacgcgattcgttttggacgaatgccaagatctgagaaagcaaaactgaaagcagaaattcttacctgtgaacatgacatagaagattctgaaactgcagatctcaaatctctggccaagagaatctacgaggcctacttgaagaacttcaacatgaacaaggtcaaagcccgggtcatcctctcaggaaaggccagtaacaatccaccttttgtcatacatgatatggagacactgtgtatggctgagaagacgctggtggccaagctggtggccaatggcatccagaacaaggaggcggaggtccgcatctttcactgctgccagtgcacgtcagtggagaccgtcacggagctcacggaattcgccaaggccatcccaggcttcgcaaacttggacctgaacgatcaagtgacattgctaaaatacggagtttatgaggccatattcgccatgctgtcttctgtgatgaacaaagacgggatgctggtagcgtatggaaatgggtttataactcgtgaattcctaaaaagcctaaggaaaccgttctgtgatatcatggaacccaagtttgattttgccatgaagttcaatgcactggaactggatgacagtgatatctccctttttgtggctgctatcatttgctgtggagatcgtcctggccttctaaacgtaggacacattgaaaaaatgcaggagggtattgtacatgtgctcagactccacctgcagagcaaccacccggacgatatctttctcttcccaaaacttcttcaaaaaatggcagacctccggcagctggtgacggagcatgcgcagctggtgcagatcatcaagaagacggagtcggatgctgcgctgcacccgctactgcaggagatctacagggacatgtactgagttccttcagatcagccacaccttttccaggagttctgaagctgacagcactacaaaggagacgggggagcagcacgattttgcacaaatatccaccactttaaccttagagcttggacagtctgagctgtaggtaaccggcatattattccatatctttgttttaaccagtacttctaagagcatagaactcaaatgctgggggtaggtggctaatctcaggactgggaagattacggcgaattatgctcaatggtctgattttaactcacccgatgttaatcaatgcacattgctttagatcacattcgtgatttaccatttaattaactggtaacctcaaaattcgtggcctgtcttcccattcaccccgcttttgactattgtgctcctttataattctgaaaactaatcagcactttttaacaatgtttataatcctataagtctagatgtatccaaaggtgaagtatgtaaaaagcagcaaaatatttatttcaaagacttcacttctgtttcctgaatctaaagaaagacaacatgctgctttttaatcataggatggagaattttaaagaactgtttgggccaggcacagtcgctcatacttgtaatcccagcactttgggaggccgaggcgggtggatcacaaggtcagcagatcgagaccatcctggccaacatggtgaaaccctgtctctactaaaaatacaaaaattagccgggtgtggtggcacatgcctgtaatcccagctactcgggaagctgaggcaggagaattgcttgaaccagggagttggaggttgcagtgagctaagactgcaccactgcactccagcctggtgacagaacgagactctgtcttaaaaacaaacaaacaaaaaaaaaatctgttagataagctatcaaaatgcagctgttgttttgtttttggctcactgttttcgtggttgtaactaatatgtggaaaggcccatttccaggtttgcgtagaagagcccagaaaacagagtctcaagacccccgctctggactgtcataagctagcacccgtggtaagcgggacgagacaagctcccgaagcccgccagcttcctgctccactcagctccgtccagtcaacctgaacccacccagtccagctgtctgtgggaatggtggtgttcttagggacagactgacaccttacttgtcagtgttcctccgggccccatttggcagctcccgtatcttttgttatgttgcttttaaagatatgatgttttattgttttaactcttggtgacagtagatgctctctggagcgcagacgaggcacatgtgtcttcatagcctgggctgggtgggagccagtcaccctgcggatcgagagagggggtagagtcttcttcaaatggcagttttacttcaaatggcagatttcacaagagttggttattttttacaatggtttaggttgttaagtctcctttgtatgtaaggtagttttttcaacatctaaaatttttgttttagccttcaaaaccaacttaccaacctcagtccagctgggaaggcagcgttgattatggtagtttgtcaagaatatatggacctggaaacactttctctctctgtccacctggtagataaattgtcctgttgagaatttttagatctggactggaactgccaggaccaccgcctccagggagtcgctgggcacctggaggtatcgtcgatgcctctcccccatctttagaaaatttggctcttctgaggtcattattattttaagaatgattaggattgataagggtcccatgaccagcattatgaaaatgcgagagtgggaaggacacagtgtgagacttccactagaaaaaagtgaaagttagggttaggacatccttttttaaaaattacaaatttagtccgttttggtttttgtaatcaggctaggcacagtggctcacacatggaatcccagcactttgggaggccgaggtgggaggatcacttgagcccaggagttcgagaccagcctaggcaacatagcaagaccctgtctgtacacaaaatttaaaaattagttcatcggggtggcacacatcagtagtcccagctactctgcaggctgaggtgggaggattgcttgaacccaggaggtcgaggctgcagtgagctgtgatctcaccactgcattccagcctgggtgacagagttagattccaccctctcccaccccggcaaaaaaaaaaaaaaaagatgcaatcaaaggggctgttggccagcaatggcagcagcagcggcgggcagtctgcccaagtgtcttaggaaccaaaagcaaataaaagtgtttccatatatgccaccagccaagtggccatcctaattcagaaagaagctagcctttgagtgtctgtcatggtgcatccgtttcagtattatttcctaaaatgagaagcccctgtgtcaacaagatccaggggctggagcccaatgccaagcctgtgttgtccccagcgaccctgcagctgctcgctctgatgtaccctgtgccattcaaggagatgtggtccaggaaagtgagcctcatggttttcagagaagtcattgttctgtttacattttcataaaacctgtttaaaatagctccccgtctcaggctttcagcagtaacagtgagctgactggcaagttcgatgttagctcccgggacactcagcagcgatggtgagcattttggtttccttaaggcccagcaagacttccagggacatctctggtgaagccagaatggagacacccgtgacctcaggctgaaagtcactcgacattggtctcttgtgttgatagggaaggaaatcaggcattcctatttctttaaataacaaaaccactaattgccactcaatgctggaatattttgggtcacctaatcatagatttctcagggcatcaatactcaaatataggctgattatgccccagttcaaatgggaactattaacagagtgcatttcttgcttgctgggtttcaacagacatcagccaaaagaacaaaagagatgtcaggacagattccaggagtgtcggagcacatgtgtggcacccgctccctctggcagcgaatgtaggaagtcgccaaatttacccactcttcaacaagtcattgtttaaacacggtttttcattttctcaacttttaatagcaaaaagtgccaaagtcctcagagacctaacagccttggtctaccgtgctgaccagggtgaaggcacggcgagggactcctcccagacgtgcctcttgtgtgccagctggctgtggctcgggagcagacgcaggcctctccattgtccaggggagcctggcggcgcatccctcctctcccacctcctggcacttccagctgggtgtcccacatgttggattccgtccccaccacacttccagagaccggagaactgtgcagggcctaaggccgtttggatgaattgtcaaaacaagatgcttccagttacagcggcaggagcgggactgggagcacgggctgacggctgctggtgcctttcttcccacctcgcttgcctgtttccgcttgacccttcctccagctccgatgagaagagtataaagcatcttcctaacgggtgtgtttgctatacgaacataatggacgtgaagtggggcagaaacccagaactcagcattcaaggatgcccaggagagctgtccctgttttaaagagctgtgttttgttttgtttcgcatttagagagcagacaaggcacccttctgctgcgctgatacgtttcttacactgggccattttagacccccagggaaacagccttcctggagcgttgtctggaggttccagggacagggcagcctcccagagccgagcaagagctcaaggtacaaatgagagatttgctataccgtgagaagtcaacaacttagccaccacttccccgcaatggaccatgtaacaaatacctcagcaggccctgcaaaaggccatgctagagctgaggcgcacagcctgtggcctctgtagttagggcaggtgggatggagactccttgagtgcacacacctgagcctgcccacacacaggggagcagcatctcgtatgacgtctggaaggaacttcggttgtgtaaagggagccttgaagatacgtgcaaaaggtgctaccccaatttggtgaaactgacattgggcacgtcttgggcttaggagaagcggccgatggtcccggcctgcagtgacaaacccccctccccgcaccgcccccagcaccccctctcctcttcacctcttcctgctggccacgaggaagccacttcctcagagagaccctaccagatgcggatggaaacagatgcaccaaagcaagccctgatgaaaccgcgacttcctaaggtctgtctcctctgaacttgcacctgggcctctctgtgtttggttccaagcacttcccacctcaaactcccattttcaaaccactgtatctctgcgcacatctgctacttaccagccgcatacatgatggagggttttttggtcctgatccagtggccacacctgtctttgaaatgtctcactgaactccagttttaaaatagattcattgcttcaacacagcaagcccaatgcacccagctaagactggcttgaccgacagcctggcctttggtggggggcttcctggggcctggggaaagctggccaccttcaacagctggtacctcttcaacagtgtggcctttcaaaatgcagatgccaccaggagaacatgcccacagctcaccacctatggatgccatggctctgggcagctttcaaagcaggttcctgtggtctcctcagctgtttgagggggtaacagcaaatcagcctccattttaaaatgaaaacaccagcctccagatgtagggcctgctgggtgttgctagccgctggtccccaggcacggtgcactttctccacctcctgcagcctccctgttgtttctagactcttgcacctggtgagtgcaaggataggtgacccaggggcctgcagccttgtcctcagctcccatctcctggactgccagcctcaccctctgcagttagcatggttggcctgatgcagggatcccgagggattactttttagaccttctttcacattcagaaaagtagtatagattcaggagaggcaagaaaattatgctgtccatagaagtcacccatgaagactgatgccaccacctgaaggctcatgattgttaaaaatgtccacgggaacctctcgtccacaggaggtttgtctcaacacttcccatttttacggcattggcattgccaagcatggggaagtatctgctcttctcatgttaaaagtggcccagcttttcttaactcagtccaagctgacttgtttagctgcactggaatttcttaccaaccaaatatttgcatcgagcaaagggggctgtgtgcacctccctaatggcagcgatgatggctgctgtcattcaagcccatcttcagacgtcacagtctggaagtgaaatgtccacaaacatctgtggcagaaaaggctatacggaccacccagttgtgctgcagctttacagagcaaggaagggttgtggcaaataaatgattaacctgcctcgactgtgctgagggcaacaaaggccatctcaccaaaggattattcgatgccattaaatcatcccgtgaccttcctgcttccgagtccatggcctttgcccagggcatgtactcccctgagaggccttctgcctagaaagatctatgactgggttccaaagttgaggcctaggtttttgctgggatttagatattttcaggcaccattttgacagcattcaggaaaacggttattgaccccatagactagggtaagaataaaggcaataaatttggtctgactcagaatataggagatccatatatttctctggaaaccacagtgtacactaaaatgtgaaattgaaggttttgttaaaaagaaaaagataatgagcttcatgctttgtttaattacataatgatttccattacgctatttctgtgaaatgcagcaggttcttaaacgttatttcagtggcatgggctggaagcttatcacaaaaagccatgtgtgtggccttatcagaacagaaagagacaggctggtgcccaaggctgctgcctgctccaccttttgccagctctggacatctgaggacgtcccggcagatctggaatggggccctcaactgaccatttgcttctcagaatttcagtttgagacatgagaggtataatcagttacttttctccccccagagaaacccttttgtgaggggagaggagctatggtatgtggttcagctgaaacacatacaactgcatccttttggagtcctttgccaacaaaaacagaccaacagaccagatggtgtccatgttcaatatcatgtcttgatggacgcagctgatgacctcaaatacttgagtggtctcatggctgttagatggattatttgaaaaaaaaaaaaaaaaaagagagaaaaaataattgatttttacatcagagatagcaaactaagacctggggaggggggtcagcttttattttattttattttttttaagtttgctagttgggtcaaatgtgaggaggagggagtctacctgccacctcttctcttgcccctcttctgcccacacatccagcatccaaaatccattcatttaatgaattgataaagtgccgtgcaaactggtgcacaaacaggcccccagtccacgcagcctggctcctaggaaaagtggtgaccgggcgtgggggggcatgccgcagccctgggacacagtcgggcaccttccccggacccccaggccttggctgtgcctcaagtcagagagggtcagccttcaggccccggagacgagtgactggccgatcatttcacaataaaatcactcacttttggcaacttcactttttttaaggcacagtcagttccttttctcatgtacctcacaaaagatgaagaccatgtagtactctttttggtaaagttacagtgttcatgttaaatatcacttttttctacattgtgtggtaaaaagaactacgttaatagctatatcttaaatactgtgatttgactttttgaaaaatatcctaatacaaatattttactaacttacaatcactcatttaataagaaacatttggattcttttgaaatcagtgttaattgactcatattcttaaaagcctggctcttgaccctattggaaacacaaaggaagctgaaatcaaacatctaaaatacactgcgtacacgtgtgcgtgcacacacacacacacacacacacacacacagctcttcatttctcctgagccatgcagaatttactttcaatgtggaaatctgttccctttaccacactgtatatgcacagagcacaagagaggctatctctagtcacttccaccagcgaggccttagactccgtattagaggccaccgatttcatacaacagtgtttcgctaaagacccttcactattcttgtttagtaaatagctgtctgctcttcagggaactgttacctatgggttattaccaaagaacgctggcaattggaaatgtcctgatggaaattctttgcacgtgccggttctctggcatcctccaggtggcccaacccaaagcagaaagcagaaaccacagaccccgtgagtctccccataccttgtttccaataacttggcaaaacttcttggtgcatattggttacaccctctgggattcataatgccattaggctaaaaccctaagagagagggttgacagaaacacacgcgagaatgaggcagatcccagagcaaggactgggcccagactctccacatgtgctctactagtgagtgccttatactctcagtattttggggcttacagcttcttatttgtgctaaaaaggtgcagttccaaagtaggaactgccacacaggccccagcatcctctctccaacttcatacctctctcctggtggggggagcgggcatccaggacctccggaatcaaggatgtgcagagaagagcgaaagtaatttttctagtcacatgaactgattggttccaggcaattagaaaatggctataaaataaccttaattttaaaaaaaaatcttgggtcttcgttttcctattaggagactgaactgaccacatgtattgatttatatcctgaatatatgggaacttctgtgtttgggatgtcctactgtaagactgatgaatgtacagagttaatttcagggtacagttttgccttaatggttttaaaaaataaactattttttaaaattt

SEQ ID NO: 22002 - DNA, 531 bp, Homo sapiens
gcagcgggcggcgggggcggaggcggccgctagcgccctgcccggcgccgcctccttcggcgttcgccccacggaccggcaggcggcggaccgcggcccaggctgaagctcagggccctgtctgctctgtggactcaacagtttgtggcaagacaagctcagaactgagaagctgtcaccacagtgccacacccccctgtcccagtgcactggggctgtggatcccttcaaagctgagattgcctgtctgtggtctccagcgttaagcacagtcattagctcagcttggagctcggcggcacaaccagcaccatctggtcgcgatggtggacacggaaagcccactctgccccctctccccactcgaggccggcgatctagagagcccgttatctgaagagttcctgcaagaaatgggaaacatccaagagatttcgcaatccatcggcgaggatagttctggaagctttggctttacggaataccagtatttaggaagctgtcctggctcagatggctcggtcatcacgg

SEQ ID NO: 22003 - DNA, 572 bp, Homo sapiens
cttcggcgttcgccccacggaccggcaggcggcggaccgcggcccaggctgaagctcagggccctgtctgctctgtggactcaacagtttgtggcaagacaagctcagaactgagaagctgtcaccacagtagcttggagctcggcggcacaaccagcaccatctggtcgcgatggtggacacggaaagcccactctgccccctctccccactcgaggccggcgatctagagagcccgttatctgaagagttcctgcaagaaatgggaaacatccaagagatttcgcaatccatcggcgaggatagttctggaagctttggctttacggaataccagtatttaggaagctgtcctggctcagatggctcggtcatcacggacacgctttcaccagcttcgagcccctcctcggtgacttatcctgtggtccccggcagcgtggacgagtctcccagtggagcattgaacatcgaatgtagaatctgcggggacaaggcctcaggctatcattacggagtccacgcgtgtgaaggctgcaaggtagaggggagctggaacagggcctggtggc

SEQ ID NO: 22004 - DNA, 1204 bp, Homo sapiens
atggtggacacggaaagcccactctgccccctctccccactcgaggccggcgatctagagagcccgttatctgaagagttcctgcaagaaatgggaaacatccaagagatttcgcaatccatcggcgaggatagttctggaagctttggctttacggaataccagtatttaggaagctgtcctggctcagatggctcggtcatcacggacacgctttcaccagcttcgagcccctcctcggtgacttatcctgtggtccccggcagcgtggacgagtctcccagtggagcattgaacatcgaatgtagaatctgcggggacaaggcctcaggctatcattacggagtccacgcgtgtgaaggctgcaagggcttctttcggcgaacgattcgactcaagctggtgtatgacaagtgcgaccgcagctgcaagatccagaaaaagaacagaaacaaatgccagtattgtcgatttcacaagtgcctttctgtcgggatgtcacacaacgccttttgtcatacatgatatggagacactgtgtatggctgagaagacgctggtggccaagctggtggccaatggcatccagaacaaggaggcggaggtccgcatctttcactgctgccagtgcacgtcagtggagaccgtcacggagctcacggaattcgccaaggccatcccaggcttcgcaaacttggacctgaacgatcaagtgacattgctaaaatacggagtttatgaggccatattcgccatgctgtcttctgtgatgaacaaagacgggatgctggtagcgtatggaaatgggtttataactcgtgaattcctaaaaagcctaaggaaaccgttctgtgatatcatggaacccaagtttgattttgccatgaagttcaatgcactggaactggatgacagtgatatctccctttttgtggctgctatcatttgctgtggagatcgtcctggccttctaaacgtaggacacattgaaaaaatgcaggagggtattgtacatgtgctcagactccacctgcagagcaaccacccggacgatatctttctcttcccaaaacttcttcaaaaaatggcagacctccggcagctggtgacggagcatgcgcagctggtgcagatcatcaagaagacggagtcggatgctgcgctgcacccgctactgcaggagatctacagggacatgtactga

SEQ ID NO: 22005 - DNA, 368 bp, Homo sapiens
gggccgtggacgcggcggccccgcggcgggggcagcgggcggcgggggcggaggcggccgctagcgccctgcccggcgccgcctccttcggcgttcgccccacggaccggcaggcggcggaccgcggcccaggctgaagctcagggccctgtctgctctgtggactcaacagtttgtggcaagacaagctcagaactgagaagctgtcaccacagttctggaggctgggaagttcaagatcaaagtgccagcagattcagtgtcatgtgaggacgtgcttcctgcttcatagataagagtagcttggagctcggcggcacaaccagcaccatctggtcgcgatggtggacacggaaagcccactctgc

SEQ ID NO: 22006 - DNA, 2327 bp, Homo sapiens
gtgcgcggctggggacctgagggcgaggagcgaggacacacaccgaggactcttgcgagggatctcggggcccagctcggcctccctcctagcgctgggggcctgcccggaacccgagtccgcggctgtccctggggtttggcgctgcgcggaggtcgggtctggggaccgcagcgactctgggtcttcgggttgtcccctcggagggagggcccacgggcggggacatcgggacttgccctttcctcggcgcagcggagctggggcgtcgccgactcagaaggtgctttccgagacctccagggatctccgaggcgaggaaacccgggccccggacagaccgaccctgggctgaagctcagggccctgtctgctctgtggactcaacagtttgtggcaagacaagctcagaactgagaagctgtcaccacagttctggaggctgggaagttcaagatcaaagtgccagcagattcagtgtcatgtgaggacgtgcttcctgcttcatagataagagtagcttggagctcggcggcacaaccagcaccatctggtcgcgatggtggacacggaaagcccactctgccccctctccccactcgaggccggcgatctagagagcccgttatctgaagagttcctgcaagaaatgggaaacatccaagagatttcgcaatccatcggcgaggatagttctggaagctttggctttacggaataccagtatttaggaagctgtcctggctcagatggctcggtcatcacggacacgctttcaccagcttcgagcccctcctcggtgacttatcctgtggtccccggcagcgtggacgagtctcccagtggagcattgaacatcgaatgtagaatctgcggggacaaggcctcaggctatcattacggagtccacgcgtgtgaaggctgcaagggcttctttcggcgaacgattcgactcaagctggtgtatgacaagtgcgaccgcagctgcaagatccagaaaaagaacagaaacaaatgccagtattgtcgatttcacaagtgcctttctgtcgggatgtcacacaacgcgattcgttttggacgaatgccaagatctgagaaagcaaaactgaaagcagaaattcttacctgtgaacatgacatagaagattctgaaactgcagatctcaaatctctggccaagagaatctacgaggcctacttgaagaacttcaacatgaacaaggtcaaagcccgggtcatcctctcaggaaaggccagtaacaatccaccttttgtcatacatgatatggagacactgtgtatggctgagaagacgctggtggccaagctggtggccaatggcatccagaacaaggaggcggaggtccgcatctttcactgctgccagtgcacgtcagtggagaccgtcacggagctcacggaattcgccaaggccatcccaggcttcgcaaacttggacctgaacgatcaagtgacattgctaaaatacggagtttatgaggccatattcgccatgctgtcttctgtgatgaacaaagacgggatgctggtagcgtatggaaatgggtttataactcgtgaattcctaaaaagcctaaggaaaccgttctgtgatatcatggaacccaagtttgattttgccatgaagttcaatgcactggaactggatgacagtgatatctccctttttgtggctgctatcatttgctgtggagatcgtcctggccttctaaacgtaggacacattgaaaaaatgcaggagggtattgtacatgtgctcagactccacctgcagagcaaccacccggacgatatctttctcttcccaaaacttcttcaaaaaatggcagacctccggcagctggtgacggagcatgcgcagctggtgcagatcatcaagaagacggagtcggatgctgcgctgcacccgctactgcaggagatctacagggacatgtactgagttccttcagatcagccacaccttttccaggagttctgaagctgacagcactacaaaggagacgggggagcagcacgattttgcacaaatatccaccactttaaccttagagcttggacagtctgagctgtaggtaaccggcatattattccatatctttgttttaaccagtacttctaagagcatagaactcaaatgctgggggtaggtggctaatctcaggactgggaagattacggcgaattatgctcaatggtctgattttaactcacccgatgttaatcaatgcacattgctttagatcacattcgtgatttaccatttaattaactggtaacctcaaaattcgtggcctgtcttc

SEQ ID NO: 22007 - DNA, 3774 bp, Homo sapiens
ggcaggagcgggagaattctgcggagcctgcgggacggcggcggtggcgccgtaggcagccgggacagtgttgtacagtgttttgggcatgcacgtgatactcacacagtggcttctgctcaccaacagatgaagacagatgcaccaacgagggtctggaatggtctggagtggtctggaaagcagggtcagatacccctggaaaactgaagcccgtggagcagtgatctctacaggactgcttcaaggctgatgggaaccaccctgtagaggtccatctgcgttcagacccagacgatgccagagctatgactgggcctgcaggtgtggcgccgaggggagatcagccatggagcagccacaggaggaagcccctgaggtccgggaagaggaggagaaagaggaagtggcagaggcagaaggagccccagagctcaatgggggaccacagcatgcacttccttccagcagctacacagacctctcccggagctcctcgccaccctcactgctggaccaactgcagatgggctgtgacggggcctcatgcggcagcctcaacatggagtgccgggtgtgcggggacaaggcatcgggcttccactacggtgttcatgcatgtgaggggtgcaagggcttcttccgtcgtacgatccgcatgaagctggagtacgagaagtgtgagcgcagctgcaagattcagaagaagaaccgcaacaagtgccagtactgccgcttccagaagtgcctggcactgggcatgtcacacaacgctatccgttttggtcggatgccggaggctgagaagaggaagctggtggcagggctgactgcaaacgaggggagccagtacaacccacaggtggccgacctgaaggccttctccaagcacatctacaatgcctacctgaaaaacttcaacatgaccaaaaagaaggcccgcagcatcctcaccggcaaagccagccacacggcgccctttgtgatccacgacatcgagacattgtggcaggcagagaaggggctggtgtggaagcagttggtgaatggcctgcctccctacaaggagatcagcgtgcacgtcttctaccgctgccagtgcaccacagtggagaccgtgcgggagctcactgagttcgccaagagcatccccagcttcagcagcctcttcctcaacgaccaggttacccttctcaagtatggcgtgcacgaggccatcttcgccatgctggcctctatcgtcaacaaggacgggctgctggtagccaacggcagtggctttgtcacccgtgagttcctgcgcagcctccgcaaacccttcagtgatatcattgagcctaagtttgaatttgctgtcaagttcaacgccctggaacttgatgacagtgacctggccctattcattgcggccatcattctgtgtggagaccggccaggcctcatgaacgttccacgggtggaggctatccaggacaccatcctgcgtgccctcgaattccacctgcaggccaaccaccctgatgcccagtacctcttccccaagctgctgcagaagatggctgacctgcggcaactggtcaccgagcacgcccagatgatgcagcggatcaagaagaccgaaaccgagacctcgctgcaccctctgctccaggagatctacaaggacatgtactaacggcggcacccaggcctccctgcagactccaatggggccagcactggaggggcccacccacatgacttttccattgaccagcccttgagcacccggcctggagcagcagagtcccacgatcgccctcagacacatgacacccacggcctctggctccctgtgccctctctcccgcttcctccagccagctctcttcctgtctttgttgtctccctctttctcagttcctctttcttttctaattcctgttgctctgtttcttcctttctgtaggtttctctcttcccttctcccttgccctccctttctctctccaccccccacgtctgtcctcctttcttattctgtgagatgttttgtattatttcaccagcagcatagaacaggacctctgcttttgcacaccttttccccaggagcagaagagagtggggcctgccctctgccccatcattgcacctgcaggcttaggtcctcacttctgtctcctgtcttcagagcaaaagacttgagccatccaaagaaacactaagctctctgggcctgggttccagggaaggctaagcatggcctggactgactgcagccccctatagtcatggggtccctgctgcaaaggacagtgggcaggaggccccaggctgagagccagatgcctccccaagactgtcattgcccctccgatgctgaggccacccactgacccaactgatcctgctccagcagcacacctcagccccactgacacccagtgtccttccatcttcacactggtttgccaggccaatgttgctgatggccccctgcactggccgctggacggcactctcccagcttggaagtaggcagggttccctccaggtgggcccccacctcactgaagaggagcaagtctcaagagaaggaggggggattggtggttggaggaagcagcacacccaattctgcccctaggactcggggtctgagtcctggggtcaggccagggagagctcggggcaggccttccgccagcactcccactgcccccctgcccagtagcagccgcccacattgtgtcagcatccagggccagggcctggcctcacatccccctgctcctttctctagctggctccacgggagttcaggccccactccccctgaagctgcccctccagcacacacacataagcactgaaatcactttacctgcaggctccatgcacctcccttccctccctgaggcaggtgagaacccagagagaggggcctgcaggtgagcaggcagggctgggccaggtctccggggaggcaggggtcctgcaggtcctggtgggtcagcccagcacctgctcccagtgggagcttcccgggataaactgagcctgttcattctgatgtccatttgtcccaatagctctactgccctccccttcccctttactcagcccagctggccacctagaagtctccctgcacagcctctagtgtccggggaccttgtgggaccagtcccacaccgctggtccctgccctcccctgctcccaggttgaggtgcgctcacctcagagcagggccaaagcacagctgggcatgccatgtctgagcggcgcagagccctccaggcctgcaggggcaaggggctggctggagtctcagagcacagaggtaggagaactggggttcaagcccaggcttcctgggtcctgcctggtcctccctcccaaggagccattctgtgtgtgactctgggtggaagtgcccagcccctgcccctacgggcgctgcagcctcccttccatgccccaggatcactctctgctggcaggattcttcccgctccccacctacccagctgatgggggttggggtgcttcctttcaggccaaggctatgaagggacagctgctgggacccacctccccctccccggccacatgccgcgtccctgccccgacccgggtctggtgctgaggatacagctcttctcagtgtctgaacaatctccaaaattgaaatgtatatttttgctaggagccccagcttcctgtgtttttaatataaatagtgtacacagactgacgaaactttaaataaatgggaattaaatatttaa

SEQ ID NO: 22008 - DNA, 2041 bp, Homo sapiens
ggcaggagcgggagaattctgcggagcctgcgggacggcggcggtggcgccgtaggcagccgggacagtgttgtacagtgttttgggcatgcacgtgatactcacacagtggcttctgctcaccaacagatgaagacagatgcaccaacgagggtctggaatggtctggagtggtctggaaagcagggtcagatacccctggaaaactgaagcccgtggagcagtgatctctacaggactgcttcaaggctgatgggaaccaccctgtagaggtccatctgcgttcagacccagacgatgccagagctatgactgggcctgcaggtgtggcgccgaggggagatcagccatggagcagccacaggaggaagcccctgaggtccgggaagaggaggagaaagaggaagtggcagaggcagaaggagccccagagctcaatgggggaccacagcatgcacttccttccagcagctacacagacctctcccggagctcctcgccaccctcactgctggaccaactgcagatgggctgtgacggggcctcatgcggcagcctcaacatggagtgccgggtgtgcggggacaaggcatcgggcttccactacggtgttcatgcatgtgaggggtgcaagggcttcttccgtcgtacgatccgcatgaagctggagtacgagaagtgtgagcgcagctgcaagattcagaagaagaaccgcaacaagtgccagtactgccgcttccagaagtgcctggcactgggcatgtcacacaacgctatccgttttggtcggatgccggaggctgagaagaggaagctggtggcagggctgactgcaaacgaggggagccagtacaacccacaggtggccgacctgaaggccttctccaagcacatctacaatgcctacctgaaaaacttcaacatgaccaaaaagaaggcccgcagcatcctcaccggcaaagccagccacacggcgccctttgtgatccacgacatcgagacattgtggcaggcagagaaggggctggtgtggaagcagttggtgaatggcctgcctccctacaaggagatcagcgtgcacgtcttctaccgctgccagtgcaccacagtggagaccgtgcgggagctcactgagttcgccaagagcatccccagcttcagcagcctcttcctcaacgaccaggttacccttctcaagtatggcgtgcacgaggccatcttcgccatgctggcctctatcgtcaacaaggacgggctgctggtagccaacggcagtggctttgtcacccgtgagttcctgcgcagcctccgcaaacccttcagtgatatcattgagcctaagtttgaatttgctgtcaagttcaacgccctggaacttgatgacagtgacctggccctattcattgcggccatcattctgtgtggaggtgagtgagagtggggcaggtgggctggcctggcacacccagtcgtcctgggggttggccctcactgcagggcactgtgcctgagctctgacagtgtggggaagtgtccctgtgatcttggcagtggaacatgcaaggcactgactgagcatgcaggatcagctccatctcattatgtacgtagatagaggtggagacaggaaaaagactaagccagacgtggtggctcacacctgtaatcccagcactttggcaggccgaggcgggtggatcacttgaggtcaggagttcgaaaccagcctggccaacatggtgaaaccccgtctctactaaaaatacaaaaaattagccagatgtggtggcacgcgcctgtaatcccagctacttgggaggctgagccaggagaatcgcttgaacccgagaggtggaggttgcagtgagccaaaatcccaccactgcactccagcctgggtgacagagtgagaccctgtctcaaaaaaaaggaaaaggactaacaggcagtatgctgtcatgttaatgtggggtggaaaaattgtctgcattttttctgcatttttaaaattccaacacaataaatacaataataactatgc

SEQ ID NO: 22009 - DNA, 3747 bp, Homo sapiens
gcggagcgtgtgacgctgcggccgccgcggacctggggattaatgggaaaagttttggcaggagcgggagaattctgcggagcctgcgggacggcggcggtggcgccgtaggcagccgggacagtgttgtacagtgttttgggcatgcacgtgatactcacacagtggcttctgctcaccaacagatgaagacagatgcaccaacgaggctgatgggaaccaccctgtagaggtccatctgcgttcagacccagacgatgccagagctatgactgggcctgcaggtgtggcgccgaggggagatcagccatggagcagccacaggaggaagcccctgaggtccgggaagaggaggagaaagaggaagtggcagaggcagaaggagccccagagctcaatgggggaccacagcatgcacttccttccagcagctacacagacctctcccggagctcctcgccaccctcactgctggaccaactgcagatgggctgtgacggggcctcatgcggcagcctcaacatggagtgccgggtgtgcggggacaaggcatcgggcttccactacggtgttcatgcatgtgaggggtgcaagggcttcttccgtcgtacgatccgcatgaagctggagtacgagaagtgtgagcgcagctgcaagattcagaagaagaaccgcaacaagtgccagtactgccgcttccagaagtgcctggcactgggcatgtcacacaacgctatccgttttggtcggatgccggaggctgagaagaggaagctggtggcagggctgactgcaaacgaggggagccagtacaacccacaggtggccgacctgaaggccttctccaagcacatctacaatgcctacctgaaaaacttcaacatgaccaaaaagaaggcccgcagcatcctcaccggcaaagccagccacacggcgccctttgtgatccacgacatcgagacattgtggcaggcagagaaggggctggtgtggaagcagttggtgaatggcctgcctccctacaaggagatcagcgtgcacgtcttctaccgctgccagtgcaccacagtggagaccgtgcgggagctcactgagttcgccaagagcatccccagcttcagcagcctcttcctcaacgaccaggttacccttctcaagtatggcgtgcacgaggccatcttcgccatgctggcctctatcgtcaacaaggacgggctgctggtagccaacggcagtggctttgtcacccgtgagttcctgcgcagcctccgcaaacccttcagtgatatcattgagcctaagtttgaatttgctgtcaagttcaacgccctggaacttgatgacagtgacctggccctattcattgcggccatcattctgtgtggagaccggccaggcctcatgaacgttccacgggtggaggctatccaggacaccatcctgcgtgccctcgaattccacctgcaggccaaccaccctgatgcccagtacctcttccccaagctgctgcagaagatggctgacctgcggcaactggtcaccgagcacgcccagatgatgcagcggatcaagaagaccgaaaccgagacctcgctgcaccctctgctccaggagatctacaaggacatgtactaacggcggcacccaggcctccctgcagactccaatggggccagcactggaggggcccacccacatgacttttccattgaccagcccttgagcacccggcctggagcagcagagtcccacgatcgccctcagacacatgacacccacggcctctggctccctgtgccctctctcccgcttcctccagccagctctcttcctgtctttgttgtctccctctttctcagttcctctttcttttctaattcctgttgctctgtttcttcctttctgtaggtttctctcttcccttctcccttgccctccctttctctctccaccccccacgtctgtcctcctttcttattctgtgagatgttttgtattatttcaccagcagcatagaacaggacctctgcttttgcacaccttttccccaggagcagaagagagtggggcctgccctctgccccatcattgcacctgcaggcttaggtcctcacttctgtctcctgtcttcagagcaaaagacttgagccatccaaagaaacactaagctctctgggcctgggttccagggaaggctaagcatggcctggactgactgcagccccctatagtcatggggtccctgctgcaaaggacagtgggcaggaggccccaggctgagagccagatgcctccccaagactgtcattgcccctccgatgctgaggccacccactgacccaactgatcctgctccagcagcacacctcagccccactgacacccagtgtccttccatcttcacactggtttgccaggccaatgttgctgatggccccctgcactggccgctggacggcactctcccagcttggaagtaggcagggttccctccaggtgggcccccacctcactgaagaggagcaagtctcaagagaaggaggggggattggtggttggaggaagcagcacacccaattctgcccctaggactcggggtctgagtcctggggtcaggccagggagagctcggggcaggccttccgccagcactcccactgcccccctgcccagtagcagccgcccacattgtgtcagcatccagggccagggcctggcctcacatccccctgctcctttctctagctggctccacgggagttcaggccccactccccctgaagctgcccctccagcacacacacataagcactgaaatcactttacctgcaggctccatgcacctcccttccctccctgaggcaggtgagaacccagagagaggggcctgcaggtgagcaggcagggctgggccaggtctccggggaggcaggggtcctgcaggtcctggtgggtcagcccagcacctgctcccagtgggagcttcccgggataaactgagcctgttcattctgatgtccatttgtcccaatagctctactgccctccccttcccctttactcagcccagctggccacctagaagtctccctgcacagcctctagtgtccggggaccttgtgggaccagtcccacaccgctggtccctgccctcccctgctcccaggttgaggtgcgctcacctcagagcagggccaaagcacagctgggcatgccatgtctgagcggcgcagagccctccaggcctgcaggggcaaggggctggctggagtctcagagcacagaggtaggagaactggggttcaagcccaggcttcctgggtcctgcctggtcctccctcccaaggagccattctgtgtgtgactctgggtggaagtgcccagcccctgcccctacgggcgctgcagcctcccttccatgccccaggatcactctctgctggcaggattcttcccgctccccacctacccagctgatgggggttggggtgcttcctttcaggccaaggctatgaagggacagctgctgggacccacctccccctccccggccacatgccgcgtccctgccccgacccgggtctggtgctgaggatacagctcttctcagtgtctgaacaatctccaaaattgaaatgtatatttttgctaggagccccagcttcctgtgtttttaatataaatagtgtacacagactgacgaaactttaaataaatgggaattaaatatttaagagctgactggaa

SEQ ID NO: 22010 - DNA, 3453 bp, Homo sapiens
gcggagcgtgtgacgctgcggccgccgcggacctggggattaatgggaaaagttttggcaggagcgggagaattctgcggagcctgcgggacggcggcggtggcgccgtaggcagccgggacagtgttgtacagtgttttgggcatgcacgtgatactcacacagtggcttctgctcaccaacagatgaagacagatgcaccaacgaggctgatgggaaccaccctgtagaggtccatctgcgttcagacccagacgatgccagagctatgactgggcctgcaggtgtggcgccgaggggagatcagccatggagcagccacaggaggaagcccctgaggtccgggaagaggaggagaaagaggaagtggcagaggcagaaggagccccagagctcaatgggggaccacagcatgcacttccttccagcagctacacagctatccgttttggtcggatgccggaggctgagaagaggaagctggtggcagggctgactgcaaacgaggggagccagtacaacccacaggtggccgacctgaaggccttctccaagcacatctacaatgcctacctgaaaaacttcaacatgaccaaaaagaaggcccgcagcatcctcaccggcaaagccagccacacggcgccctttgtgatccacgacatcgagacattgtggcaggcagagaaggggctggtgtggaagcagttggtgaatggcctgcctccctacaaggagatcagcgtgcacgtcttctaccgctgccagtgcaccacagtggagaccgtgcgggagctcactgagttcgccaagagcatccccagcttcagcagcctcttcctcaacgaccaggttacccttctcaagtatggcgtgcacgaggccatcttcgccatgctggcctctatcgtcaacaaggacgggctgctggtagccaacggcagtggctttgtcacccgtgagttcctgcgcagcctccgcaaacccttcagtgatatcattgagcctaagtttgaatttgctgtcaagttcaacgccctggaacttgatgacagtgacctggccctattcattgcggccatcattctgtgtggagaccggccaggcctcatgaacgttccacgggtggaggctatccaggacaccatcctgcgtgccctcgaattccacctgcaggccaaccaccctgatgcccagtacctcttccccaagctgctgcagaagatggctgacctgcggcaactggtcaccgagcacgcccagatgatgcagcggatcaagaagaccgaaaccgagacctcgctgcaccctctgctccaggagatctacaaggacatgtactaacggcggcacccaggcctccctgcagactccaatggggccagcactggaggggcccacccacatgacttttccattgaccagcccttgagcacccggcctggagcagcagagtcccacgatcgccctcagacacatgacacccacggcctctggctccctgtgccctctctcccgcttcctccagccagctctcttcctgtctttgttgtctccctctttctcagttcctctttcttttctaattcctgttgctctgtttcttcctttctgtaggtttctctcttcccttctcccttgccctccctttctctctccaccccccacgtctgtcctcctttcttattctgtgagatgttttgtattatttcaccagcagcatagaacaggacctctgcttttgcacaccttttccccaggagcagaagagagtggggcctgccctctgccccatcattgcacctgcaggcttaggtcctcacttctgtctcctgtcttcagagcaaaagacttgagccatccaaagaaacactaagctctctgggcctgggttccagggaaggctaagcatggcctggactgactgcagccccctatagtcatggggtccctgctgcaaaggacagtgggcaggaggccccaggctgagagccagatgcctccccaagactgtcattgcccctccgatgctgaggccacccactgacccaactgatcctgctccagcagcacacctcagccccactgacacccagtgtccttccatcttcacactggtttgccaggccaatgttgctgatggccccctgcactggccgctggacggcactctcccagcttggaagtaggcagggttccctccaggtgggcccccacctcactgaagaggagcaagtctcaagagaaggaggggggattggtggttggaggaagcagcacacccaattctgcccctaggactcggggtctgagtcctggggtcaggccagggagagctcggggcaggccttccgccagcactcccactgcccccctgcccagtagcagccgcccacattgtgtcagcatccagggccagggcctggcctcacatccccctgctcctttctctagctggctccacgggagttcaggccccactccccctgaagctgcccctccagcacacacacataagcactgaaatcactttacctgcaggctccatgcacctcccttccctccctgaggcaggtgagaacccagagagaggggcctgcaggtgagcaggcagggctgggccaggtctccggggaggcaggggtcctgcaggtcctggtgggtcagcccagcacctgctcccagtgggagcttcccgggataaactgagcctgttcattctgatgtccatttgtcccaatagctctactgccctccccttcccctttactcagcccagctggccacctagaagtctccctgcacagcctctagtgtccggggaccttgtgggaccagtcccacaccgctggtccctgccctcccctgctcccaggttgaggtgcgctcacctcagagcagggccaaagcacagctgggcatgccatgtctgagcggcgcagagccctccaggcctgcaggggcaaggggctggctggagtctcagagcacagaggtaggagaactggggttcaagcccaggcttcctgggtcctgcctggtcctccctcccaaggagccattctgtgtgtgactctgggtggaagtgcccagcccctgcccctacgggcgctgcagcctcccttccatgccccaggatcactctctgctggcaggattcttcccgctccccacctacccagctgatgggggttggggtgcttcctttcaggccaaggctatgaagggacagctgctgggacccacctccccctccccggccacatgccgcgtccctgccccgacccgggtctggtgctgaggatacagctcttctcagtgtctgaacaatctccaaaattgaaatgtatatttttgctaggagccccagcttcctgtgtttttaatataaatagtgtacacagactgacgaaactttaaataaatgggaattaaatatttaagagctgactggaa

SEQ ID NO: 22011 - DNA, 2002 bp, Homo sapiens
gcggagcgtgtgacgctgcggccgccgcggacctggggattaatgggaaaagttttggcaggagcgggagaattctgcggagcctgcgggacggcggcggtggcgccgtaggcagccgggacagtgttgtacagtgttttgggcatgcacgtgatactcacacagtggcttctgctcaccaacagatgaagacagatgcaccaacgaggctgatgggaaccaccctgtagaggtccatctgcgttcagacccagacgatgccagagctatgactgggcctgcaggtgtggcgccgaggggagatcagccatggagcagccacaggaggaagcccctgaggtccgggaagaggaggagaaagaggaagtggcagaggcagaaggagccccagagctcaatgggggaccacagcatgcacttccttccagcagctacacagacctctcccggagctcctcgccaccctcactgctggaccaactgcagatgggctgtgacggggcctcatgcggcagcctcaacatggagtgccgggtgtgcggggacaaggcatcgggcttccactacggtgttcatgcatgtgaggggtgcaagggcttcttccgtcgtacgatccgcatgaagctggagtacgagaagtgtgagcgcagctgcaagattcagaagaagaaccgcaacaagtgccagtactgccgcttccagaagtgcctggcactgggcatgtcacacaacgctatccgttttggtcggatgccggaggctgagaagaggaagctggtggcagggctgactgcaaacgaggggagccagtacaacccacaggtggccgacctgaaggccttctccaagcacatctacaatgcctacctgaaaaacttcaacatgaccaaaaagaaggcccgcagcatcctcaccggcaaagccagccacacggcgccctttgtgatccacgacatcgagacattgtggcaggcagagaaggggctggtgtggaagcagttggtgaatggcctgcctccctacaaggagatcagcgtgcacgtcttctaccgctgccagtgcaccacagtggagaccgtgcgggagctcactgagttcgccaagagcatccccagcttcagcagcctcttcctcaacgaccaggttacccttctcaagtatggcgtgcacgaggccatcttcgccatgctggcctctatcgtcaacaaggacgggctgctggtagccaacggcagtggctttgtcacccgtgagttcctgcgcagcctccgcaaacccttcagtgatatcattgagcctaagtttgaatttgctgtcaagttcaacgccctggaacttgatgacagtgacctggccctattcattgcggccatcattctgtgtggaggtgagtgagagtggggcaggtgggctggcctggcacacccagtcgtcctgggggttggccctcactgcagggcactgtgcctgagctctgacagtgtggggaagtgtccctgtgatcttggcagtggaacatgcaaggcactgactgagcatgcaggatcagctccatctcattatgtacgtagatagaggtggagacaggaaaaagactaagccagacgtggtggctcacacctgtaatcccagcactttggcaggccgaggcgggtggatcacttgaggtcaggagttcgaaaccagcctggccaacatggtgaaaccccgtctctactaaaaatacaaaaaattagccagatgtggtggcacgcgcctgtaatcccagctacttgggaggctgagccaggagaatcgcttgaacccgagaggtggaggttgcagtgagccaaaatcccaccactgcactccagcctgggtgacagagtgagaccctgtctcaaaaaaaaggaaaaggactaacaggcagtatgctgtcatgttaatgtggggtggaaaaattgtctgcattttttctgcatttttaaaattccaacacaataaatacaataataactatgct

SEQ ID NO: 22012 - DNA, 3516 bp, Homo sapiens
gcggagcgtgtgacgctgcggccgccgcggacctggggattaatgggaaaagttttggcaggagcgggagaattctgcggagcctgcgggacggcggcggtggcgccgtaggcagccgggacagtgttgtacagtgttttgggcatgcacgtgatactcacacagtggcttctgctcaccaacagatgaagacagatgcaccaacgagacctctcccggagctcctcgccaccctcactgctggaccaactgcagatgggctgtgacggggcctcatgcggcagcctcaacatggagtgccgggtgtgcggggacaaggcatcgggcttccactacggtgttcatgcatgtgaggggtgcaagggcttcttccgtcgtacgatccgcatgaagctggagtacgagaagtgtgagcgcagctgcaagattcagaagaagaaccgcaacaagtgccagtactgccgcttccagaagtgcctggcactgggcatgtcacacaacgctatccgttttggtcggatgccggaggctgagaagaggaagctggtggcagggctgactgcaaacgaggggagccagtacaacccacaggtggccgacctgaaggccttctccaagcacatctacaatgcctacctgaaaaacttcaacatgaccaaaaagaaggcccgcagcatcctcaccggcaaagccagccacacggcgccctttgtgatccacgacatcgagacattgtggcaggcagagaaggggctggtgtggaagcagttggtgaatggcctgcctccctacaaggagatcagcgtgcacgtcttctaccgctgccagtgcaccacagtggagaccgtgcgggagctcactgagttcgccaagagcatccccagcttcagcagcctcttcctcaacgaccaggttacccttctcaagtatggcgtgcacgaggccatcttcgccatgctggcctctatcgtcaacaaggacgggctgctggtagccaacggcagtggctttgtcacccgtgagttcctgcgcagcctccgcaaacccttcagtgatatcattgagcctaagtttgaatttgctgtcaagttcaacgccctggaacttgatgacagtgacctggccctattcattgcggccatcattctgtgtggagaccggccaggcctcatgaacgttccacgggtggaggctatccaggacaccatcctgcgtgccctcgaattccacctgcaggccaaccaccctgatgcccagtacctcttccccaagctgctgcagaagatggctgacctgcggcaactggtcaccgagcacgcccagatgatgcagcggatcaagaagaccgaaaccgagacctcgctgcaccctctgctccaggagatctacaaggacatgtactaacggcggcacccaggcctccctgcagactccaatggggccagcactggaggggcccacccacatgacttttccattgaccagcccttgagcacccggcctggagcagcagagtcccacgatcgccctcagacacatgacacccacggcctctggctccctgtgccctctctcccgcttcctccagccagctctcttcctgtctttgttgtctccctctttctcagttcctctttcttttctaattcctgttgctctgtttcttcctttctgtaggtttctctcttcccttctcccttgccctccctttctctctccaccccccacgtctgtcctcctttcttattctgtgagatgttttgtattatttcaccagcagcatagaacaggacctctgcttttgcacaccttttccccaggagcagaagagagtggggcctgccctctgccccatcattgcacctgcaggcttaggtcctcacttctgtctcctgtcttcagagcaaaagacttgagccatccaaagaaacactaagctctctgggcctgggttccagggaaggctaagcatggcctggactgactgcagccccctatagtcatggggtccctgctgcaaaggacagtgggcaggaggccccaggctgagagccagatgcctccccaagactgtcattgcccctccgatgctgaggccacccactgacccaactgatcctgctccagcagcacacctcagccccactgacacccagtgtccttccatcttcacactggtttgccaggccaatgttgctgatggccccctgcactggccgctggacggcactctcccagcttggaagtaggcagggttccctccaggtgggcccccacctcactgaagaggagcaagtctcaagagaaggaggggggattggtggttggaggaagcagcacacccaattctgcccctaggactcggggtctgagtcctggggtcaggccagggagagctcggggcaggccttccgccagcactcccactgcccccctgcccagtagcagccgcccacattgtgtcagcatccagggccagggcctggcctcacatccccctgctcctttctctagctggctccacgggagttcaggccccactccccctgaagctgcccctccagcacacacacataagcactgaaatcactttacctgcaggctccatgcacctcccttccctccctgaggcaggtgagaacccagagagaggggcctgcaggtgagcaggcagggctgggccaggtctccggggaggcaggggtcctgcaggtcctggtgggtcagcccagcacctgctcccagtgggagcttcccgggataaactgagcctgttcattctgatgtccatttgtcccaatagctctactgccctccccttcccctttactcagcccagctggccacctagaagtctccctgcacagcctctagtgtccggggaccttgtgggaccagtcccacaccgctggtccctgccctcccctgctcccaggttgaggtgcgctcacctcagagcagggccaaagcacagctgggcatgccatgtctgagcggcgcagagccctccaggcctgcaggggcaaggggctggctggagtctcagagcacagaggtaggagaactggggttcaagcccaggcttcctgggtcctgcctggtcctccctcccaaggagccattctgtgtgtgactctgggtggaagtgcccagcccctgcccctacgggcgctgcagcctcccttccatgccccaggatcactctctgctggcaggattcttcccgctccccacctacccagctgatgggggttggggtgcttcctttcaggccaaggctatgaagggacagctgctgggacccacctccccctccccggccacatgccgcgtccctgccccgacccgggtctggtgctgaggatacagctcttctcagtgtctgaacaatctccaaaattgaaatgtatatttttgctaggagccccagcttcctgtgtttttaatataaatagtgtacacagactgacgaaactttaaataaatgggaattaaatatttaagagctgactggaa

SEQ ID NO: 22013 - DNA, 1505 bp, Homo sapiens
gagaattctgcggagcctgcgggacggcggcggtggcgccgtaggcagccgggacaggctgatgggaaccaccctgtagaggtccatctgcgttcagacccagacgatgccagagctatgactgggcctgcaggtgtggcgccgaggggagatcagccatggagcagccacaggaggaagcccctgaggtccgggaagaggaggagaaagaggaagtggcagagggcttcttccgtcgtacgatccgcatgaagctggagtacgagaagtgtgagcgcagctgcaagattcagaagaagaaccgcaacaagtgccagtactgccgcttccagaagtgcctggcactgggcatgtcacacaacgctatccgttttggtcggatgccggaggctgagaagaggaagctggtggcagggctgactgcaaacgaggggagccagtacaacccacaggtggccgacctgaaggccttctccaagcacatctacaatgcctacctgaaaaacttcaacatgaccaaaaagaaggcccgcagcatcctcaccggcaaagccagccacacggcgccctttgtgatccacgacatcgagacattgtggcaggcagagaaggggctggtgtggaagcagttggtgaatggcctgcctccctacaaggagatcagcgtgcacgtcttctaccgctgccagtgcaccacagtggagaccgtgcgggagctcactgagttcgccaagagcatccccagcttcagcagcctcttcctcaacgaccaggttacccttctcaagtatggcgtgcacgaggccatcttcgccatgctggcctctatcgtcaacaaggacgggctgctggtagccaacggcagtggctttgtcacccgtgagttcctgcgcagcctccgcaaacccttcagtgatatcattgagcctaagtttgaatttgctgtcaagttcaacgccctggaacttgatgacagtgacctggccctattcattgcggccatcattctgtgtggagaccggccaggcctcatgaacgttccacgggtggaggctatccaggacaccatcctgcgtgccctcgaattccacctgcaggccaaccaccctgatgcccagtacctcttccccaagctgctgcagaagatggctgacctgcggcaactggtcaccgagcacgcccagatgatgcagcggatcaagaagaccgaaaccgagacctcgctgcaccctctgctccaggagatctacaaggacatgtactaacggcggcacccaggcctccctgcagactccaatggggccagcactggaggggcccacccacatgacttttccattgaccagcccttgagcacccggcctggagcagcagagtcccacgatcgccctcagacacatgacacccacggcctctggctccctgtgccctctctcccgcttcctccagccagctctcttcctgtctttgttgtctccctctttctcagttcctctttcttttct

SEQ ID NO: 22014 - DNA, 1850 bp, Homo sapiens
actcatgggtgtattcacaaattctgttacttcaagtctttttcttttaacggattgatcttttgctagatagagacaaaatatcagtgtgaattacagcaaacccctattccatgctgttatgggtgaaactctgggagattctcctattgacccagaaagcgattccttcactgatacactgtctgcaaacatatcacaagaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactagcagagagtcctgagccactgccaacatttcccttcttccagttgcactattctgagggaaaatctgacacctaagaaatttactgtgaaaaagcattttaaaaagaaaaggttttagaatatgatctattttatgcatattgtttataaagacacatttacaatttacttttaatattaaaaattaccatattatgaaattgctgatagta

SEQ ID NO: 22015 - DNA, 1870 bp, Homo sapiens
cccgcccccgcgccgggcccggctcggcccgacccggctccgccgcgggcaggcggggcccagcgcactcggagcccgagcccgagccgcagccgccgcctggggcgcttgggtcggcctcgaggacaccggagaggggcgccacgccgccgtggccgcagatttgaaagaagccaacactaaaccacaaatatacaacaaggccattttctcaaacgagagtcagcctttaacgaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactagcagagagtcctgagccactgccaacatttcccttcttccagttgcactattctgagggaaaatctgacacctaagaaatttactgtgaaaaagcattttaaaaagaaaaggttttagaatatgatctattttatgcatattgtttataaagacacatttacaatttacttttaatattaaaaattaccatattatgaaa

SEQ ID NO: 22016 - DNA, 1122 bp, Homo sapiens
gaagccaacactaaaccacaaatatacaacaaggccattttctcaaacgagagtcagcctttaacgaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactagcagagagtcctgagccactgccaacatttcccttcttccagttgcactattctgagggaaaatctgacacc

SEQ ID NO: 22017 - DNA, 2017 bp, Homo sapiens
aacttacaaacgcaaggaactctgaaagtgtgcagcaccaccgatcagaagagaaaaccaagggacccgaaatatgctttaattaaattttcttttaaaatgtcactggaaagaacatcttgggaagacggcctggccgatcgccgtgtgaagggcaagccactctggccgagagggagccccacacctcggtctccccagaccggccctggccgggggcatccccctaaacttcggatccctcctcggaaatgggaccctctctgggccgcctcccagcggtggtggcgaggagcaaacgacaccagatttgaaagaagccaacactaaaccacaaatatacaacaaggccattttctcaaacgagagtcagcctttaacgaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactagcagagagtcctgagccactgccaacatttcccttcttccagttgcactattctgagggaaaatctgacacctaagaaatttactgtgaaaaagcattttaaaaagaaaaggttttagaatatgatctattttatgcatattgtttataaagacacatttacaatttacttttaatattaaaaattaccatattatgaaa

SEQ ID NO: 22018 - DNA, 2006 bp, Homo sapiens
ctttgtgggctcctgcaagtgccaggcgctgaccactcctcctgggagcctaactgaggggggtagaggcagcagaggttaacagaaatctcaggtcccttggtggaaggtgggtgtgtagtcgtggtactttacgcctcggtgtttagggaggagcctaaggtaaggagtcagaaacggggagtaaccgagctgcggcttttatataaggtcagtggtaggtaaggaaggggccttaacctctgctggtgaccagaagcctgcatttctgcattctgcttaattccctttccttagatttgaaagaagccaacactaaaccacaaatatacaacaaggccattttctcaaacgagagtcagcctttaacgaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactagcagagagtcctgagccactgccaacatttcccttcttccagttgcactattctgagggaaaatctgacacctaagaaatttactgtgaaaaagcattttaaaaagaaaaggttttagaatatgatctattttatgcatattgtttataaagacacatttacaatttacttttaatattaaaaattaccatattatgaaa

SEQ ID NO: 22019 - DNA, 1722 bp, Homo sapiens
gccgcgggcaggcggggcccagcgcactcggagcccgagcccgagccgcagccgccgcctggggcgcttgggtcggcctcgaggacaccggagaggggcgccacgccgccgtggccgcagaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactagcagagagtcctgagccactgccaacatttcccttcttccagttgcactattctgagggaaaatctgacacctaagaaatttactgtgaaaaagcattttaaaaagaaaaggttttagaatatgatctattttatgcatattgtttataaagacacatttacaattt

SEQ ID NO: 22020 - DNA, 2029 bp, Homo sapiens
ccttaacctctgctggtgaccagaagcctgcatttctgcattctgcttaattccctttccttagatttgaaagaagccaacactaaaccacaaatatacaacaaggccattttctcaaacgagagtcagcctttaacgtgtttcaggatgattcttgtctctggatgtcgctgtcatgatgggagaggaattagtaaattcccaggtcagtttacactgcagagtgatcttgatctgcatgaatcagtaaggatgggctggataaacaagttggaaccacagttatgagtaccatgacattaactgaaacaaatgagaagggattgaaaaatcggcggttaagtgtcttttaaggtcatttccaacaaaactacaaaggacctatgaaaggcttttcagaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactagcagagagtcctgagccactgccaacatttcccttcttccagttgcactattctgagggaaaatctgacacctaagaaatttactgtgaaaaagcattttaaaaagaaaaggttttagaatatgatctattttatgcatattgtttataaagacacatttacaatttacttttaatattaaaaattaccatatta

SEQ ID NO: 22021 - DNA, 686 bp, Homo sapiens
tctgaaagtgtgcagcaccaccgatcagaagagaaaaccaagggacccgaaatatgctttaattaaattttcttttaaaatgtcactggaaagaacatcttgggaagacggcctggccgatcgccgtgtgaagggcaagccactctggccgagagggagccccacacctcggtctccccagaccggccctggccgggggcatccccctaaacttcggatccctcctcggaaatgggaccctctctgggccgcctcccagcggtggtggcgaggagcaaacgacaccagaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaag

SEQ ID NO: 22022 - DNA, 560 bp, Homo sapiens
ttagtatacaatgaatttataaatgtaaccatacaatttcatgcttagagaacgttttctctccattctctctacctttagaccattctgcagtttaaatcttgaaccaaaatgtcatttaaccatccttctgaacgataactccataattaactcaagcaccaaataagtcatctagctcttgatgatttgaaagaagccaacactaaaccacaaatatacaacaaggccattttctcaaacgagagtcagcctttaacgaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcat

SEQ ID NO: 22023 - DNA, 428 bp, Homo sapiens
ctttgtgggctcctgcaagtgccaggcgctgaccactcctcctgggagcctaactgaggggggtagaggcagcagaggttaacagaaatctcaggtcccttggtggaaggtgggtgtgtagtcgtggtactttacgcctcggtgtttagggaggagcctaaggtaaggagtcagaaacggggagtaaccgagctgcggcttttatataaggtcagtggtaggtaaggaaggggccttaacctctgctggtgaccagaagcctgcatttctgcattctgcttaattccctttccttagaaatgaccatggttgacacagagatgccattctggcccaccaactttgggatcagctccgtggatctctccgtaatggaagaccactcccactcctttgatatcaagcccttcactactgttgacttctcc

SEQ ID NO: 22024 - DNA, 1122 bp, Homo sapiens; identical to SEQ ID NO: 22016

SEQ ID NO: 22025 - DNA, 3004 bp, Homo sapiens
cggctcggcgttgactccgccgcacgctgcagccgcggctggaagatggcggggaacgactgcggcgcgctgctggacgaagagctctcctccttcttcctcaactatctcgctgacacgcagggtggagggtccggggaggagcaactctatgctgactttccagaacttgacctctcccagctggatgccagcgactttgactcggccacctgctttggggagctgcagtggtgcccagagaactcagagactgaacccaaccagtacagccccgatgactccgagctcttccagattgacagtgagaatgaggccctcctggcagagctcaccaagaccctggatgacatccctgaagatgacgtgggtctggctgccttcccagccctggatggtggagacgctctatcatgcacctcagcttcgcctgccccctcatctgcaccccccagccctgccccggagaagccctcggccccagcccctgaggtggacgagctctcactggcggacagcacccaagacaagaaggctcccatgatgcagtctcagagccgaagttgtacagaactacataagcacctcacctcggcacagtgctgcctgcaggatcggggtctgcagccaccatgcctccagagtccccggctccctgccaaggaggacaaggagccgggtgaggactgcccgagcccccagccagctccagcctctccccgggactccctagctctgggcagggcagaccccggtgccccggtttcccaggaagacatgcaggcgatggtgcaactcatacgctacatgcacacctactgcctcccccagaggaagctgcccccacagacccctgagccactccccaaggcctgcagcaacccctcccagcaggtcagatcccggccctggtcccggcaccactccaaagcctcctgggctgagttctccattctgagggaacttctggctcaagacgtgctctgtgatgtcagcaaaccctaccgtctggccacgcctgtttatgcctccctcacacctcggtcaaggcccaggccccccaaagacagtcaggcctcccctggtcgcccgtcctcggtggaggaggtaaggatcgcagcttcacccaagagcaccgggcccagaccaagcctgcgcccactgcggctggaggtgaaaagggaggtccgccggcctgccagactgcagcagcaggaggaggaagacgaggaagaagaggaggaggaagaggaagaagaaaaagaggaggaggaggagtggggcaggaaaaggccaggccgaggcctgccatggacgaagctggggaggaagctggagagctctgtgtgccccgtgcggcgttctcggagactgaaccctgagctgggcccctggctgacatttgcagatgagccgctggtcccctcggagccccaaggtgctctgccctcactgtgcctggctcccaaggcctacgacgtagagcgggagctgggcagccccacggacgaggacagtggccaagaccagcagctcctacggggaccccagatccctgccctggagagcccctgtgagagtgggtgtggggacatggatgaggaccccagctgcccgcagctccctcccagagactctcccaggtgcctcatgctggccttgtcacaaagcgacccaacttttggcaagaagagctttgagcagaccttgacagtggagctctgtggcacagcaggactcaccccacccaccacaccaccgtacaagcccacagaggaggatcccttcaaaccagacatcaagcatagtctaggcaaagaaatagctctcagcctcccctcccctgagggcctctcactcaaggccaccccaggggctgcccacaagctgccaaagaagcacccagagcgaagtgagctcctgtcccacctgcgacatgccacagcccagccagcctcccaggctggccagaagcgtcccttctcctgttcctttggagaccatgactactgccaggtgctccgaccagaaggcgtcctgcaaaggaaggtgctgaggtcctgggagccgtctggggttcaccttgaggactggccccagcagggtgccccttgggctgaggcacaggcccctggcagggaggaagacagaagctgtgatgctggcgccccacccaaggacagcacgctgctgagagaccatgagatccgtgccagcctcaccaaacactttgggctgctggagaccgccctggaggaggaagacctggcctcctgcaagagccctgagtatgacactgtctttgaagacagcagcagcagcagcggcgagagcagcttcctcccagaggaggaagaggaagaaggggaggaggaggaggaggacgatgaagaagaggactcaggggtcagccccacttgctctgaccactgcccctaccagagcccaccaagcaaggccaaccggcagctctgttcccgcagccgctcaagctctggctcttcaccctgccactcctggtcaccagccactcgaaggaacttcagatgtgagagcagagggccgtgttcagacagaacgccaagcatccggcacgccaggaagcggcgggaaaaggccattggggaaggccgcgtggtgtacattcaaaatctctccagcgacatgagctcccgagagctgaagaggcgctttgaagtgtttggtgagattgaggagtgcgaggtgctgacaagaaataggagaggcgagaagtacggcttcatcacctaccggtgttctgagcacgcggccctctctttgacaaagggcgctgccctgaggaagcgcaacgagccctccttccagctgagctacggagggctccggcacttctgctggcccagatacactgactacgattccaattcagaagaggcccttcctgcgtcagggaaaagcaagtatgaagccatggattttgacagcttactgaaagaggcccagcagagcctgcattgataac

SEQ ID NO: 22026 - DNA, 3146 bp, Homo sapiens
acattctcattttaatcctcaagcaactctgaattagttgctgttatcccagacttacaggcaggaagcaggctcagagaagtgaaggtttccaacttagacgtgccaggctgtgcacaggtggggacctctgaggggcctgctctgatctgggttggggctgccccaggacccttggaggagccgccaccagagcaatgggtggagggtccggggaggagcaactctatgctgactttccagaacttgacctctcccagctggatgccagcgactttgactcggccacctgctttggggagctgcagtggtgcccagagaactcagagactgaacccaaccagtacagccccgatgactccgagctcttccagattgacagtgagaatgaggccctcctggcagagctcaccaagaccctggatgacatccctgaagatgacgtgggtctggctgccttcccagccctggatggtggagacgctctatcatgcacctcagcttcgcctgccccctcatctgcaccccccagccctgccccggagaagccctcggccccagcccctgaggtggacgagctctcactggcggacagcacccaagacaagaaggctcccatgatgcagtctcagagccgaagttgtacagaactacataagcacctcacctcggcacagtgctgcctgcaggatcggggtctgcagccaccatgcctccagagtccccggctccctgccaaggaggacaaggagccgggtgaggactgcccgagcccccagccagctccagcctctccccgggactccctagctctgggcagggcagaccccggtgccccggtttcccaggaagacatgcaggcgatggtgcaactcatacgctacatgcacacctactgcctcccccagaggaagctgcccccacagacccctgagccactccccaaggcctgcagcaacccctcccagcaggtcagatcccggccctggtcccggcaccactccaaagcctcctgggctgagttctccattctgagggaacttctggctcaagacgtgctctgtgatgtcagcaaaccctaccgtctggccacgcctgtttatgcctccctcacacctcggtcaaggcccaggccccccaaagacagtcaggcctcccctggtcgcccgtcctcggtggaggaggtaaggatcgcagcttcacccaagagcaccgggcccagaccaagcctgcgcccactgcggctggaggtgaaaagggaggtccgccggcctgccagactgcagcagcaggaggaggaagacgaggaagaagaggaggaggaagaggaagaagaaaaagaggaggaggaggagtggggcaggaaaaggccaggccgaggcctgccatggacgaagctggggaggaagctggagagctctgtgtgccccgtgcggcgttctcggagactgaaccctgagctgggcccctggctgacatttgcagatgagccgctggtcccctcggagccccaaggtgctctgccctcactgtgcctggctcccaaggcctacgacgtagagcgggagctgggcagccccacggacgaggacagtggccaagaccagcagctcctacggggaccccagatccctgccctggagagcccctgtgagagtgggtgtggggacatggatgaggaccccagctgcccgcagctccctcccagagactctcccaggtgcctcatgctggccttgtcacaaagcgacccaacttttggcaagaagagctttgagcagaccttgacagtggagctctgtggcacagcaggactcaccccacccaccacaccaccgtacaagcccacagaggaggatcccttcaaaccagacatcaagcatagtctaggcaaagaaatagctctcagcctcccctcccctgagggcctctcactcaaggccaccccaggggctgcccacaagctgccaaagaagcacccagagcgaagtgagctcctgtcccacctgcgacatgccacagcccagccagcctcccaggctggccagaagcgtcccttctcctgttcctttggagaccatgactactgccaggtgctccgaccagaaggcgtcctgcaaaggaaggtgctgaggtcctgggagccgtctggggttcaccttgaggactggccccagcagggtgccccttgggctgaggcacaggcccctggcagggaggaagacagaagctgtgatgctggcgccccacccaaggacagcacgctgctgagagaccatgagatccgtgccagcctcaccaaacactttgggctgctggagaccgccctggaggaggaagacctggcctcctgcaagagccctgagtatgacactgtctttgaagacagcagcagcagcagcggcgagagcagcttcctcccagaggaggaagaggaagaaggggaggaggaggaggaggacgatgaagaagaggactcaggggtcagccccacttgctctgaccactgcccctaccagagcccaccaagcaaggccaaccggcagctctgttcccgcagccgctcaagctctggctcttcaccctgccactcctggtcaccagccactcgaaggaacttcagatgtgagagcagagggccgtgttcagacagaacgccaagcatccggcacgccaggaagcggcgggaaaaggccattggggaaggccgcgtggtgtacattcaaaatctctccagcgacatgagctcccgagagctgaagaggcgctttgaagtgtttggtgagattgaggagtgcgaggtgctgacaagaaataggagaggcgagaagtacggcttcatcacctaccggtgttctgagcacgcggccctctctttgacaaagggcgctgccctgaggaagcgcaacgagccctccttccagctgagctacggagggctccggcacttctgctggcccagatacactgactacgattccaattcagaagaggcccttcctgcgtcagggaaaagcaagtatgaagccatggattttgacagcttactgaaagaggcccagcagagcctgcattgataacagccttaaccctcgaggaatacctcaatacctcagacaaggcccttccaatatgtttacgttttc

SEQ ID NO: 22027 - DNA, 6318 bp, Homo sapiens
tagtaagacaggtgccttcagttcactctcagtaaggggctggttgcctgcatgagtgtgtgctctgtgtcactgtggattggagttgaaaaagcttgactggcgtcattcaggagctggatggcgtgggacatgtgcaaccaggactctgagtctgtatggagtgacatcgagtgtgctgctctggttggtgaagaccagcctctttgcccagatcttcctgaacttgatctttctgaactagatgtgaacgacttggatacagacagctttctgggtggactcaagtggtgcagtgaccaatcagaaataatatccaatcagtacaacaatgagccttcaaacatatttgagaagatagatgaagagaatgaggcaaacttgctagcagtcctcacagagacactagacagtctccctgtggatgaagacggattgccctcatttgatgcgctgacagatggagacgtgaccactgacaatgaggctagtccttcctccatgcctgacggcacccctccaccccaggaggcagaagagccgtctctacttaagaagctcttactggcaccagccaacactcagctaagttataatgaatgcagtggtctcagtacccagaaccatgcaaatcacaatcacaggatcagaacaaaccctgcaattgttaagactgagaattcatggagcaataaagcgaagagtatttgtcaacagcaaaagccacaaagacgtccctgctcggagcttctcaaatatctgaccacaaacgatgaccctcctcacaccaaacccacagagaacagaaacagcagcagagacaaatgcacctccaaaaagaagtcccacacacagtcgcagtcacaacacttacaagccaaaccaacaactttatctcttcctctgaccccagagtcaccaaatgaccccaagggttccccatttgagaacaagactattgaacgcaccttaagtgtggaactctctggaactgcaggcctaactccacccaccactcctcctcataaagccaaccaagataacccttttagggcttctccaaagctgaagtcctcttgcaagactgtggtgccaccaccatcaaagaagcccaggtacagtgagtcttctggtacacaaggcaataactccaccaagaaagggccggagcaatccgagttgtatgcacaactcagcaagtcctcagtcctcactggtggacacgaggaaaggaagaccaagcggcccagtctgcggctgtttggtgaccatgactattgccagtcaattaattccaaaacagaaatactcattaatatatcacaggagctccaagactctagacaactagaaaataaagatgtctcctctgattggcaggggcagatttgttcttccacagattcagaccagtgctacctgagagagactttggaggcaagcaagcaggtctctccttgcagcacaagaaaacagctccaagaccaggaaatccgagccgagctgaacaagcacttcggtcatcccagtcaagctgtttttgacgacgaagcagacaagaccggtgaactgagggacagtgatttcagtaatgaacaattctccaaactacctatgtttataaattcaggactagccatggatggcctgtttgatgacagcgaagatgaaagtgataaactgagctacccttgggatggcacgcaatcctattcattgttcaatgtgtctccttcttgttcttcttttaactctccatgtagagattctgtgtcaccacccaaatccttattttctcaaagaccccaaaggatgcgctctcgttcaaggtccttttctcgacacaggtcgtgttcccgatcaccatattccaggtcaagatcaaggtctccaggcagtagatcctcttcaagatcctgctattactatgagtcaagccactacagacaccgcacgcaccgaaattctcccttgtatgtgagatcacgttcaagatcgccctacagccgtcggcccaggtatgacagctacgaggaatatcagcacgagaggctgaagagggaagaatatcgcagagagtatgagaagcgagagtctgagagggccaagcaaagggagaggcagaggcagaaggcaattgaagagcgccgtgtgatttatgtcggtaaaatcagacctgacacaacacggacagaactgagggaccgttttgaagtttttggtgaaattgaggagtgcacagtaaatctgcgggatgatggagacagctatggtttcattacctaccgttatacctgtgatgcttttgctgctcttgaaaatggatacactttgcgcaggtcaaacgaaactgactttgagctgtacttttgtggacgcaagcaatttttcaagtctaactatgcagacctagattcaaactcagatgactttgaccctgcttccaccaagagcaagtatgactctctggattttgatagtttactgaaagaagctcagagaagcttgcgcaggtaacatgttccctagctgaggatgacagagggatggcgaatacctcatgggacagcgcgtccttccctaaagactattgcaagtcatacttaggaatttctcctactttacactctctgtacaaaaacaaaacaaaacaacaacaatacaacaagaacaacaacaacaataacaacaatggtttacatgaacacagctgctgaagaggcaagagacagaatgatatccagtaagcacatgtttattcatgggtgtcagctttgcttttcctggagtctcttggtgatggagtgtgcgtgtgtgcatgtatgtgtgtgtgtatgtatgtgtgtggtgtgtgtgcttggtttaggggaagtatgtgtgggtacatgtgaggactgggggcacctgaccagaatgcgcaagggcaaaccatttcaaatggcagcagttccatgaagacacgcttaaaacctagaacttcaaaatgttcgtattctattcaaaaggaaatatatatatatatatatatatatatatatatatatataaattaaaaaggaaagaaaactaacaaccaaccaaccaaccaaccaaccacaaaccaccctaaaatgacagccgctgatgtctgggcatcagcctttgtactctgtttttttaagaaagtgcagaatcaacttgaagcaagctttctctcataacgtaatgattatatgacaatcctgaagaaaccacaggttccatagaactaatatcctgtctctctctctctctctctctctctcttttttttttctttttccttttgccatggaatctgggtgggagaggatactgcgggcaccagaatgctaaagtttcctaacattttgaagtttctgtagttcatccttaatcctgacacccatgtaaatgtccaaaatgttgatcttccactgcaaatttcaaaagccttgtcaatggtcaagcgtgcagcttgttcagcggttctttctgaggagcggacaccgggttacattactaatgagagttgggtagaactctctgagatgtgttcagatagtgtaattgctacattctctgatgtagttaagtatttacagatgttaaatggagtatttttattttatgtatatactatacaacaatgttcttttttgttacagctatgcactgtaaatgcagccttcttttcaaaactgctaaatttttcttaatcaagaatattcaaatgtaattatgaggtgaaacaattattgtacactaacatatttagaagctgaacttactgcttatatatatttgattgtaaaaacaaaaagacagtgtgtgtgtctgttgagtgcaacaagagcaaaatgatgctttccgcacatccatcccttaggtgagcttcaatctaagcatcttgtcaagaaatatcctagtcccctaaaggtattaaccacttctgcgatatttttccacattttcttgtcgcttgtttttctttgaagttttatacactggatttgttaggggaatgaaattttctcatctaaaatttttctagaagatatcatgattttatgtaaagtctctcaatgggtaaccattaagaaatgtttttattttctctatcaacagtagttttgaaactagaagtcaaaaatctttttaaaatgctgttttgttttaatttttgtgattttaatttgatacaaaatgctgaggtaataattatagtatgatttttacaataattaatgtgtgtctgaagactatctttgaagccagtatttctttcccttggcagagtatgacgatggtatttatctgtattttttacagttatgcatcctgtataaatactgatatttcattcctttgtttactaaagagacatatttatcagttgcagatagcctatttattataaattatgagatgatgaaaataataaagccagtggaaattttctacctaggatgcatgacaattgtcaggttggagtgtaagtgcttcatttgggaaattcagcttttgcagaagcagtgtttctacttgcactagcatggcctctgacgtgaccatggtgttgttcttgatgacattgcttctgctaaatttaataaaaacttcagaaaaacctccattttgatcatcaggatttcatctgagtgtggagtccctggaatggaattcagtaacatttggagtgtgtattcaagtttctaaattgagattcgattactgtttggctgacatgacttttctggaagacatgatacacctactactcaattgttcttttcctttctctcgcccaacacgatcttgtaagatggatttcacccccaggccaatgcagctaattttgatagctgcattcatttatcaccagcatattgtgttctgagtgaatccactgtttgtcctgtcggatgcttgcttgattttttggcttcttatttctaagtagatagaaagcaataaaaatactatgaaatgaaagaacttgttcacaggttctgcgttacaacagtaacacatctttaatccgcctaattcttgttgttctgtaggttaaatgcaggtattttaactgtgtgaacgccaaactaaagtttacagtctttctttctgaattttgagtatcttctgttgtagaataataataaaaagactattaagagcaataaattatttttaagaaatcgagatttagtaaatcctattatgtgttcaaggaccacatgtgttctctattttgcctttaaatttttgtgaaccaattttaaatacattctcctttttgccctggattgttgacatgagtggaatacttggtttcttttcttacttatcaaaagacagcactacagatatcatattgaggattaatttatcccccctacccccagcctgacaaatattgttaccatgaagatagttttcctcaatggacttcaaattgcatctagaattagtggagcttttgtatcttctgcagacactgtgggtagcccatcaaaatgtaagctgtgctcctctcatttttatttttatttttttgggagagaatatttcaaatgaacacgtgcaccccatcatcactggaggcaaatttcagcatagatctgtaggatttttagaagaccgtgggccattgccttcatgccgtggtaagtaccacatctacaattttggtaaccgaactggtgctttagtaatgtggatttttttcttttttaaaagagatgtagcagaataattcttccagtgcaacaaaatcaattttttgctaaacgactccgagaacaacagttgggctgtcaacattcaaagcagcagagagggaactttgcactattggggtatgatgtttgggtcagttgataaaaggaaaccttttcatgcctttagatgtgagcttccagtaggtaatgattatgtgtcctttcttgatggctgtaatgagaacttcaatcactgtagtctaagacctgatctatagatgacctagaatagccatgtactataatgtgatgattctaaatttgtacctatgtgacagacattttcaataatgtgaactgctgatttgatggagctactttaagatttgtaggtgaaagtgtaatactgttggttgaactatgctgaagagggaaagtgagcgattagttgagcccttgccgggccttttttccacctgccaattctacatgtattgttgtggttttattcattgtatgaaaattcctgtgattttttttaaatgtgcagtacacatcagcctcactgagctaataaagggaaacgaatgtttcaaatcta

SEQ ID NO: 22028 - DNA, 10568 bp, Homo sapiens
actccgccgcacgctgcagccgcggctggaagatggcggggaacgactgcggcgcgctgctggacgaagagctctcctccttcttcctcaactatctcgctgacacgcagggtggagggtccggggaggagcaactctatgctgactttccagaacttgacctctcccagctggatgccagcgactttgactcggccacctgctttggggagctgcagtggtgcccagagaactcagagactgaacccaaccagtacagccccgatgactccgagctcttccagattgacagtgagaatgaggccctcctggcagagctcaccaagaccctggatgacatccctgaagatgacgtgggtctggctgccttcccagccctggatggtggagacgctctatcatgcacctcagcttcgcctgccccctcatctgcaccccccagccctgccccggagaagccctcggccccagcccctgaggtggacgagctctcactgctgcagaagctcctcctggccacatcctacccaacatcaagctctgacacccagaaggaagggaccgcctggcgccaggcaggcctcagatctaaaagtcaacggccttgtgttaaggcggacagcacccaagacaagaaggctcccatgatgcagtctcagagccgaagttgtacagaactacataagcacctcacctcggcacagtgctgcctgcaggatcggggtctgcagccaccatgcctccagagtccccggctccctgccaaggaggacaaggagccgggtgaggactgcccgagcccccagccagctccagcctctccccgggactccctagctctgggcagggcagaccccggtgccccggtttcccaggaagacatgcaggcgatggtgcaactcatacgctacatgcacacctactgcctcccccagaggaagctgcccccacagacccctgagccactccccaaggcctgcagcaacccctcccagcaggtcagatcccggccctggtcccggcaccactccaaagcctcctgggctgagttctccattctgagggaacttctggctcaagacgtgctctgtgatgtcagcaaaccctaccgtctggccacgcctgtttatgcctccctcacacctcggtcaaggcccaggccccccaaagacagtcaggcctcccctggtcgcccgtcctcggtggaggaggtaaggatcgcagcttcacccaagagcaccgggcccagaccaagcctgcgcccactgcggctggaggtgaaaagggaggtccgccggcctgccagactgcagcagcaggaggaggaagacgaggaagaagaggaggaggaagaggaagaagaaaaagaggaggaggaggagtggggcaggaaaaggccaggccgaggcctgccatggacgaagctggggaggaagctggagagctctgtgtgccccgtgcggcgttctcggagactgaaccctgagctgggcccctggctgacatttgcagatgagccgctggtcccctcggagccccaaggtgctctgccctcactgtgcctggctcccaaggcctacgacgtagagcgggagctgggcagccccacggacgaggacagtggccaagaccagcagctcctacggggaccccagatccctgccctggagagcccctgtgagagtgggtgtggggacatggatgaggaccccagctgcccgcagctccctcccagagactctcccaggtgcctcatgctggccttgtcacaaagcgacccaacttttggcaagaagagctttgagcagaccttgacagtggagctctgtggcacagcaggactcaccccacccaccacaccaccgtacaagcccacagaggaggatcccttcaaaccagacatcaagcatagtctaggcaaagaaatagctctcagcctcccctcccctgagggcctctcactcaaggccaccccaggggctgcccacaagctgccaaagaagcacccagagcgaagtgagctcctgtcccacctgcgacatgccacagcccagccagcctcccaggctggccagaagcgtcccttctcctgttcctttggagaccatgactactgccaggtgctccgaccagaaggcgtcctgcaaaggaaggtgctgaggtcctgggagccgtctggggttcaccttgaggactggccccagcagggtgccccttgggctgaggcacaggcccctggcagggaggaagacagaagctgtgatgctggcgccccacccaaggacagcacgctgctgagagaccatgagatccgtgccagcctcaccaaacactttgggctgctggagaccgccctggaggaggaagacctggcctcctgcaagagccctgagtatgacactgtctttgaagacagcagcagcagcagcggcgagagcagcttcctcccagaggaggaagaggaagaaggggaggaggaggaggaggacgatgaagaagaggactcaggggtcagccccacttgctctgaccactgcccctaccagagcccaccaagcaaggccaaccggcagctctgttcccgcagccgctcaagctctggctcttcaccctgccactcctggtcaccagccactcgaaggaacttcagatgtgagagcagagggccgtgttcagacagaacgccaagcatccggcacgccaggaagcggcgggaaaaggccattggggaaggccgcgtggtgtacattcaaaatctctccagcgacatgagctcccgagagctgaagaggcgctttgaagtgtttggtgagattgaggagtgcgaggtgctgacaagaaataggagaggcgagaagtacggcttcatcacctaccggtgttctgagcacgcggccctctctttgacaaagggcgctgccctgaggaagcgcaacgagccctccttccagctgagctacggagggctccggcacttctgctggcccagatacactgactacgattccaattcagaagaggcccttcctgcgtcagggaaaagcaagtatgaagccatggattttgacagcttactgaaagaggcccagcagagcctgcattgataacagccttaaccctcgaggaatacctcaatacctcagacaaggcccttccaatatgtttacgttttcaaagaaatcaagtatatgaggagagcgagcgagcgtgagagaacacccgtgagagagacttgaaactgctgtcctttaaaaaaaaaaaaaatcaatgtttacattgaacaaagctgcttctgtctgtgagtttccatggtgttgacgttccactgccacattagtgtcctcgcttccaacgggttgtcccgggtgcacctcgaagtgccgggtccgtcacccatcgccccttccttcccgactgacttcctctcgtagacttgcagctgtgttcaccataacatttcttgtctgtagtgtgtgatgatgaaattgttacttgtgaatagaatcaggactataaacttcatttttaattgaaaaaaaaagtatatccttaaaataatgtatttatggctcagatgtactgtgcctgggattattgtattgcttccttgattttttaactatgcactgtcatgaggtgtttgccactgagctgccctgctccccttgccagattgccctggaggtgctgggtggccgctaggctggtctgcaggaaagcgcggcctgccgtttccgggccgtatctgccaagccctgccttgtctcttactgagcaagtttggctcaaattataggagcccccatcttgtgcccagctcatgctccaagtgtgtgtctatccatttgtactcagactcttgagtaccttgtaaggaaggcggggcaagctgcatcattcctgttttccaggggaggctggcagctcctcaagaggcgaaatgactgtgggaggtccggttaccagtgaggaggcagagcggtgacccagaccaggccttctggttcttggtcccgtgcttccgtagtagctggggtaaagacaccgtttcagggactggtagaggtgagttcggctaaattgggcaccgggctagaagcctaagggctcattttaggggttacattaggtgttgattcaccagcatcaggtgaattcaagccctggcatgtgtcttggatgcaccatcagctttgatcctgagtggtcctgcggtttgtctgtgcctgtggacacactgtcagaacttcagtgacacccctggcagcggtacagacaggtggtctgggagcagtcatcttttttgggccagccaccagcccatcctactccctcaggtagtccttcgtctttaccttgtccttgtctgtaaagttgttttggtggctggggcaggggagccaggaggagggagtgaaggttgggaatagataggacaatctcctagctctcctccaattgagaaaacactccaattgggctttgctttaaactttgtgttcttaagtgatgtcaaagccatttccagcttaatgttctgtgggtaccttgggggccattcatgcagggagcatggccaggcagggtatgagtacattgtttctgatttctttcatacatcagggttcctcgggaaatttttgtattttttttttaagtcctgctgctttaaaaatttgaaagtggctcattaaactaaacaggctaatgtaatttgttgcttatgccaagcctagactgttgagaattgacgtttttaaagattatcaaatacctcagtaggtaaaatgagcccatgatcttccactgagtggtgagcatactcccagcccatggacaaggccggaagagacaggctttagtaggggtagggaatttgaactgttgtgtgtcacagcagttgacctctctggactccaatttcctttcctgtgaaatgaactgattagacatgtttcaacattgttagcttctgctgaggcagtgtctagcccaagatggcaaatacatagctcatgtgccactactcccacctccttgaccaatacagacataactaatcaatcacaccactcaggttccctgagcctggatgtgctataagaatcctgaaatcagtgctctggtaagtcattactaattgattagagttcaatctatttgacatcttgggctaatctttggaaggtttccaacaatcacacaaaaccatatgctggctgggtttcatgctggcctatccctgtctgtgatgttccgttccatgagagaaaactcccctaatgctattccatggcgtaacactcccaatactattttgacgcccacgtccccttgcagagggtgcagggggcggtagacgaatgacagacaggaacatatttggggaaggcagggcttaggaagatggaccaaaaagggacttcccacagcacagacctgatcattcggatttcctctttagctattcactgcctagcacatagtaggcacacaataaatgattatggaatgggataaaatttagatctttctgctgcctccactaagttaagtcctgatttacatcaaggagagaactgagataggaaagaacactagattccaagtctggagagttgggggagtccagattctaccaagaatttcctttgtaactttggtaagtcccttttactccctggcaccccggtgtgctgaaaggagttggtccatatatgatctcttagcccctcctatttgcttcttccttgattgctcttggtcaaagggtcagccttgggctggtgatactttagagtaaagaaatggagagttttagcaaaggaccagtctgtccctccctgctttggggtcagctaaagctgtcctttcatgtcagattaacctaggacacttgtagttagcttagacgttggcccttgagcagagacctgagcgtggcattgggacatgacatacctaaagtcagggctaggggacgctgcctgccaagggcatcgagtagtctctacttgctatcccgtacataaaatgctacaagttctaaaatttaccgaccctgcagacaacctctatcccgaaggactcattcggtgctgtgtattatttagggcaactccaaggtctattcagaaaaacgagtgaaccttggtctctttcccaccaaattgaggagtaacccagagggagcagctgccattggcaaccatctcgttgtagctctgtcctagtgtttgctcttgatgatgtttacatgtgatcgccataaagcttgctgtagactgtgtcgatagccgcccgcacagggcaggtcgtactgtccgtttctgtgccgtgctggtgttttccaaaaatgtctgatccaaccactaagtggaattcttccatctccttcctcagtctgtacaaggctgaatcagaatccccattctcgggggctctggttaccgaaggaaaatgcatcaaagagttaaagaatatgagtggatggagtgcagctaaggcccccaccccctgctccgtcacaacttgccccctcaaccaaaaagctgctttgagtcaaaaagcacccataagatacctgcatctgccttgaaatcttgcagcatggagtgtcatatgtactcaggagagaggcagggctttgcgggcaggagaaggaagggaggaatgctctgagctgcaaagacccagtactcaagttctgacgtgggaggagatgcagtgagacgtctcttgttgcctaaagcctgttcctgttggttttcttagagtgatttctcctagacatgtgcagtaggcccactggggctgctgtgcagtggtgagtaaaagggcagggaaggcatggacagcctggtccttctgcatggacagctcagtccatggcccatcccaggtatagagttcagttaatcccatttgagcctgcagcttaagagatggctcatcctaactgtgaagcaaaatcagccccagaggatgtattgatctgactcactgatgtcaaaattgcagtatttttttagcatttgagatttagcagctgccttcagtttggggttacccacatcccagcatcagatatgattaaggaaagaaattggatgtacaacagcaaagaaagtgaatgtcatggtttccctggccaaagaagagggaccctgtcatccttaccaatggggaagaagaaaactagtgcatgtgcaatatgtcaaagttagtcccctagtccctgaggggtttttacacacagatgggctccaggtctgctcgtcaagtttggaggtaccgggtaaatggaggggagctgcagagttggaaacccacatgcatggatgtgtccttggcccagaaccaccatgggatgggggaggccctgagccggctacaagacacccaggaagtaggcaaaggctgactttgcattaaacaataaaagcactttgagaaaaccccaacacttcagcctgggtccgtgtttctacactggaaaatacgagtctcctttggctgtgtgaagtgatcttctagagactgggacagggagtttgggaatggggctgctgtcaggtaggagagagcagagatgcctttggagatgtcagcagcaggagagccagtgctggggccaaccctttgctggccttttgttggaagcccttgaaacagggagccatgggtttagatcttggtacctacctttacagaaagatgaaaacagcccagctgagtgaaatgagtttgtagagtaagtcacttaactgtaagccatctcagaatcagaaaccctaatgtttcttacttgctatgtgaccttgggcccctgtttcctcatctaccaaatgagaatgttgaatatgagcattaaagtccctttcacctctgagaggctcagatccccaaccaggagcattgggaatccatcactcctccttgaaactgattccattctctgacttgacccagctcctgttcagggtgagggttctctgcaagaaccaaccagcagtaggttcaatcccactgtgtcctggctgagttgccttatccaagaagaccagctccccgggacagatctaagccatagtttctagtggggacagtaaggaattaaacccccaacttggctaggtaacgatgtcaaatctcacattaaccttgtctttgtccccactggatagctgttaatccgaatgttgtgaccatttggctgtttctctcttgttctcagacaatactagcaatacactttttttttttttttttaaagaaaaacagcttaggagcttttcacacatttctttcaaatgattgtaaaacatatggggcaacaggaggcattgatcgcgctgcatatgtttagggcagcttttgttttttgtttctttaatggtatagcagcagtgactgagccttcgtgattcctggggacagcttttcagatactctgtttcatcagtatgctttgcacatccggaaggagtacaaaaatccaactgcccaaatttggggcttggaaaataggttttataggtggtcggtccctgggctgtgcaacaactcctcaaagaggggtttatataactagaacccccctgggctgtatttttggtcaaaggagtctccaaggcggcttacaaaagcttcctttttcacttgaccacccttgctcattggttacttgtgaagggaattggtcagtttccacctcagcactttgccttatcaacatgcggtcgccatctagtggccaaaggttgtctccaccagctacccagatggaaggcaaataaatcctttcggccaccctgctgtccatcgtgaactttgggaatgaaatataatggcctgaacgaactgcctttgtgttcagagatcagtgcaacactagggtcagaagactccagaagcagccacttagtagactctcacgcagaactgagaaatgcactagctgtcctgtgggcagaagagacaggagtggaccaggagaggtccaggtgcccgggaagggtttactgtaactgcaatactggcagcccagctgctgaccttgttaagtaaacctttgctgggtggtccgaattctgccctcaaggcaagataagaagttgggtgtaaggattttgtggggggcctggccatgatctttgatatgatccccgaatagccaaatagttttttttgttcaattttttgtttctgtattttgtatttttaaaatcttgtcaaatgtttttgtgttaggaataaaaagtcataaactattcccaactttgtttcttgagggatgttctgattccaatggaaacaggtgggaaatctcaaggggagcgtggacaaggtggtatgtgcagcaggggaatagactgcttggatttccaaatggtttctggggaagatgaccatccagaagtccagcttagtgcagtctgctctggaattcacacccaccccctcgcctccttgtgccatgttgttagcattggcttggagcatctgcttcttccagaggcagctgctaatgttgaaaccaacacgagccctctccccaaccccaggtttctaaagaaggtgtctgtagccagccttaatcaactgggcaaggtggtccctatggtcctttccagcatttccaaatcttggactcaaattattttctcttggtgtgaccacacagcctagagaattctgagcaataggagccagggctttccctgactctgcgacagggtcaaaccaaggaatggctaaacctgtgaggttttgtcatccccgggggtactactgtagggggcattatttattaggaagcttaacaaggtaactacggcctgagtgcgtgagtgtaaggctgtgtttgtggtgggggtgtgtgtgtgtgtatctgtgcacacatacacacgtctgtgcctgtgtgtgtgtgtttgtgtgtgtgtgtgtgtgtggaattacattgatgcatttattgagaaaggtgcaagaatttcacctacacagagggacacatctgctttgttatttataatagaaagctaaattttaattttttaaaggacactgctaatgattgagaatcaagtttttagttttgctattttttttaattggtagaggatttttatatattttttccattttgttgggttgtgtccttatttatataaatactttatccgtaagaggcaaggaggaaaccttctttgcttttacatattgtggttgtcatcgtccctattttatttctggtgtgatttctctgtcttaccttctaaatgagaaaatgttttcttgtatttgtacattgtcagattctatagtttcctagataatttaaccaaattgctctatgtattattattctgtgagtataaagttctattttaatgtctgtaaatacttcagaactggcttcttttctcaaactcccactgtggggttattgtttacatcacagaaactgtagaatctctatgctcatgtactgtaaatagtgaagtgatctgcttataaataaacttaacaaatacactatggagattaaaaacaaaataccacccaca

SEQ ID NO: 22029 - DNA, 4803 bp, Homo sapiens
ctcggcgttgactccgccgcacgctgcagccgcggctggaagatggcggggaacgactgcggcgcgctgctggacgaagagctctcctccttcttcctcaactatctcgctgacacgcagggtggagggtccggggaggagcaactctatgctgactttccagaacttgacctctcccagctggatgccagcgactttgactcggccacctgctttggggagctgcagtggtgcccagagaactcagagactgaacccaaccagtacagccccgatgactccgagctcttccagattgacagtgagaatgaggccctcctggcagagctcaccaagaccctggatgacatccctgaagatgacgtgggtctggctgccttcccagccctggatggtggagacgctctatcatgcacctcagcttcgcctgccccctcatctgcaccccccagccctgccccggagaagccctcggccccagcccctgaggtggacgagctctcactgctgcagaagctcctcctggccacatcctacccaacatcaagctctgacacccagaaggaagggaccgcctggcgccaggcaggcctcagatctaaaagtcaacggccttgtgttaaggcggacagcacccaagacaagaaggctcccatgatgcagtctcagagccgaagttgtacagaactacataagcacctcacctcggcacagtgctgcctgcaggatcggggtctgcagccaccatgcctccagagtccccggctccctgccaaggaggacaaggagccgggtgaggactgcccgagcccccagccagctccagcctctccccgggactccctagctctgggcagggcagaccccggtgccccggtttcccaggaagacatgcaggcgatggtgcaactcatacgctacatgcacacctactgcctcccccagaggaagctgcccccacagacccctgagccactccccaaggcctgcagcaacccctcccagcaggtcagatcccggccctggtcccggcaccactccaaagcctcctgggctgagttctccattctgagggaacttctggctcaagacgtgctctgtgatgtcagcaaaccctaccgtctggccacgcctgtttatgcctccctcacacctcggtcaaggcccaggccccccaaagacagtcaggcctcccctggtcgcccgtcctcggtggaggaggtaaggatcgcagcttcacccaagagcaccgggcccagaccaagcctgcgcccactgcggctggaggtgaaaagggaggtccgccggcctgccagactgcagcagcaggaggaggaagacgaggaagaagaggaggaggaagaggaagaagaaaaagaggaggaggaggagtggggcaggaaaaggccaggccgaggcctgccatggacgaagctggggaggaagctggagagctctgtgtgccccgtgcggcgttctcggagactgaaccctgagctgggcccctggctgacatttgcagatgagccgctggtcccctcggagccccaaggtgctctgccctcactgtgcctggctcccaaggcctacgacgtagagcgggagctgggcagccccacggacgaggacagtggccaagaccagcagctcctacggggaccccagatccctgccctggagagcccctgtgagagtgggtgtggggacatggatgaggaccccagctgcccgcagctccctcccagagactctcccaggtgcctcatgctggccttgtcacaaagcgacccaacttttggcaagaagagctttgagcagaccttgacagtggagctctgtggcacagcaggactcaccccacccaccacaccaccgtacaagcccacagaggaggatcccttcaaaccagacatcaagcatagtctaggcaaagaaatagctctcagcctcccctcccctgagggcctctcactcaaggccaccccaggggctgcccacaagctgccaaagaagcacccagagcgaagtgagctcctgtcccacctgcgacatgccacagcccagccagcctcccaggctggccagaagcgtcccttctcctgttcctttggagaccatgactactgccaggtgctccgaccagaaggcgtcctgcaaaggaaggtgctgaggtcctgggagccgtctggggttcaccttgaggactggccccagcagggtgccccttgggctgaggcacaggcccctggcagggaggaagacagaagctgtgatgctggcgccccacccaaggacagcacgctgctgagagaccatgagatccgtgccagcctcaccaaacactttgggctgctggagaccgccctggaggaggaagacctggcctcctgcaagagccctgagtatgacactgtctttgaagacagcagcagcagcagcggcgagagcagcttcctcccagaggaggaagaggaagaaggggaggaggaggaggaggacgatgaagaagaggactcaggggtcagccccacttgctctgaccactgcccctaccagagcccaccaagcaaggccaaccggcagctctgttcccgcagccgctcaagctctggctcttcaccctgccactcctggtcaccagccactcgaaggaacttcagatgtgagagcagagggccgtgttcagacagaacgccaagcatccggcacgccaggaagcggcgggaaaaggccattggggaaggccgcgtggtgtacattcaaaatctctccagcgacatgagctcccgagagctgaagaggcgctttgaagtgtttggtgagattgaggagtgcgaggtgctgacaagaaataggagaggcgagaagtacggcttcatcacctaccggtgttctgagcacgcggccctctctttgacaaagggcgctgccctgaggaagcgcaacgagccctccttccagctgagctacggagggctccggcacttctgctggcccagatacactgactacggtaagcccctgaaacccagccacagtctagtaagactcaaagcttgggaagcagtgccttccttgaacaaaacccagagctaaagcgccttgtggacatagcttccatccccacaccccagtgtgctgcttggtataactttgcagccactttgcctgaagactaccatcctgtttctcttctggcctctggtccaccttatcctgtcctgtgactgctaccaaagagaatccagcctcccacggcctctaggaagattcagtcatgtgcacagccagctggcagaaccgtggctacggtctccttgacttcacagggccagctgctaccctgtccccttcaggggcattccgtggtgaccccagacaaggcagcagccacctggggacaagatgatgaagaaggacaaagaagtacaatgtacgaaagaattacttggccaggctcagtggctcatgcctgtaatcccatcaccttgggaggctgaggcaagaggatcacttgagcccaggagttcgagaccagcttgggcaacatagtgaaatcctgtctctacaaaaaatataaaaattagccaggcatggtggcttgcgcctatagtcccagctactcaggaggcagaggtgggaggatcacctgaacccaagaggttggagctgcagtgagccatgatggcactactgcattccagcctgggcaacagagcaagaccctgtctcaaaaggaaagaaaaaaaaaaaaacacttactggagagaatccaatgcagccttgatggtacaggactgagtgtcagtgacccggctgggtgccaggccaggcggccctgcccttggctgcatgtccatttatgggaatcagtttcccaatctattaaaaaattctagtgttggctgggtgcagttgctcacgcctgtaatcccagcactttgggaggccgaggcaggaagatcatgaggtcaagagatcgagaccatcgtggccaacatggtgaaaccccctctctattaaaaatacaaaaattagctgggcgtggtggcgcacacctgtagtcccagcaacttgggaggctgaggcgggagaatcacttgaacccgagaggcagaggttgcagtgagctgagatcacatccctgcactccagccttggtgacagagcgagactgcatctcaaaaaaaaaaaaattctagtgttgttagccctcccttatgtggcactgcagcaggttactaatggacgagaagctgttgggggaagtagagttgtagggtgttggagctagaaaggctctggagtgctctagtttgggcctccaggtctctagataggacagccaaggccctgagacactgataccatggccaagatgtcccagcaggatggcaggcagtgcccacagtccagcgctcatcccagctccccaaggccttgggctgcagccactccacggtgcccactcatagtggcagattcttcaaccatccggtctttgtaagttgctcactgccttcccctcttccctgcctcttcacccccatgcccagattccaattcagaagaggcccttcctgcgtcagggaaaagcaagtatgaagccatggattttgacagcttactgaaagaggcccagcagagcctgcattgataacagccttaaccctcgaggaatacctcaatacctcagacaaggcccttccaatatgtttacgttttcaaagaaatcaagtatatgaggagagcgagcgagcgtgagagaacacccgtgagagagacttgaaactgctgtccttt

SEQ ID NO: 22030 - DNA, 471 bp, Homo sapiens
atggccgtagggaagttcctgctgggctccctgctgctcctgtccctgcagctgggacagggctggggccccgatgcccgtggggttcccgtggccgatggagagttctcgtctgaacaggtggcaaaggctggagggacctggctgggcacccaccgcccccttgcccgcctgcgccgagccctgtctggtccatgccagctgtggagcctgaccctgtccgtggcagagctaggcctgggctacgcctcagaggagaaggtcatcttccgctactgcgccggcagctgcccccgtggtgcccgcacccagcatggcctggcgctggcccggctgcagggccagggccgagcccacggcgggccctgctgccggcccactcgctacaccgacgtggccttcctcgatgaccgccaccgctggcagcggctgccccagctctcggcggctgcctgcggctgtggtggctga

SEQ ID NO: 22031 - DNA, 1657 bp, Homo sapiens
gcccgcctgatgtcgtcccacgccgtgccggctctcaggcgccggaagtgagctgcgcagcgccggaagcggcggacgcaggaggcctcgtggaggacacagcagcatgggacagtcagggaggtcccggcaccagaagcgcgcccgcgcccaggcgcagctccgcaacctcgaggcctatgccgcgaacccgcactcgttcgtgttcacgcgaggctgcacgggtcgcaacatccggcagctcagcctggacgtgcggcgggtcatggagccgctcactgccagccgtctgcaggttcgtaagaagaactcgctgaaggactgcgtggcagtggctgggcccctcggggtcacacactttctgatcctgagcaaaacagagaccaatgtctactttaagctgatgcgcctcccaggaggccccaccttgaccttccaggtcaagaagtactcgctggtgcgtgatgtggtctcctcactgcgccggcaccgcatgcacgagcagcagtttgcccacccacccctcctggtactcaacagctttggcccccatggtatgcatgtgaagctcatggccaccatgttccagaacctgttcccctccatcaacgtgcacaaggtgaacctgaacaccatcaagcgctgcctcctcatcgactacaaccccgactcccaggagctggacttccgccactatagcatcaaagttgttcctgtgggcgcgagtcgcgggatgaagaagctgctccaggagaagttccccaacatgagccgcctgcaggacatcagcgagctgctggccacgggcgcggggctgtcggagagcgaggcagagcctgacggcgaccacaacatcacagagctgcctcaggctgtcgctggccgtggcaacatgcgggcccagcagagtgcagtgcggctcaccgagatcggcccgcggatgacactgcagctcatcaaggtccaggagggcgtcggggagggcaaagtgatgttccacagttttgtgagcaagacggaggaggagctgcaggccatcctggaagccaaggagaagaagctgcggctgaaggcgcagaggcaggcccagcaggcccagaatgtgcagcgcaagcaggagcagcgggaggcccacagaaagaagagcctggagggcatgaagaaggcacgggtcgggggtagtgatgaagaggcctctgggatcccttcaaggacggcgagcctggagttgggtgaggacgatgatgaacaggaagatgatgacatcgagtatttctgccaggcggtgggcgaggcgcccagtgaggacctgttccccgaggccaagcagaaacggcttgccaagtctccagggcggaagcggaagcggtgggaaatggatcgaggcaggggtcgcctttgtgaccagaagtttcccaagaccaaggacaagtcccagggagcccaggccaggcgggggcccagaggggcttcccgggatggtgggcgaggccggggccggggccgcccagggaagagagtggcctgagcccaagccgcaccggagcagcggctggattgaacgccccagattggggcccgagatgtggccctcggtttcctttcataaaggagttgtgtccccagcccttccactccagtaaagaactgaattggc

SEQ ID NO: 22032 - DNA, 1410 bp, Homo sapiens
aggaggcctcgtggaggacacagcagcatgggacagtcagggaggtcccggcaccagaagcgcgcccgcgcccaggcgcagctccgcaacctcgaggcctatgccgcgaacccgcactcgttcgtgttcacgcgaggctgcacgggtcgcaacatccggcagctcagcctggacgtgcggcgggtcatggagccgctcactgccagccgtctgcaggttcgtaagaagaactcgctgaaggactgcgtggcagtggctgggcccctcggggtcacacactttctgatcctgagcaaaacagagaccaatgtctactttaagctgatgcgcctcccaggaggccccaccttgaccttccaggtcaagaagtactcgctggtgcgtgatgtggtctcctcactgcgccggcaccgcatgcacgagcagcagtttgcccacccacccctcctggtactcaacagctttggcccccatggtatgcatgtgaagctcatggccaccatgttccagaacctgttcccctccatcaacgtgcacaaggtgaacctgaacaccatcaagcgctgcctcctcatcgactacaaccccgactcccaggagctggacttccgccactatagcatcaaagttgttcctgtgggcgcgagtcgcgggatgaagaagctgctccaggagaagttccccaacatgagccgcctgcaggacatcagcgagctgctggccacgggcgcggggctgtcggagagcgaggcagagcctgacggcgaccacaacatcacagagctgcctcaggctgtcgctggccgtggcaacatgcgggcccagcagagtgcagtgcggctcaccgagatcggcccgcggatgacactgcagctcatcaaggtccaggagggcgtcggggagggcaaagtgatgttccacagttttgtgagcaagacggaggaggagctgcaggccatcctggaagccaaggagaagaagctgcggctgaaggcgcagaggcaggcccagcaggcccagaatgtgcagcgcaagcaggagcagcgggaggcccacagaaagaagagcctggagggcatgaagaaggcacgggtcgggggtagtgatgaagaggcctctgggatcccttcaaggacggcgagcctggagttgggtgaggacgatgatgaacaggaagatgatgacatcgagtatttctgccaggcggtgggcgaggcgcccagtgaggacctgttccccgaggccaagcagaaacggcttgccaagtctccagggcggaagcggaagcggtgggaaatggatcgaggcaggggtcgcctttgtgaccagaagtttcccaagaccaaggacaagtcccaggatggtgggcgaggccggggccggggccgcccagggaagagagtggcctga

SEQ ID NO: 22033 - DNA, 2412 bp, Homo sapiens
aggaggcctcgtggaggacacagcagcatgggacagtcagggaggtcccggcaccagaagcgcgcccgcgcccaggcgcagctccgcaacctcgaggcctatgccgcgaacccgcactcgttcgtgttcacgcgaggctgcacgggtcgcaacatccggcagctcagcctggacgtgcggcgggtcatggagccgctcactgccagccgtctgcaggttcgtaagaagaactcgctgaaggactgcgtggcagtggctgggcccctcggggtcacacactttctgatcctgagcaaaacagagaccaatgtctactttaagctgatgcgcctcccaggaggccccaccttgaccttccaggtcaagaagtactcgctggtgcgtgatgtggtctcctcactgcgccggcaccgcatgcacgagcagcagtttgcccacccacccctcctggtactcaacagctttggcccccatggtatgcatgtgaagctcatggccaccatgttccagaacctgttcccctccatcaacgtgcacaaggtgaacctgaacaccatcaagcgctgcctcctcatcgactacaaccccgactcccaggagctggacttccgccactatagcatcaaagttgttcctgtgggcgcgagtcgcgggatgaagaagctgctccaggagaagttccccaacatgagccgcctgcaggacatcagcgagctgctggccacgggcgcggggctgtcggagagcgaggcagagcctgacggcgaccacaacatcacagagctgcctcaggctgtcgctggccgtggcaacatgcgggcccagcagagtgcagtgcggctcaccgagatcggcccgcggatgacactgcagctcatcaaggtccaggagggcgtcggggagggcaaagtgatgttccacagttttgtgagcaagacggaggaggagctgcaggccatcctggaagccaaggagaagaagctgcggctgaaggcgcagaggcaggcccagcaggcccagaatgtgcagcgcaagcaggagcagcgggaggcccacagaaagaagagcctggagggcatgaagaaggcacgggtcgggggtagtgatgaagaggcctctgggatcccttcaaggacggcgagcctggagttgggtgaggacgatgatgaacaggaagatgatgacatcgagtatttctgccaggcggtgggcgaggcgcccagtgaggacctgttccccgaggccaagcagaaacggcttgccaagtctccagggcggaagcggaagcggtgggaaatggatcgaggtgccaagtcctgccctgccaacttcttggcagctgccgacgacaaactcagtgggttccagggggacttcctgtggcccatactggtggttgagttcctggtggccgtggccagcaatggcctggccctgtaccgcttcagcatccggaagcagcgcccatggcaccccgccgtggtcttctctgtccagctggcagtcagcgacctgctctgcgccctgacgctgcccccgctggccgcctacctctatccccccaagcactggcgctatggggaggccgcgtgccgcctggagcgcttcctcttcacctgcaacctgctgggcagcgtcatcttcatcacctgcatcagcctcaaccgctacctgggcatcgtgcaccccttcttcgcccgaagccacctgcgacccaagcacgcctgggccgtgagcgctgccggctgggtcctggccgccctgctggccatgcccacactcagcttctcccacctgaagaggccgcagcagggggcgggcaactgcagcgtggccaggcccgaggcctgcatcaagtgtctggggacagcagaccacgggctggcggcctacagagcgtatagcctggtgctggcggggttgggctgcggcctgccgctgctgctcacgctggcagcctacggcgccctcgggcgggccgtgctacgcagcccaggcatgactgtggccgagaagctgcgtgtggcagcgttggtggccagtggtgtggccctctacgccagctcctatgtgccctaccacatcatgcgggtgctcaacgtggatgctcggcggcgctggagcacccgctgcccgagctttgcagacatagcccaggccacagcagccctggagctggggccctacgtgggctaccaggtgatgcggggcctcatgcccctggccttctgtgtccaccctctactctacatggccgcagtgcccagcctgggctgctgctgccgacactgccccggctacagggacagctggaacccagaggacgccaagagcactggccaagccctgcccctcaatgccacagccgcccctaaaccgtcagagccccagtcccgtgagctgagccaatga

SEQ ID NO: 22034 - DNA, 2224 bp, Homo sapiens
caccctcccccccaaccggtccgtccctcccctccctccctcccccccgccgcctcctcctcctgccgctgccgctgctttggctgctgcgtcatacgccccagagccgccgggacggaggggctgggcctggggaccccccggcctccgcctgcacgcccccccacgcccggacgtgccctctccgcgcgggggactcgcctaggtctcctacgtctgcccctgcccggctcccggcggccccagctgtcaccggcccccccaggatgcaatggcgcagcccccccggctgagccgctctggtgcctcctcactttgggacccagcttctcctgctcccacctctggccccaggcctcggctttgggagggtcaagatgtgctggccagatggactgatgggctgctatacttgggtaccatcaaaaaggtggacagtgctagggaggtgtgtctggtccagtttgaggatgattcgcagtttctggttctatggaaagacattagccctgctgccctccctggagaggaactcctctgttgtgtctgtcgctctgagactgtggtccctgggaaccggctggtcagctgtgagaagtgtcgccatgcttatcaccaggactgccatgttcccagggctccagcccctggagagggagagggcacatcctgggtatgccgccagtgtgtctttgcgatcgccaccaagaggggaggtgccctgaagaagggcccctatgcccgggccatgctgggtatgaagctttctctgccatatggactgaaggggctggactgggatgctggacatctgagcaaccgacagcagagttactgttactgtggtggccctggggagtggaacctgaaaatgctgcagtgccggagctgcctgcagtggttccatgaggcctgcacccagtgtctgagcaagcccctcctctatggggacaggttctatgaatttgaatgctgtgtgtgtcgcgggggccctgagaaagtccggagactacagcttcgctgggtggatgtggcccatcttgtcctgtatcacctcagtgtttgctgtaagaagaaatactttgattttgatcgtgagatcctccccttcacttctgagaattgggacagtttgctcctgggggagctttcagacacccccaaaggagaacgttcttccaggctcctctctgctcttaacagccacaaggaccgtttcatttcagggagagagattaagaagaggaaatgtttgtttggtctccatgctcggatgcctccccctgtggagccccctactggagatggagcactcaccagggcagggccctgggggaggggtctcacgtcccctggggaagcgccggaggccggagccagagcccctgaggaggaggcagaaggggaaagtggaggagctggggccaccctcagcagtgcgcaatcagcccgagccccaggagcagagggagcgggctcatctgcagagggcactgcagcagccccatccggatgtttgcttccttccacccttctgccagcaccgcagggacctctggggacagtggacccccagacaggtcacccctggaacttcacattggtttccccacagacatccctaaaagtgccccccactcgatgactgcctcatcttcctcagtttcatccccatccccaggtcttcctagacgctcagcacccccttctcccctgtgccgtagtttgtctcctgggactgggggaggagtccgaggtggggttggttacctgtcccgaggggaccctgtccgggtccttgctcggagagtacggcctgatggctctgtgcagtacctggttgagtggggaggagggggcatcttctgaacagcctgcctctgcccagctccccattcacacacaccggcactttcataccctgacctctgacctcacctacagctgggatgtacctggagagatagggggtagttctccctactgcccaggctggaatccaagagtggggagtggggaagaggccctcttctctaccctccttcatgattcctgacccctcccatccttcccatttcctttgatgttattttgttacagctttttaaatattttttaaaattatttaacccctgggggcagagactgaggagggaggatgataagggatcccggactctgtatgattgaaataaagagaaataaacaaatctagcagctctga

SEQ ID NO: 22035 - DNA, 2330 bp, Homo sapiens
caccctcccccccaaccggtccgtccctcccctccctccctcccccccgccgcctcctcctcctgccgctgccgctgctttggctgctgcgtcatacgccccagagccgccgggacggaggggctgggcctggggaccccccggcctccgcctgcacgcccccccacgcccggacgtgccctctccgcgcgggggactcgcctaggtctcctacgtctgcccctgcccggctcccggcggccccagctgtcaccggcccccccaggatgcaatggcgcagcccccccggctgagccgctctggtgcctcctcactttgggacccagcttctcctgctcccacctctggccccaggcctcggctttgggagggtcaagatgtgctggccagatggactgatgggctgctatacttgggtaccatcaaaaaggtggacagtgctagggaggtgtgtctggtccagtttgaggatgattcgcagtttctggttctatggaaagacattagccctgctgccctccctggagaggaactcctctgttgtgtctgtcgctctgagactgtggtccctgggaaccggctggtcagctgtgagaagtgtcgccatgcttatcaccaggactgccatgttcccagggctccagcccctggagagggagagggcacatcctgggtatgccgccagtgtgtctttgcgatcgccaccaagaggggaggtgccctgaagaagggcccctatgcccgggccatgctgggtatgaagctttctctgccatatggactgaaggggctggactgggatgctggacatctgagcaaccgacagcagagttactgttactgtggtggccctggggagtggaacctgaaaatgctgcagtgccggagctgcctgcagtggttccatgaggcctgcacccagtgtctgagcaagcccctcctctatggggacaggttctatgaatttgaatgctgtgtgtgtcgcgggggccctgagaaagtccggagactacagcttcgctgggtggatgtggcccatcttgtcctgtatcacctcagtgtttgctgtaagaagaaatactttgattttgatcgtgagatcctccccttcacttctgagaattgggacagtttgctcctgggggagctttcagacacccccaaaggagaacgttcttccaggctcctctctgctcttaacagccacaaggaccgtttcatttcagggagagagattaagaagaggaaatgtttgtttggtctccatgctcggatgcctccccctgtggagccccctactggagatggagcactcaccagcttcccttcagggcagggccctgggggaggggtctcacgtcccctggggaagcgccggaggccggagccagagcccctgaggaggaggcagaaggggaaagtggaggagctggggccaccctcagcagtgcgcaatcagcccgagccccaggagcagagggagcgggctcatctgcagagggcactgcaggcctcagtgtctccaccatcccccagccctaaccagagttaccagggcagcagcggctacaacttccggcccacagatgcccgctgcctgcccagcagccccatccggatgtttgcttccttccacccttctgccagcaccgcagggacctctggggacagtggacccccagacaggtcacccctggaacttcacattggtttccccacagacatccctaaaagtgccccccactcgatgactgcctcatcttcctcagtttcatccccatccccaggtcttcctagacgctcagcacccccttctcccctgtgccgtagtttgtctcctgggactgggggaggagtccgaggtggggttggttacctgtcccgaggggaccctgtccgggtccttgctcggagagtacggcctgatggctctgtgcagtacctggttgagtggggaggagggggcatcttctgaacagcctgcctctgcccagctccccattcacacacaccggcactttcataccctgacctctgacctcacctacagctgggatgtacctggagagatagggggtagttctccctactgcccaggctggaatccaagagtggggagtggggaagaggccctcttctctaccctccttcatgattcctgacccctcccatccttcccatttcctttgatgttattttgttacagctttttaaatattttttaaaattatttaacccctgggggcagagactgaggagggaggatgataagggatcccggactctgtatgattgaaataaagagaaataaacaaatctagcagctctga

SEQ ID NO: 22036 - DNA, 728 bp, Homo sapiens
ctctctgctcttaacagccacaaggaccgtttcatttcagggagagagattaagaagaggaaatgtttgtttggtctccatgctcggatgcctccccctgtggagccccctactggagatggagcactcaccagggcagggccctgggggaggggtctcacgtcccctggggaagcgccggaggccggagccagagcccctgaggaggaggcagaaggggaaagtggaggagctggggccaccctcagcagtgcgcaatcagcccgagccccaggagcagagggagcgggctcatctgcagagggcactgcaggcctcagtgtctccaccatcccccagccctaaccagagttaccagggcagcagcggctacaacttccggcccacagatgcccgctgcctgcccagccccatccggatgtttgcttccttccacccttctgccagcaccgcagggacctctggggacagtggacccccagacaggtcacccctggaacttcacattggtttccccacagacatccctaaaagtgccccccactcgatgactgcctcatcttcctcagtttcatccccatccccaggtcttcctagacgctcagcacccccttctcccctgtgccgtagtttgtctcctgggactgggggaggagtccgaggtggggttggttacctgtcccgaggggaccctgtccgggtccttgctcggagagtacggcctgatg

SEQ ID NO: 22037 - DNA, 609 bp, Homo sapiens
aagcacggggcgggacgtccacgggaagcggcgcgcacgcccgccgactccctcgcgccaaccgccgacggccgccgcccggtgaaggaggggctcagtcctcccaggtctcctacgtctgcccctgcccggctcccggcggccccagctgtcaccggcccccccaggatgcaatggcgcagcccccccggctgagccgctctggtgcctcctcactttgggacccagcttctcctgctcccacctctggccccaggcctcggctttgggagggtcaagatgtgctggccagatggactgatgggctgctatacttgggtaccatcaaaaaggtggacagtgctagggaggtgtgtctggtccagtttgaggatgattcgcagtttctggttctatggaaagacattagccctgctgccctccctggagaggaactcctctgttgtgtctgtcgctctgagactgtggtccctgggaaccggctggtcagctgtgagaagtgtcgccatgcttatcaccaggactgccatgttcccagggctccagcccctggagagggagagggcacatcctgggtatgccgccagtgtgtctttgcgatcgccacca

SEQ ID NO: 22038 - DNA, 862 bp, Homo sapiens
tggggccaccctcagcagtgcgcaatcagcccgagccccaggagcagagggagcgggctcatctgcagagggcactgcaggcctcagtgtctccaccatcccccagccctaaccagagttaccagggcagcagcggctacaacttccggcccacagatgcccgctgcctgcccaggtcaccccatccggatgtttgcttccttccacccttctgccagcaccgcagggacctctggggacagtggacccccagacaggtcacccctggaacttcacattggtttccccacagacatccctaaaagtgccccccactcgatgactgcctcatcttcctcagtttcatccccatccccaggtcttcctagacgctcagcacccccttctcccctgtgccgtagtttgtctcctgggactgggggaggagtccgaggtggggttggttacctgtcccgaggggaccctgtccgggtccttgctcggagagtacggcctgatggctctgtgcagtacctggttgagtggggaggagggggcatcttctgaacagcctgcctctgcccagctccccattcacacacaccggcactttcataccctgacctctgacctcacctacagctgggatgtacctggagagatagggggtagttctccctactgcccaggctggaatccaagagtggggagtggggaagaggccctcttctctaccctccttcatgattcctgacccctcccatccttcccatttcctttgatgttattttgttacagctttttaaatattttttaaaattatttaacccctgggggcagagactgaggagggaggatgataagggatcccggactctgtatg

SEQ ID NO: 22039 - DNA, 609 bp, Homo sapiens; identical to SEQ ID NO: 22037

SEQ ID NO: 22040 - DNA, 2330 bp, Homo sapiens
caccctcccccccaaccggtccgtccctcccctccctccctcccccccgccgcctcctcctcctgccgctgccgctgctttggctgctgcgtcatacgccccagagccgccgggacggaggggctgggcctggggaccccccggcctccgcctgcacgcccccccacgcccggacgtgccctctccgcgcgggggactcgcctaggtctcctacgtctgcccctgcccggctcccggcggccccagctgtcaccggcccccccaggatgcaatggcgcagcccccccggctgagccgctctggtgcctcctcactttgggacccagcttctcctgctcccacctctggccccaggcctcggctttgggagggtcaagatgtgctggccagatggactgatgggctgctatacttgggtaccatcaaaaaggtggacagtgctagggaggtgtgtctggtccagtttgaggatgattcgcagtttctggttctatggaaagacattagccctgctgccctccctggagaggaactcctctgttgtgtctgtcgctctgagactgtggtccctgggaaccggctggtcagctgtgagaagtgtcgccatgcttatcaccaggactgccatgttcccagggctccagcccctggagagggagagggcacatcctgggtatgccgccagtgtgtctttgcgatcgccaccaagaggggaggtgccctgaagaagggcccctatgcccgggccatgctgggtatgaagctttctctgccatatggactgaaggggctggactgggatgctggacatctgagcaaccgacagcagagttactgttactgtggtggccctggggagtggaacctgaaaatgctgcagtgccggagctgcctgcagtggttccatgaggcctgcacccagtgtctgagcaagcccctcctctatggggacaggttctatgaatttgaatgctgtgtgtgtcgcgggggccctgagaaagtccggagactacagcttcgctgggtggatgtggcccatcttgtcctgtatcacctcagtgtttgctgtaagaagaaatactttgattttgatcgtgagatcctccccttcacttctgagaattgggacagtttgctcctgggggagctttcagacacccccaaaggagaacgttcttccaagctcctctctgctcttaacagccacaaggaccgtttcatttcagggagagagattaagaagaggaaatgtttgtttggtctccatgctcggatgcctccccctgtggagccccctactggagatggagcactcaccagcttcccttcagggcagggccctgggggaggggtctcacgtcccctggggaagcgccggaggccggagccagagcccctgaggaggaggcagaaggggaaagtggaggagctggggccaccctcagcagtgcgcaatcagcccgagccccaggagcagagggagcgggctcatctgcagagggcactgcaggcctcagtgtctccaccatcccccagccctaaccagagttaccagggcagcagcggctacaacttccggcccacagatgcccgctgcctgcccagcagccccatccggatgtttgcttccttccacccttctgccagcaccgcagggacctctggggacagtggacccccagacaggtcacccctggaacttcacattggtttccccacagacatccctaaaagtgccccccactcgatgactgcctcatcttcctcagtttcatccccatccccaggtcttcctagacgctcagcacccccttctcccctgtgccgtagtttgtctcctgggactgggggaggagtccgaggtggggttggttacctgtcccgaggggaccctgtccgggtccttgctcggagagtacggcctgatggctctgtgcagtacctggttgagtggggaggagggggcatcttctgaacagcctgcctctgcccagctccccattcacacacaccggcactttcataccctgacctctgacctcacctacagctgggatgtacctggagagatagggggtagttctccctactgcccaggctggaatccaagagtggggagtggggaagaggccctcttctctaccctccttcatgattcctgacccctcccatccttcccatttcctttgatgttattttgttacagctttttaaatattttttaaaattatttaacccctgggggcagagactgaggagggaggatgataagggatcccggactctgtatgattgaaataaagagaaataaacaaatctagcagctctga

SEQ ID NO: 22041 - DNA, 836 bp, Homo sapiens
ttccctcgtgccccaagggcgaatctcaggtcggaggaaggggctgaggggattccctctcccaccgggtccgactcttcgctccccaagccgcggagggccagcctcttcttcggcgccctccaggcctgttggaggcccccccaggatgcaatggcgcagcccccccggctgagccgctctggtgcctcctcactttgggacccagcttctcctgctcccacctctggccccaggcctcggctttgggagggtcaagatgtgctggccagatggactgatgggctgctatacttgggtaccatcaaaaaggtggacagtgctagggaggtgtgtctggtccagtttgaggatgattcgcagtttctggttctatggaaagacattagccctgctgccctccctggagaggaactcctctgttgtgtctgtcgctctgagactgtggtccctgggaaccggctggtcagctgtgagaagtgtcgccatgcttatcaccaggactgccatgttcccagggctccagcccctggagagggagagggcacatcctgggtatgccgccagtgtgtctttgcgatcgccaccaagaggggaggtgccctgaagaagggcccctatgcccgggccatgctgggtatgaagctttctctgccatatggactgaaggggctggactgggatgctggacatctgagcaaccgacagcagagttactgttactgtggtggccctggggagtggaacctgaaaatgctgcagtgccggagctgcctgcagtggttccatgaggcctgcacccagtgtctgagcaagcccctcctctatggggacag

SEQ ID NO: 22042 - DNA, 836 bp, Homo sapiens; identical to SEQ ID NO: 22041

SEQ ID NO: 22043 - DNA, 2224 bp, Homo sapiens
caccctcccccccaaccggtccgtccctcccctccctccctcccccccgccgcctcctcctcctgccgctgccgctgctttggctgctgcgtcatacgccccagagccgccgggacggaggggctgggcctggggaccccccggcctccgcctgcacgcccccccacgcccggacgtgccctctccgcgcgggggactcgcctaggtctcctacgtctgcccctgcccggctcccggcggccccagctgtcaccggcccccccaggatgcaatggcgcagcccccccggctgagccgctctggtgcctcctcactttgggacccagcttctcctgctcccacctctggccccaggcctcggctttgggagggtcaagatgtgctggccagatggactgatgggctgctatacttgggtaccatcaaaaaggtggacagtgctagggaggtgtgtctggtccagtttgaggatgattcgcagtttctggttctatggaaagacattagccctgctgccctccctggagaggaactcctctgttgtgtctgtcgctctgagactgtggtccctgggaaccggctggtcagctgtgagaagtgtcgccatgcttatcaccaggactgccatgttcccagggctccagcccctggagagggagagggcacatcctgggtatgccgccagtgtgtctttgcgatcgccaccaagaggggaggtgccctgaagaagggcccctatgcccgggccatgctgggtatgaagctttctctgccatatggactgaaggggctggactgggatgctggacatctgagcaaccgacagcagagttactgttactgtggtggccctggggagtggaacctgaaaatgctgcagtgccggagctgcctgcagtggttccatgaggcctgcacccagtgtctgagcaagcccctcctctatggggacaggttctatgaatttgaatgctgtgtgtgtcgcgggggccctgagaaagtccggagactacagcttcgctgggtggatgtggcccatcttgtcctgtatcacctcagtgtttgctgtaagaagaaatactttgattttgatcgtgagatcctccccttcacttctgagaattgggacagtttgctcctgggggagctttcagacacccccaaaggagaacgttcttccaagctcctctctgctcttaacagccacaaggaccgtttcatttcagggagagagattaagaagaggaaatgtttgtttggtctccatgctcggatgcctccccctgtggagccccctactggagatggagcactcaccagggcagggccctgggggaggggtctcacgtcccctggggaagcgccggaggccggagccagagcccctgaggaggaggcagaaggggaaagtggaggagctggggccaccctcagcagtgcgcaatcagcccgagccccaggagcagagggagcgggctcatctgcagagggcactgcagcagccccatccggatgtttgcttccttccacccttctgccagcaccgcagggacctctggggacagtggacccccagacaggtcacccctggaacttcacattggtttccccacagacatccctaaaagtgccccccactcgatgactgcctcatcttcctcagtttcatccccatccccaggtcttcctagacgctcagcacccccttctcccctgtgccgtagtttgtctcctgggactgggggaggagtccgaggtggggttggttacctgtcccgaggggaccctgtccgggtccttgctcggagagtacggcctgatggctctgtgcagtacctggttgagtggggaggagggggcatcttctgaacagcctgcctctgcccagctccccattcacacacaccggcactttcataccctgacctctgacctcacctacagctgggatgtacctggagagatagggggtagttctccctactgcccaggctggaatccaagagtggggagtggggaagaggccctcttctctaccctccttcatgattcctgacccctcccatccttcccatttcctttgatgttattttgttacagctttttaaatattttttaaaattatttaacccctgggggcagagactgaggagggaggatgataagggatcccggactctgtatgattgaaataaagagaaataaacaaatctagcagctctga

SEQ ID NO: 22044 - DNA, 1719 bp, Homo sapiens
gggggcggggccggggcggcggggggcccgcgcggcggcggcggcggcggcggcggcagcggcggcggcggccgggacaaggcggaggcgacggcggcggcggcggcgcggggcgctcgggctgatggcggcggcggccgggcccggggctgcgctgtccccgcggccgtgcgacagcgacccagccacccccggagcgcagtccccgaaggatgataatgaagataattcaaatgatgggacccagccatccaaaaggaggcgaatgggctcaggagatagttctaggagttgtgaaacttcaagtcaagatcttggttttagttactatccagcagaaaacttgatagagtacaaatggccacctgatgaaacaggagaatactatatgcttcaagaacaagtcagtgaatatttgggtgtgacctcctttaaaaggaaatatccagatttagagcgacgagatttgtctcacaaggagaaactctacctgagagagctaaatgtcattactgaaactcagtgcactctaggcttaacagcattgcgcagtgatgaagtgattgatttaatgataaaagaatatccagccaaacatgctgagtattctgttattctacaagaaaaagaacgtcaacgaattacagaccattataaagagtattcccaaatgcaacaacagaatactcagaaagttgaagccagtaaagtgcctgagtatattaagaaagctgccaaaaaagcagcagaatttaatagcaacttaaaccgggaacgcatggaagaaagaagagcttattttgacttgcagacacatgttatccaggtacctcaagggaagtacaaagttttgccaacagagcgaacaaaggtcagttcttacccagtggctctcatccccggacagttccaggaatattataagaggtactcaccagatgagctgcggtatctgccattaaacacagccctgtatgagccccctctggatcctgagctccctgctctagacagtgatggtgattcagatgatggcgaagatggtcgaggtgatgagaaacggaaaaataaaggcacttcggacagctcctctggcaatgtatctgaaggggaaagccctcctgacagccaggaggactctttccagggaagacagaaatcaaaagacaaagctgccactccaagaaaagatggtcccaaacgttctgtactgtccaagtcagttcctgggtacaagccaaaggtcattccaaatgctatatgtggaatttgtctgaagggtaaggagtccaacaagaaaggaaaggctgaatcacttatacactgctcccaatgtgagaatagtggccatccttcttgcctggatatgacaatggagcttgtttctatgattaagacctacccatggcagtgtatggaatgtaaaacatgcattatatgtggacaaccccaccatgaagaagaaatgatgttctgtgatatgtgtgacagaggttatcatactttttgtgtgggccttggtgctattccatcaggtcgctggatttgtgactgttgtcagcgggcccccccaacacccaggaaagtgggcagaagggggaaaaacagcaaagagggataaaatagtttttgactctaatactgtatatgcatttaagtggaatatttggtgccatttacaacattattttcatgccaataaaagattttttttgcaaa

SEQ ID NO: 22045 - DNA, 1589 bp, Homo sapiens
atggcggcggcggccgggcccggggctgcgctgtccccgcggccgtgcgacagcgacccagccacccccggagcgcagtccccgaaggatgataatgaagataattcaaatgatgggacccagccatccaaaaggaggcgaatgggctcaggagatagttctaggagttgtgaaacttcaagtcaagatcttggttttagttactatccagcagaaaacttgatagagtacaaatggccacctgatgaaacaggagaatactatatgcttcaagaacaagtcagtgaatatttgggtgtgacctcctttaaaaggaaatatccagagcgacgagatttgtctcacaaggagaaactctacctgagagagctaaatgtcattactgaaactcagtgcactctaggcttaacagcattgcgcagtgatgaagtgattgatttaatgataaaagaatatccagccaaacatgctgagtattctgttattctacaagaaaaagaacgtcaacgaattacagaccattataaagagtattcccaaatgcaacaacagaatactcagaaagttgaagccagtaaagtgcctgagtatattaagaaagctgccaaaaaagcagcagaatttaatagcaacttaaaccgggaacgcatggaagaaagaagagcttattttgacttgcagacacatgttatccaggtacctcaagggaagtacaaagttttgccaacagagcgaacaaaggtcagttcttacccagtggctctcatccccggacagttccaggaatattataagaggtactcaccagatgagctgcggtatctgccattaaacacagccctgtatgagccccctctggatcctgagctccctgctctagacagtgatggtgattcagatgatggcgaagatggtcgaggtgatgagaaacggaaaaataaaggcacttcggacagctcctctggcaatgtatctgaaggggaaagccctcctgacagccaggaggactctttccagggaagacagaaatcaaaagacaaagctgccactccaagaaaagatggtcccaaacgttctgtactgtccaagtcagttcctgggtacaagccaaaggtcattccaaatgctatatgtggaatttgtctgaagggtaaggagtccaacaagaaaggaaaggctgaatcacttatacactgctcccaatgtgagaatagtggccatccttcttgcctggatatgacaatggagcttgtttctatgattaagacctacccatggcagtgtatggaatgtaaaacatgcattatatgtggacaaccccaccatgaagaagaaatgatgttctgtgatatgtgtgacagaggttatcatactttttgtgtgggccttggtgctattccatcaggtcgctggatttgtgactgttgtcagcgggcccccccaacacccaggaaagtgggcagaagggggaaaaacagcaaagagggataaaatagtttttgactctaatactgtatatgcatttaagtggaatatttggtgccatttacaacattattttcatgccaataaaagattttttttgcaaa

SEQ ID NO: 22046 - DNA, 1471 bp, Homo sapiens
agcccagtgcttccaccacaaccgatgtcaactctcctagcgcccctccgctcaccggtaaaccaggacagtggaggggcgccctgatgcgggcaagactcagccaaaggtggaaaagttgaaggggtgttcccagcagagaggatgacacaaaggcaccaaaccacaaaacgtcacacgtaaacatcatacgtggcaaccacaagccaatcagttggatatttcattcattggtatacatatggactgtaaggtgtctttcaggttgcagaaaagatggaaaaaaggacatgtgcactctgccccaaagatgtcgaatataatgtcctatactttgcacaatcagagaatatagctgctcatgagaattgtttgctgtattcttcaggacttgtggaatgtgaggatcaggatccacttaatcctgatagaagttttgatgtggaatcagtaaagaaagaaatccagagaggaaggaagttgaaatgcaaattttgtcataaaagaggagccaccgtgggatgtgatttaaaaaactgtaacaagaattaccactttttctgtgccaagaaggacgacgcagttccacagtctgatggagttcgaggaatttataaactgctttgccagcaacatgctcaattcccgatcatcgctcaaagtgctaaattttcaggagtgaaaagaaaaagaggaaggaagaaacccctctcaggcaatcatgtacagccacccgaaacaatgaaatgtaatacattcataagacaagtgaaagaagagcatggcagacacacagatgcaactgtgaaagttccttttcttaagaaatgcaaggaagcaggacttcttaattacttacttgaagaaatattagacaaagttcattcaattccagaaaaactcatggatgagactacttcagaatcagactatgaagaaatcgggagtgcactttttgactgtagattgttcgaagacacatttgtaaattttcaagcagcaatagagaaaaaaattcatgcatctcaacaaaggtggcagcagttgaaggaagagattgagctacttcaggacttaaaacaaaccttgtgctcttttcaagaaaatagagatcttatgtcaagttctacatcaatatcatccctgtcttattagggattaccgtttcctaagccaagagtcatgtcaaattgcaatcaggctcaaaaccagagaccaggctgtgaaatccacacatctttagaactagtcgtctcctcttggcctcagcagctcttccctgttcttactggttgacattttgatcactctttgcacactcttgtgttttttgctcactgtcacattcccagcacctagtatgctcagtaaatgtttgtggaataagtgcataaaatgttcttaacctttgattctacttacagcccatgatagcctcttagatataataaatttggattatactacttta

SEQ ID NO: 22047 - DNA, 1359 bp, Homo sapiens
gatctcgctatccggccgccacccgcagctgcagcacagtcatggcccaggcgtcgccgccccggcccgagagggtgctcggcgccagcagcccggaggcccggcccgcgcaggaggcgctcctccttcccaccggtgtctttcaggttgcagaaaagatggaaaaaaggacatgtgcactctgccccaaagatgtcgaatataatgtcctatactttgcacaatcagagaatatagctgctcatgagaattgtttgctgtattcttcaggacttgtggaatgtgaggatcaggatccacttaatcctgatagaagttttgatgtggaatcagtaaagaaagaaatccagagaggaaggaagttgaaatgcaaattttgtcataaaagaggagccaccgtgggatgtgatttaaaaaactgtaacaagaattaccactttttctgtgccaagaaggacgacgcagttccacagtctgatggagttcgaggaatttataaactgctttgccagcaacatgctcaattcccgatcatcgctcaaagtgctaaattttcaggagtgaaaagaaaaagaggaaggaagaaacccctctcaggcaatcatgtacagccacccgaaacaatgaaatgtaatacattcataagacaagtgaaagaagagcatggcagacacacagatgcaactgtgaaagttccttttcttaagaaatgcaaggaagcaggacttcttaattacttacttgaagaaatattagacaaagttcattcaattccagaaaaactcatggatgagactacttcagaatcagactatgaagaaatcgggagtgcactttttgactgtagattgttcgaagacacatttgtaaattttcaagcagcaatagagaaaaaaattcatgcatctcaacaaaggtggcagcagttgaaggaagagattgagctacttcaggacttaaaacaaaccttgtgctcttttcaagaaaatagagatcttatgtcaagttctacatcaatatcatccctgtcttattagggattaccgtttcctaagccaagagtcatgtcaaattgcaatcaggctcaaaaccagagaccaggctgtgaaatccacacatctttagaactagtcgtctcctcttggcctcagcagctcttccctgttcttactggttgacattttgatcactctttgcacactcttgtgttttttgctcactgtcacattcccagcacctagtatgctcagtaaatgtttgtggaataagtgcataaaatgttcttaacctttgattctacttacagcccatgatagcctcttagatataataaatttggattatactactttacttgta

SEQ ID NO: 22048 - DNA, 903 bp, Homo sapiens
gccgccccggcccgagagggtgctcggcgccagcagcccggaggcccggcccgcgcaggaggcgctcctccttcccaccgctgtattcttcaggacttgtggaatgtgaggatcaggatccacttaatcctgatagaagttttgatgtggaatcagtaaagaaagaaatccagagaggaaggaagttgaaatgcaaattttgtcataaaagaggagccaccgtgggatgtgatttaaaaaactgtaacaagaattaccactttttctgtgccaagaaggacgacgcagttccacagtctgatggagttcgaggaatttataaactgctttgccagcaacatgctcaattcccgatcatcgctcaaagtgctaaattttcaggagtgaaaagaaaaagaggaaggaagaaacccctctcaggcaatcatgtacagccacccgaaacaatgaaatgtaatacattcataagacaagtgaaagaagagcatggcagacacacagatgcaactgtgaaagttccttttcttaagaaatgcaaggaagcaggacttcttaattacttacttgaagaaatattagacaaagttcattcaattccagaaaaactcatggatgagactacttcagaatcagactatgaagaaatcgggagtgcactttttgactgtagattgttcgaagacacatttgtaaattttcaagcagcaatagagaaaaaaattcatgcatctcaacaaaggtggcagcagttgaaggaagagattgagctacttcaggacttaaaacaaaccttgtgctcttttcaagaaaatagagatcttatgtcaagttctacatcaatatcatccctgtcttattagggattaccgtttcctaagccaagagtcatgtcaaattgcaatc

SEQ ID NO: 22049 - DNA, 610 bp, Homo sapiens
gcttccaccacaaccgatgtcaactctcctagcgcccctccgctcaccggtaaaccaggacagtggaggggcgccctgatgcggtgtctttcaggttgcagaaaagatggaaaaaaggacatgtgcactctgccccaaagatgtcgaatataatgtcctatactttgcacaatcagagaatatagctgctcatgagaattgtttgctgtattcttcaggacttgtggaatgtgaggatcaggatccacttaatcctgatagaagttttgatgtggaatcagtaaagaaagaaatccagagaggaaggaagttgaaatgcaaattttgtcataaaagaggagccaccgtgggatgtgatttaaaaaactgtaacaagaattaccactttttctgtgccaagaaggacgacgcagttccacagtctgatggagttcgaggaatttataaactgctttgccagcaacatgctcaattcccgatcatcgctcaaagtgctaaattttcaggagtgaaaagaaaaagaggaaggaagaaacccctctcaggcaatcatgtacagccacccgaaacaatgaaatgtaatacattcataagacaagtgaaagaagag

SEQ ID NO: 22050 - DNA, 566 bp, Homo sapiens
agtgcttccaccacaaccgatgtcaactctcctagcgcccctccgctcaccggtaaaccaggacagtggaggggcgccctgatgcgggcaagactcagccaaaggtggaaaagttgaaggggtgttcccagcagagaggatgacacaaaggcaccaaaccacaaaacgtcacacgtaaacatcatacgtggcaaccacaagccaatcagttggatatttcattcattggtatacatatggactgtaaggtgtctttcaggttgcagaaaagatggaaaaaaggacatgtgcactctgccccaaagatgtcgaatataatgtcctatactttgcacaatcagagaatatagctgctcatgagaattgtttgctgtattcttcaggacttgtggaatgtgaggatcaggatccacttaatcctgatagaagttttgatgtggaatcagtaaagaaagaaatccagagaggaaggaagttgaaatgcaaattttgtcataaaagaggagccaccgtgggatgtgatttaaaaaactgtaacaagaattaccactttttctgtgccaaga

SEQ ID NO: 22051 - DNA, 1318 bp, Homo sapiens
cacaaaggcaccaaaccacaaaacgtcacacgtaaacatcatacgtggcaaccacaagccaatcagttggatatttcattcattggtatacatatggactgtaaggtgtctttcaggttgcagaaaagatggaaaaaaggacatgtgcactctgccccaaagatgtcgaatataatgtcctatactttgcacaatcagagaatatagctgctcatgagaattgtttgctgtattcttcaggacttgtggaatgtgaggatcaggatccacttaatcctgatagaagttttgatgtggaatcagtaaagaaagaaatccagagaggaaggaagttgaaatgcaaattttgtcataaaagaggagccaccgtgggatgtgatttaaaaaactgtaacaagaattaccactttttctgtgccaagaaggacgacgcagttccacagtctgatggagttcgaggaatttataaactgctttgccagcaacatgctcaattcccgatcatcgctcaaagtgctaaattttcaggagtgaaaagaaaaagaggaaggaagaaacccctctcaggcaatcatgtacagccacccgaaacaatgaaatgtaatacattcataagacaagtgaaagaagagcatggcagacacacagatgcaactgtgaaagttccttttcttaagaaatgcaaggaagcaggacttcttaattacttacttgaagaaatattagacaaagttcattcaattccagaaaaactcatggatgagactacttcagaatcagactatgaagaaatcgggagtgcactttttgactgtagattgttcgaagacacatttgtaaattttcaagcagcaatagagaaaaaaattcatgcatctcaacaaaggtggcagcagttgaaggaagagattgagctacttcaggacttaaaacaaaccttgtgctcttttcaagaaaatagagatcttatgtcaagttctacatcaatatcatccctgtcttattagggattaccgtttcctaagccaagagtcatgtcaaattgcaatcaggctcaaaaccagagaccaggctgtgaaatccacacatctttagaactagtcgtctcctcttggcctcagcagctcttccctgttcttactggttgacattttgatcactctttgcacactcttgtgttttttgctcactgtcacattcccagcacctagtatgctcagtaaatgtttgtggaataagtgcataaaatgttcttaacctttgattctacttacagcccatgatagcctcttagatataataaatttggattatacta

SEQ ID NO: 22052 - DNA, 836 bp, Homo sapiens
actcggccgggcagccgcgggccgagcgcagccgcctccgccaccgatgcgcctggtggccagactccaagtgggaccggcggacacgcagcctcgcgtgtcaggggaagctgatggagaatcgagctctggatccagggactcgggactcctatggtgccaccagccacctccccaacaagggggccctggcgaaggtcaagaacaacttcaaagacttgatgtccaaactgacggagggccagtatgtgctgtgccggtggacagatggcctgtactacctcgggaagatcaagagggtcagcagctctaagcaaagctgcctcgtgactttcgaagataattccaaatactgggtcctatggaaggacatacagcatgccggtgttccaggagaggagcccaagtgcaacatctgcctagggaagacatcagggccgctgaatgagatcctcatctgcgggaagtgtggcctgggttaccaccagcagtgccacatccccatagcgggcagtgctgaccagcccctgctcacaccttggttctgccgacgctgcatcttcgcactggctgtgcgggtgagccttccatcctccccagtccctgcctctcctgcctcctccagtggggcagaccagagactcccatcacagagtctgagctccaagcagaagggccacacctgggctttggagacagatagcgcctctgccactgtccttggccaggatttgtagactccctgagcctcagtttcctcaactgtaaagtggagatgggtttggtgtcgggaataacgggaccaataaatgatgctttactattaaaaaagaaaa

SEQ ID NO: 22053 - DNA, 4241 bp, Homo sapiens
gaaaaagatggcgccccgcgcccggggggccccttcctgagcgccccggcccctccctccgccgcctccccctcctccccgcggcgcccccgccccgccccgcccccgccgagaccccgaccccggccccacgggcggacactcggccgggcagccgcgggccgagcgcagccgcctccgccaccgatgcgcctggtggccagactccaagtgggaccggcggacacgcagcctcgcgtgtcaggggaagctgatggagaatcgagctctggatccagggactcgggactcctatggtgccaccagccacctccccaacaagggggccctggcgaaggtcaagaacaacttcaaagacttgatgtccaaactgacggagggccagtatgtgctgtgccggtggacagatggcctgtactacctcgggaagatcaagagggtcagcagctctaagcaaagctgcctcgtgactttcgaagataattccaaatactgggtcctatggaaggacatacagcatgccggtgttccaggagaggagcccaagtgcaacatctgcctagggaagacatcagggccgctgaatgagatcctcatctgcgggaagtgtggcctgggttaccaccagcagtgccacatccccatagcgggcagtgctgaccagcccctgctcacaccttggttctgccgacgctgcatcttcgcactggctgtgcggaaaggcggcgcgctgaagaagggcgccatcgccaggacgctgcaggccgtgaagatggtgctgtcctaccagcccgaggagctcgagtgggactcgccccatcgcaccaaccagcagcaatgctactgctactgcggcgggcccggagaatggtacctgcggatgctgcaatgttaccggtgcaggcagtggttccacgaggcctgcacccagtgcctcaatgagcccatgatgtttggagaccggttttacctgttcttctgctccgtgtgtaaccagggcccagagtacatcgagaggctgcccctgcgatgggtggatgtggttcacctggccctctataatctgggggtacagagcaagaagaagtactttgactttgaggagattctggcctttgtcaaccaccactgggagctcctgcagcttggcaagctcaccagcaccccagtgacagatcgaggaccacatctcctcaacgctctgaacagttataaaagccggttcctctgcggcaaggagatcaagaagaagaagtgcatcttccgcctgcgcatccgcgtcccacccaacccgccagggaagctgctgcctgacaaaggactgctgccaaatgagaacagcgcctcctctgagctgcgtaagagaggaaagagcaagcctggtttgttgcctcacgaattccagcagcagaaaaggcgagtttatagaagaaaaagatcaaagtttttgctggaagatgctattcccagtagtgacttcacctcagcctggagcaccaaccaccacctggctagcatatttgacttcacgctggatgaaattcaaagtttaaaaagtgccagctcaggccagaccttcttctcagatgtcgactccaccgacgctgccagcacctctggctctgcctccaccagcctctcctatgactccagatggacagtgggcagccgaaagaggaagctggcagccaaggcatacatgcccctgcgggcaaagcggtgggcagctgagctggatggacgctgcccctcggacagcagtgcagagggggcttcagtccccgagcggccagacgaaggcattgacagccacacatttgagagcatcagtgaagatgactcatccctgtcccacctcaagtcatctatcaccaactactttggtgcagctgggcggttggcctgtggggagaagtaccaggtgttggctcggagggtcacacctgagggcaaggttcagtacctggtggagtgggaagggaccaccccttactgactagcccccgggggtgccaggggtcctgaaaaccaaaggaggagcagcagaagccataggctccccagctttctccaggctggggtgggagaaggaagcaggacagagctgcaagtgcctggcagaatgccctgcctgcctgcctgccaggccaaggcctgcgtctctctgctgtaccagctctgttccagggcctcctcaggctcgttacccctgtgcctgtgtctctacacactccacaccccctcaaactctgtttatctgttctctgaccttgtgtcccctgcgctgggacccttcctcctgaggcccaggtctttgtccccagttgtgtgccttgacctctctcgcccctttctgggtgtgttcgcacatcctgtgtgtgcacagctgtccctccactggatccccttcacacgtgacccgtggggcagccagtcctcccagggactacataacaggcacctttgagagagcatgggagaaggtggataagaggatgctgctcagtgcttttctcttccactttcctgccactccccactaccctcggagagaggtggtgggatgggagagagcccctgtgaaagcctgtgaggatctgaagagtaaagggctgggtctgcctcagaaggcaccagcaccagggcccaggtattaaggctgagagtgaaggctgccaatgtcagctttggaggtcccagaagtcttctgttctctggcctcaccccctcagtcgccatagagctgggcctggccttgctggaatggaggcatccttccaaacctgggggacgggggtggggggtggtagtggtgggagggaaaccatgtcttgctaaacctgtttctggtgcctcccatccccagacccaccagacaccacacagcagacaatacacacccactcgcacaagcttccatccacatgtgttgtactttcagctctaggcatgcagacaaccccacacggccacaccaccacatgcccaagtgtacacacacagagccacaccgtccctctgggcctgctggctcctcccttggctttcccttggcccacttccagggcccaggtgctgcaactaaatgtgaaagctcagtggccgctccttctttcagcccatcaaccagcattggtcccatagggaagcacaggggactcaccctctttcatatcccttgccctgccctgaaatggacaatcactttttgggataggttgaaatttttaaagagcctgcatcatttggttccctcaaagggaagcccttgccagtgggggtttgaaagagaatttttggaaccaacattcaaattctgcctcatctggagggaaaccaaaattgggagggggaagaggacccctgatgttttgctgcttccagagatattagaaactgactcacttgattggaaaatggacaaaagtgccttgacgtggagggtgggcaccagatggggaccagccttgccaactgctgctgtggcctccagcttggctggttttgcaggccgccagcaggaaggcgaaggtggtagtacagcaagaggcactggcggggcagcaggcctgcaggagctgtttttccattgctaggcctgacccctctctacctgtgagcgttcagggggtccctgagatagtttagatgcccccccatcttagacctcagctcccacagtgccttttaagggggacctcacctcctgtgcacagcccacccactttcctctgcttccctggcacagcccaggcatagacgagctggcgttggacccagttcttcccccttttcagccccacagctgctgccacaggggccaactagggccaggtggaaggggagctgagaagccaacccctagcccaggggtgctgtgggaactgggatccaatttgtagcttcctgcctggcttcagagagcccagcaaccttctaggcctgctttccagacttctgagatagcctgggatgagcaatcctgttatagtacatctggaccttccctacctgggctctggggaggctgtgggcctggagagggaaaaggagggagggggtgtctgcaccacctgggaagatagcacaaggcctaatgaggtcaccctgactccccaccccagcatttcattcataccagataatagctgcattactgccaactgaccttataaccctctgcaccttcaaaaagattcatggtttttaattgctgcttttaataacatttgttaaagtta

SEQ ID NO: 22054 - DNA, 1528 bp, Homo sapiens
aggttagaccttggggcgaggcctcgggaggcgggcctggcgggttgcgaccgcccaagcagggccccagggagatggtacctgcggatgctgcaatgttaccggtgcaggcagtggttccacgaggcctgcacccagtgcctcaatgagcccatgatgtttggagaccggttttacctgttcttctgctccgtgtgtaaccagggcccagagtacatcgagaggctgcccctgcgatgggtggatgtggttcacctggccctctataatctgggggtacagagcaagaagaagtactttgactttgaggagattctggcctttgtcaaccaccactgggagctcctgcagcttggcaagctcaccagcaccccagtgacagatcgaggaccacatctcctcaacgctctgaacagttataaaagccggttcctctgcggcaaggagatcaagaagaagaagtgcatcttccgcctgcgcatccgcgtcccacccaacccgccagggaagctgctgcctgacaaaggactgctgccaaatgagaacagcgcctcctctgagctgcgtaagagaggaaagagcaagcctggtttgttgcctcacgaattccagcagcagaaaaggcgagtttatagaagaaaaagatcaaagtttttgctggaagatgctattcccagtagtgacttcacctcagcctggagcaccaaccaccacctggctagcatatttgacttcacgctggatgaaattcaaagtttaaaaagtgccagctcaggccagaccttcttctcagatgtcgactccaccgacgctgccagcacctctggctctgcctccaccagcctctcctatgactccagatggacagtgggcagccgaaagaggaagctggcagccaaggcatacatgcccctgcgggcaaagcggtgggcagctgagctggatggacgctgcccctcggacagcagtgcagagggggcttcagtccccgagcggccagacgaaggcattgacagccacacatttgagagcatcagtgaagatgactcatccctgtcccacctcaagtcatctatcaccaactactttggtgcagctgggcggttggcctgtggggagaagtaccaggtgttggctcggagggtcacacctgagggcaaggttcagtacctggtggagtgggaagggaccaccccttactgactagcccccgggggtgccaggggtcctgaaaaccaaaggaggagcagcagaagccataggctccccagctttctccaggctggggtgggagaaggaagcaggacagagctgcaagtgcctggcagaatgccctgcctgcctgcctgccaggccaaggcctgcgtctctctgctgtaccagctctgttccagggcctcctcaggctcgttacccctgtgcctgtgtctctacacactccacaccccctcaaactctgtttatctgttctctgaccttgtgtcccctgcgctgggacccttcctcctgaggcccaggtctttgtccc

SEQ ID NO: 22055 - DNA, 558 bp, Homo sapiens
ttttcgaaatctccctgaactttggcggcccgaacgcctccgggggtgtcaggggaagctgatggagaatcgagctctggatccagggactcgggactcctatggtgccaccagccacctccccaacaagggggccctggcgaaggtcaagaacaacttcaaagacttgatgtccaaactgacggagggccagtatgtgctgtgccggtggacagatggcctgtactacctcgggaagatcaagagggtcagcagctctaagcaaagctgcctcgtgactttcgaagataattccaaatactgggtcctatggaaggacatacagcatgccggtgttccaggagaggagcccaagtgcaacatctgcctagggaagacatcagggccgctgaatgagatcctcatctgcgggaagtgtggcctgggttaccaccagcagtgccacatccccatagcgggcagtgctgaccagcccctgctcacaccttggttctgccgacgctgcatcttcgcactggctgtgcggaaaggcggcgcgctgaagaagggcgccatcgc

SEQ ID NO: 22056 - DNA, 888 bp, Homo sapiens
cgcccggccagggtggaggcgggtgcggcgacccggccggctcctagaggcgcagcgggagaggaagtgtcagtttgtgaacctgcagcggccccggcctggcccctggccgggcgggcggggacctcgcagcgccgggcgagccaggtggcagggagaggacagggattcagaccgcatcccctgcccgggagcctgtgcgctctgcgctggagaaaaaggagatgggagtgggggtggagaaggtcgtggccacgccaccatctggggagccgagacccctgcagtgcctggctcgccccagggccccgcacatacttagcttcacacactccctggcacaatgccgtagacatcatcctgcccagtctcacaggagtacacacacgcaccacacagaaacaggcactggactctctccctgtgaacagatagtcacaacaccaggtgcccagcgccatggccacaaggaggagacccgagtaggcccgcggggaaagagagaggctgtgtgtggctgtagtggagagcatgtggagggacttggagccagtgtcaggggaagctgatggagaatcgagctctggatccagggactcgggactcctatggtgccaccagccacctccccaacaagggggccctggcgaaggtcaagaacaacttcaaagacttgatgtccaaactgacggagggccagtatgtgctgtgccggtggacagatggcctgtactacctcgggaagatcaagagggtcagcagctctaagcaaagctgcctcgtgactttcgaagataattccaaatactgggtcctatggaaggacatacagcatgccggtgttccaggagaggagcccaagtgcaacatctgcctagggaagacatc

SEQ ID NO: 22057 - DNA, 4100 bp, Homo sapiens
actcggccgggcagccgcgggccgagcgcagccgcctccgccaccgatgcgcctggtggccagactccaagtgggaccggcggacacgcagcctcgcgtgtcaggggaagctgatggagaatcgagctctggatccagggactcgggactcctatggtgccaccagccacctccccaacaagggggccctggcgaaggtcaagaacaacttcaaagacttgatgtccaaactgacggagggccagtatgtgctgtgccggtggacagatggcctgtactacctcgggaagatcaagagggtcagcagctctaagcaaagctgcctcgtgactttcgaagataattccaaatactgggtcctatggaaggacatacagcatgccggtgttccaggagaggagcccaagtgcaacatctgcctagggaagacatcagggccgctgaatgagatcctcatctgcgggaagtgtggcctgggttaccaccagcagtgccacatccccatagcgggcagtgctgaccagcccctgctcacaccttggttctgccgacgctgcatcttcgcactggctgtgcggaaaggcggcgcgctgaagaagggcgccatcgccaggacgctgcaggccgtgaagatggtgctgtcctaccagcccgaggagctcgagtgggactcgccccatcgcaccaaccagcagcaatgctactgctactgcggcgggcccggagaatggtacctgcggatgctgcaatgttaccggtgcaggcagtggttccacgaggcctgcacccagtgcctcaatgagcccatgatgtttggagaccggttttacctgttcttctgctccgtgtgtaaccagggcccagagtacatcgagaggctgcccctgcgatgggtggatgtggttcacctggccctctataatctgggggtacagagcaagaagaagtactttgactttgaggagattctggcctttgtcaaccaccactgggagctcctgcagcttggcaagctcaccagcaccccagtgacagatcgaggaccacatctcctcaacgctctgaacagttataaaagccggttcctctgcggcaaggagatcaagaagaagaagtgcatcttccgcctgcgcatccgcgtcccacccaacccgccagggaagctgctgcctgacaaaggactgctgccaaatgagaacagcgcctcctctgagctgcgtaagagaggaaagagcaagcctggtttgttgcctcacgaattccagcagcagaaaaggcgagtttatagaagaaaaagatcaaagtttttgctggaagatgctattcccagtagtgacttcacctcagcctggagcaccaaccaccacctggctagcatatttgacttcacgctggatgaaattcaaagtttaaaaagtgccagctcaggccagaccttcttctcagatgtcgactccaccgacgctgccagcacctctggctctgcctccaccagcctctcctatgactccagatggacagtgggcagccgaaagaggaagctggcagccaaggcatacatgcccctgcgggcaaagcggtgggcagctgagctggatggacgctgcccctcggacagcagtgcagagggggcttcagtccccgagcggccagacgaaggcattgacagccacacatttgagagcatcagtgaagatgactcatccctgtcccacctcaagtcatctatcaccaactactttggtgcagctgggcggttggcctggggagaagtaccaggtgttggctcggagggtcacacctgagggcaaggttcagtacctggtggagtgggaagggaccaccccttactgactagcccccgggggtgccaggggtcctgaaaaccaaaggaggagcagcagaagccataggctccccagctttctccaggctggggtgggagaaggaagcaggacagagctgcaagtgcctggcagaatgccctgcctgcctgcctgccaggccaaggcctgcgtctctctgctgtaccagctctgttccagggcctcctcaggctcgttacccctgtgcctgtgtctctacacactccacaccccctcaaactctgtttatctgttctctgaccttgtgtcccctgcgctgggacccttcctcctgaggcccaggtctttgtccccagttgtgtgccttgacctctctcgcccctttctgggtgtgttcgcacatcctgtgtgtgcacagctgtccctccactggatccccttcacacgtgacccgtggggcagccagtcctcccagggactacataacaggcacctttgagagagcatgggagaaggtggataagaggatgctgctcagtgcttttctcttccactttcctgccactccccactaccctcggagagaggtggtgggatgggagagagcccctgtgaaagcctgtgaggatctgaagagtaaagggctgggtctgcctcagaaggcaccagcaccagggcccaggtattaaggctgagagtgaaggctgccaatgtcagctttggaggtcccagaagtcttctgttctctggcctcaccccctcagtcgccatagagctgggcctggccttgctggaatggaggcatccttccaaacctgggggacgggggtggggggtggtagtggtgggagggaaaccatgtcttgctaaacctgtttctggtgcctcccatccccagacccaccagacaccacacagcagacaatacacacccactcgcacaagcttccatccacatgtgttgtactttcagctctaggcatgcagacaaccccacacggccacaccaccacatgcccaagtgtacacacacagagccacaccgtccctctgggcctgctggctcctcccttggctttcccttggcccacttccagggcccaggtgctgcaactaaatgtgaaagctcagtggccgctccttctttcagcccatcaaccagcattggtcccatagggaagcacaggggactcaccctctttcatatcccttgccctgccctgaaatggacaatcactttttgggataggttgaaatttttaaagagcctgcatcatttggttccctcaaagggaagcccttgccagtgggggtttgaaagagaatttttggaaccaacattcaaattctgcctcatctggagggaaaccaaaattgggagggggaagaggacccctgatgttttgctgcttccagagatattagaaactgactcacttgattggaaaatggacaaaagtgccttgacgtggagggtgggcaccagatggggaccagccttgccaactgctgctgtggcctccagcttggctggttttgcaggccgccagcaggaaggcgaaggtggtagtacagcaagaggcactggcggggcagcaggcctgcaggagctgtttttccattgctaggcctgacccctctctacctgtgagcgttcagggggtccctgagatagtttagatgcccccccatcttagacctcagctcccacagtgccttttaagggggacctcacctcctgtgcacagcccacccactttcctctgcttccctggcacagcccaggcatagacgagctggcgttggacccagttcttcccccttttcagccccacagctgctgccacaggggccaactagggccaggtggaaggggagctgagaagccaacccctagcccaggggtgctgtgggaactgggatccaatttgtagcttcctgcctggcttcagagagcccagcaaccttctaggcctgctttccagacttctgagatagcctgggatgagcaatcctgttatagtacatctggaccttccctacctgggctctggggaggctgtgggcctggagagggaaaaggagggagggggtgtctgcaccacctgggaagatagcacaaggcctaatgaggtcaccctgactccccaccccagcatttcattcataccagataatagctgcattactgccaactgaccttataaccctctgcaccttcaaaaagattcatggtttttaattgctgcttttaataacatttgttaaagttat

SEQ ID NO: 22058 - DNA, 5565 bp, Homo sapiens
ggccgctcggcggccgggggtcccttcggtggggccgcggctccccgcccgccgcccccgcgcgtccattcccttttgtgtcccgcgcgcggcccgtcccccgcgcacactagcgccctgagccccgcgggccggcgggcggctcccggcgcggcccctccagccagcgcgcccggcattgtgtggacgcgcctggccgggagcgcgcgcgggggctgtcgtgcgcccccgtccccgtcccctcccggccgcggcgccgcctgcgccccgccgcccccgccgcccccgcgcggcccggcccccggcccggcccggaccgacccgggcagcgcagcggcggggccgagcggcggcgcggcgcggcaacatggcgacggtgcccgtgtactgcgtctgccggctcccctacgacgttacccgcttcatgatcgagtgcgacgcctgcaaggactggttccacggcagctgtgttggggtggaagaggaggaggcgcccgacatcgacatataccactgcccaaactgtgagaaaacccatgggaagtccaccttaaagaagaagcggacctggcacaaacacggcccggggcaagcgcctgacgtcaagcccgtgcagaatggcagccagctcttcatcaaggagctgcggagccggacctttcccagtgctgaagacgtggtggcccgtgtgccaggaagtcagctcacgctgggctacatggaggagcacggcttcaccgagcccatcctcgtccctaagaaagacgggctgggtctggctgtcccggcccccacgttctatgtcagtgacgtcgagaactacgtggggccggaacggagtgtggatgtgacagatgtcaccaagcagaaggactgcaagatgaagctgaaggagtttgtggactattactacagcaccaaccgcaagcgggtcctcaacgtcaccaacctcgagttctctgacacccgaatgtccagcttcgtggagccacctgacattgtaaagaaactgtcatgggtagaaaactactggccagatgatgcattgctggccaagcccaaagtgaccaagtactgcctaatctgcgtgaaggacagttacaccgacttccacatcgactctgggggcgcctctgcctggtaccacgtgctcaagggggagaagaccttctatctcatcaggccggcctcggccaacatctccctgtatgagcgctggcggtctgcctctaaccacagcgagatgttctttgctgaccaggtcgacaaatgctacaagtgcatcgtcaagcagggccagaccctcttcatcccctcaggctggatctacgccacactcacccctgtggactgcctggccttcgcgggacatttcctccacagcctgagtgtggagatgcagatgagagcatatgaagtggaaaggaggttgaaactgggcagcctgactcagtttcccaactttgaaactgcgtgctggtacatggggaagcacctgctggaggcattcaaaggctctcacaaatctgggaagcagctgccccctcatctagtccaaggagctaaaattctcaatggtgctttccgatcgtggacgaagaagcaggctttggcagagcatgaggacgagctcccggagcacttcaaaccttcacagctaatcaaagacctggccaaagagatccggctcagtgagaatgcctccaaagccgtccgaccggaagtgaatactgtcgcctcgtcagatgaggtgtgtgacggggaccgggagaaggaggagcccccgtctcccattgaggccaccccgcctcaatccctcctggagaaagtgtccaaaaaaaagactcccaaaactgtgaagatgcccaagccatccaaaatccccaagcccccgaagccccctaagcccccaaggccccccaaaacgctgaagctcaaagatggaggcaagaagaaagggaagaagtcccgggagtcagcctcacccaccatccccaacctggacctgctcgaagcccacaccaaggaggcactgaccaagatggagccgcccaagaagggcaaggccacaaagagtgtcctgagtgtgcccaacaaagatgtggttcacatgcagaatgatgtggagaggctggaaattcgagagcaaaccaagagcaagtcagaggccaagtggaagtacaagaacagcaaacctgactccttactgaagatggaagaggagcagaagctagagaagtcgcctctagctggaaacaaagacaataagttctctttttctttctccaacaagaaactcctcggctccaaggctctcaggcccccgacgagccctggtgtgttcggggccttgcagaacttcaaggaggacaagcccaagcccgtgcgggatgagtatgagtacgtgtcggatgacggtgagctcaagatcgacgagtttcccatcaggaggaagaaaaacgccccgaaaagggacttgtccttcttgttggataagaaggctgtgctgcccacgcctgtcacgaagccaaagctggactcggcagcgtacaagagtgatgactcctcggacgagggttcgctgcacatcgacacagacaccaagcccggccgcaatgccagagtcaagaaggagagtgggagctcggcagctggcatcttggacctgctgcaggccagtgaggaggttggcgcgctggagtacaaccccagcagccagcccccggcctcccccagcacacaggaagccattcagggaatgctgtccatggccaacctgcaggcctccgactcctgcctgcagaccacgtggggagctggccaggccaaggggagctcgctggctgcccatggtgcccggaagaatgggggtggcagtggcaagagtgcaggcaaacgactgctgaagagggctgccaagaacagtgtcgacctggacgactacgaggaagagcaggaccacctggatgcctgcttcaaggactcagactacgtttacccctcactggagtcagatgaagacaaccccatctttaagtcccggtcgaagaaaaggaaaggctcagacgacgctccctacagcccaacagcaagggtcggcccatcggtgccaagacaggacaggcctgtgcgtgagggtacacgggtggcttccatcgagaccgggctggcggctgctgcagctaagttgtcccagcaggaggagcagaaaagcaagaaaaaaaagagtgccaagaggaagctgactcctaacaccacctccccttccacctccacctccatctctgccggcaccacctccacctccaccacgccagcctctaccaccccggcctccaccaccccggcctccaccagcacggccagcagccaggcctcgcaggagggcagctcgccagagcccccgcctgagtcgcatagcagcagcctggcggaccatgagtacacagccgctggcaccttcaccggggcccaggctggccgcacctcccagcccatggcccctggggtctttctcacacagaggcggccctccgcatcgtctccaaacaacaacaccgctgccaaaggaaaacgtacgaaaaagggcatggcgaccgccaagcagaggcttgggaaaattttgaaaattcatcggaacgggaaactactcctttaagatttggaaagccaggatccttctgctccgctcaggacccccggagccccgcgaaaacatctgcctcccaggagggtgccgagctgcctcaccagggagggccttgcctcttcccggctgccatctccccaacaagcgtctgtcccttcagccggcagagcgagcccagcgtggcccctcaatttgaaaatggacgtcttttctcaagttgctaagagtgatctgtcccagaaaagcggccctgcaagtttgaggaccgcttattccactttaaggacagccttcaggccccctgagcgtgggtgtgattgcagggcctctgcagctctgctgagagcatgagtccttcaaggaagacagagtgagccaatgctcaccagccccagagtcagagctggccacaggctggcagcctccaggggcttaaaaaaaaaggcaaagaacacagaaagaggaggagcaagtgggatgtttatgtccccccttctcttcctgagtgattctcagccaagtccagacagtgctcggcgggtgaggaagggtctgccccgagctttctggttggcaggtggcagcaggatggtgggtgttcagcctgaatgcccaggagcatttctggggggcagctaagactggcagctgggttggtgtgttagcgggcaggggagccattgtggggtccccaggaaagggcaagggctcagccacatcttggggtctgggaggcccaggctaagccatgtggcagggaccgtcttgccctgctggccacactctggagaagcacttctcagccaaggcacccctgccctgggactggcagggcaggggcaggggcagggacagtggccaggcggcccgaggacttacggtcggcacttctctgttctcccgtgtcagcgtgtggtgtcgcctgcatgggtcgtacctggatggtgtgtccaccatcgacacggaggggctggatttgtttctcaggcaatcctgtattttaattttagatgtatttcctgaagcatatttttcatagaatgtagcgtgtaaatagctttttaaataacttcttttttataagagtaaaagtatctttaggaatttctttctatagagttcttcattaacatttatacgagttttttgctgagtcagatggacagttgggttctgatgctttttccttctcctttccttttattattattatttttttcttttaagaactaaggtattgcctgaaaaacaagtgatgtctgtgcagccttacactctgtctttacagaagcaaatagtacacaaaagatctatttcagacacattttgaagatgaatcttcaactttaataccagctctttgttttccttgtatgatgaggggattgggggatacagttattttactagcaccttgtgaagtgtttccgtgttttgtgatgctgtaatttattaatgtttgtagctttttatatttgtacatttcttatgagctttgtttatatacccattacctggatgtttttgtccactgggagaggcagcttggtggaggccttatccactcccacttgtcctgtttggagggacgcagtccctagggcccgagactgggtgggagagggggagtctcacggggccccaggcttattcagaactggtgtttttaaagtttcctttaccctgcccttgttgaacatttatataatctaacctggacatcaagctgttctctctctctcttttttttaattttattattattattttggcaacatgtacatttctaacaaagtttatcgtggctattaaagtgttttatttcccaattcatattactcttgtatcgagtccatgaggtctaaggcaacttagatcaaagttttaaaaaagtaaaaatatttcaggttttgtac

SEQ ID NO: 22059 - DNA, 3042 bp, Homo sapiens
gtgcgcccccgtccccgtcccctcccggccgcggcgccgcctgcgccccgccgcccccgccgcccccgcgcggcccggcccccggcccggcccggaccgacccgggcagcgcagcggcggggccgagcggcggcgcggcgcggcaacatggcgacggtgcccgtgtactgcgtctgccggctcccctacgacgttacccgcttcatgatcgagtgcgacgcctgcaaggactggttccacggcagctgtgttggggtggaagaggaggaggcgcccgacatcgacatataccactgcccaaactgtgagaaaacccatgggaagtccaccttaaagaagaagcggacctggcacaaacacggcccggggcaagcgcctgacgtcaagcccaaaaacagtgtcgacctggacgactacgaggaagagcaggaccacctggatgcctgcttcaaggactcagactacgtttacccctcactggagtcagatgaagacaaccccatctttaagtcccggtcgaagaaaaggaaaggctcagacgacgctccctacagcccaacagcaagggtcggcccatcggtgccaagacaggacaggcctgtgcgtgagggtacacgggtggcttccatcgagaccgggctggcggctgctgcagctaagttgtcccagcaggaggagcagaaaagcaagaaaaaaaagagtgccaagaggaagctgactcctaacaccacctccccttccacctccacctccatctctgccggcaccacctccacctccaccacgccagcctctaccaccccggcctccaccaccccggcctccaccagcacggccagcagccaggcctcgcaggagggcagctcgccagagcccccgcctgagtcgcatagcagcagcctggcggaccatgagtacacagccgctggcaccttcaccggggcccaggctggccgcacctcccagcccatggcccctggggtctttctcacacagaggcggccctccgcatcgtctccaaacaacaacaccgctgccaaaggaaaacgtacgaaaaagggcatggcgaccgccaagcagaggcttgggaaaattttgaaaattcatcggaacgggaaactactcctttaagatttggaaagccaggatccttctgctccgctcaggacccccggagccccgcgaaaacatctgcctcccaggagggtgccgagctgcctcaccagggagggccttgcctcttcccggctgccatctccccaacaagcgtctgtcccttcagccggcagagcgagcccagcgtggcccctcaatttgaaaatggacgtcttttctcaagttgctaagagtgatctgtcccagaaaagcggccctgcaagtttgaggaccgcttattccactttaaggacagccttcaggccccctgagcgtgggtgtgattgcagggcctctgcagctctgctgagagcatgagtccttcaaggaagacagagtgagccaatgctcaccagccccagagtcagagctggccacaggctggcagcctccaggggcttaaaaaaaaaggcaaagaacacagaaagaggaggagcaagtgggatgtttatgtccccccttctcttcctgagtgattctcagccaagtccagacagtgctcggcgggtgaggaagggtctgccccgagctttctggttggcaggtggcagcaggatggtgggtgttcagcctgaatgcccaggagcatttctggggggcagctaagactggcagctgggttggtgtgttagcgggcaggggagccattgtggggtccccaggaaagggcaagggctcagccacatcttggggtctgggaggcccaggctaagccatgtggcagggaccgtcttgccctgctggccacactctggagaagcacttctcagccaaggcacccctgccctgggactggcagggcaggggcaggggcagggacagtggccaggcggcccgaggacttacggtcggcacttctctgttctcccgtgtcagcgtgtggtgtcgcctgcatgggtcgtacctggatggtgtgtccaccatcgacacggaggggctggatttgtttctcaggcaatcctgtattttaattttagatgtatttcctgaagcatatttttcatagaatgtagcgtgtaaatagctttttaaataacttcttttttataagagtaaaagtatctttaggaatttctttctatagagttcttcattaacatttatacgagttttttgctgagtcagatggacagttgggttctgatgctttttccttctcctttccttttattattattatttttttcttttaagaactaaggtattgcctgaaaaacaagtgatgtctgtgcagccttacactctgtctttacagaagcaaatagtacacaaaagatctatttcagacacattttgaagatgaatcttcaactttaataccagctctttgttttccttgtatgatgaggggattgggggatacagttattttactagcaccttgtgaagtgtttccgtgttttgtgatgctgtaatttattaatgtttgtagctttttatatttgtacatttcttatgagctttgtttatatacccattacctggatgtttttgtccactgggagaggcagcttggtggaggccttatccactcccacttgtcctgtttggagggacgcagtccctagggcccgagactgggtgggagagggggagtctcacggggccccaggcttattcagaactggtgtttttaaagtttcctttaccctgcccttgttgaacatttatataatctaacctggacatcaagctgttctctctctctcttttttttaattttattattattattttggcaacatgtacatttctaacaaagtttatcgtggctattaaagtgttttatttcccaattcatattactcttgtatcgagtccatgaggtctaaggcaacttagatcaaagttttaaaaaagtaaaaatatttcaggttttgtacagaa

SEQ ID NO: 22060 - DNA, 7318 bp, Homo sapiens
ggtgaatgggctggtggtgctcgctgctgctgctgagaggaggaggaggatgaagagttgggcttgtttgtctcctacagtttctctcctgctgctctgattcccccctcccgattccggcccggggcctgtgtgtgtccctcctggaggaggaggaggatccagttcctccccccaaccccctcctccccacccccccttgcctggggaagaggaggaaagaaacagcccagagagagagagagagagagagtgagtgagagagagaggagaggagaggaggaggaggaggagggagaagggaacaacctaccatcttaacacactaatatctaaaaagtgcgagaggcccagagcagcagcagaagcagcagcagcagctccagcttcttccctccctccccatgaagaagagttccctcctcctcctcctcctgcttctcctgctcagagttcctgcctccagctgccaggggggacagccagccagcagcaggaggggggctagagagctgaaggagagccagtttccccaaaattgctgcagtgagaagaggagtttgttactttaaacagaggctgaagaaactatagaattagcagagaaagtggagaaggtagaggatggagttgcagactctacaggaggctcttaaagtggaaattcaggttcaccagaaactggttgctcaaatgaagcaggatccacagaatgctgacttaaagaaacagcttcatgaactccaagccaaaatcacagctttgagtgagaaacagaaaagagtagttgaacagctacggaagaacctgatagtaaagcaagaacaaccggacaagttccaaatacagccattgccacaatctgaaaacaaactacaaacagcacagcagcaaccactacagcaactacaacaacagcagcagtaccaccaccaccacgcccagcagtcagctgcagcctctcccaacctgactgcttcacagaagactgtaactacagcttctatgattaccacaaagacactacctctcgtcttgaaagcagcaactgcgaccatgcctgcctctgtggtgggccagagacctaccattgctatggtgaccgccatcaacagtcagaaggctgtgctcagcactgatgtgcagaacacaccagtcaacctccagacgtctagtaaggtcactgggcctggggcagaggctgtccaaattgtggcaaaaaacacagtcactctgcaggttcaggcaacacctcctcagcccatcaaagtaccacagtttatcccccctcctagactcactccacgtccaaactttcttccacaggttcgacccaagcctgtggcccagaataacattcctattgccccagcaccacctcccatgctcgcagctcctcagcttatccagaggcccgtcatgctgaccaagttcacccccacaacccttcccacatcccagaattccatccaccccgtccgtgtcgtcaatgggcagactgcaaccatagccaaaacgttccccatggcccagctcaccagcattgtgatagctactccagggaccagactcgctggacctcaaactgtacagcttagcaagccaagtcttgaaaaacagacagttaaatctcacacagaaacagatgagaaacaaacagagagccgcaccatcaccccacctgctgcacccaaaccaaaacgggaggagaaccctcagaaacttgccttcatggtgtctctagggttggtaacacatgaccatctagaagaaatccaaagcaagaggcaagagcgaaaaagaagaacaacagcaaatccggtctacagtggagcagtctttgagccagagcgtaagaagagtgcagtgacatacctaaacagcacaatgcaccctgggacccggaagagaggtcgtcctccaaaatacaatgcagtgctggggtttggagcccttaccccaacatccccccaatccagtcatcctgactcccctgaaaatgaaaagacagagaccacattcactttccctgcacctgttcagcctgtgtccctgcccagccccacctccacagacggtgatattcatgaggatttttgcagcgtttgcagaaaaagtggccagttactgatgtgcgacacatgttcccgtgtatatcatttggactgcttagacccccctctgaaaacaattcccaagggcatgtggatctgtcccagatgtcaggaccagatgctgaagaaggaagaagcaattccatggcctggaactttagcaattgttcattcctatattgcctacaaagcagcaaaagaagaagagaaacagaagttacttaaatggagttcagatttaaaacaagaacgagaacaactagagcaaaaggtgaaacagctcagcaattccataagtaaatgcatggaaatgaagaacaccatcctggcccggcagaaggagatgcacagctccctggagaaggtaaaacagctgattcgcctcatccacggcatcgacctctccaaacctgtagactctgaggccactgtgggggccatctccaatggcccggactgcaccccccctgccaatgccgccacctccacgccggccccttccccctcctcccagagctgcacagcgaactgtaaccagggggaagagactaaataacagagcccctctaggagaagccacgggatcccggcggcaaggagaacagaacactgaagactctagaaaagcaaagccggatttctggaaagtgcagaattcttttggttctttggttccagagagagagaagatgcttgtgccaggtggcaccagagtttgccaattgatccttcttattctgtgtgtacatgcaaagattggaccatgttacatgaaatagtgccagctggaggttctttgccagcaccatgccaagtgaaataatatatttactctctctattatacaccagtgtgtgcctgcagcagcctccacagccacgatgggtttgtttctgttttcttgggtggggagcagggacgggcggagggaggagagcaggtttcagatccttacttgccgagccgtttgtttaggtagagaagacaagtccaaagagtgtgtgggctttcctgtttctaaactttcgctactataaaaccaaaaaaaggaattgagatttcaccaaccccagtgcccagaagagggaaggggagtggctggagggagcagggggtgggacagtgtatcaaataagcagtatttaatcacctctggcgggggcctcgtgcaaggggagactgacaccaagaacagccagtaggttcttctcccctgcactctgctccctgcgcggtaaccccaccactcctgaagcctgcccagtctccttccttccctgcttggtgagtcgcgcatctccgtggttatcccgctgtctcctctccaagaacaagcagagcccgggccactggcccttgcccaaggcagggaagaaggatgtgtgtgtccaggaaggaaaaaaaggtggatcagtgattttacttgaaaacaagctccatcccttttctatatttataagaagagaagatcttgagtgaagcagcacgcgacccaggtgtgtgtgaattgaatggagacgtttcttttctctttctttaatttttgtttttgttctttttttctttaaggaaagttttattttactgttcattttactttcttggtaacaaaaactaaaataaggaatagaaaagctgtttttcaggctgacagtccaattaagggtagccaagaccttgcatggtagagtaggaatcatagtgtcagtgaggtcccgtgagtctttgtgagtccttgtgtcatcgttcgggcactgtttttttatgcaagggcaaaaatctttgtatctggggaaaaaaaacttttttttaaattaaaaaggaaaataaaagatattgaggtcttcctagtgttacttaaattaagatcaaggtaagaaacattgtaaaaaaaaattacaaaagtgctatttgtttcctaaaaacagtgatttctattaaaaaggtgtcagaactggagaaaatgccgtgtagttataattttttagcacagaccctgctgatcacgatgacattttgccgtgtgtgtgtctctagactggtgggccagtctccttgaaggacagaggcggagctccccacccttctctctcctcagaaaagaccgtgctctcttcttggtgcagggatcttgtctcctgttgtgaagcccaaatggaagcgtggatggtatcagggccctacccgtggtcttctcagattctgctagagcaaaaggctggtgcctaaataagatcccttcctttggtgctgcttttggtctttcagccaccagcattatgagtgcctgggggacacctccgagggaactggccagcggagctctgtggtgcgcacgcaccctggccgtgacaggagggtgcgggagtacaggctggctgcatcagcccttggtgcttagaacagaggaggagtgacatgttttgagggtacgtctctgagacagagccccagcgtggccttcgctctgtcttgcctttggggagaggtctgaagctcccactcctttctctgcctgttggctccaggcaccagaaatttactccactccacccacccacaagcctcctgggtgaccctgggctagaattgctgcgcttgcctcggcttggccggttgtggcctctccttgagaaaaccagggttgtgaaagactcagaccattctctcatcttgccttgtcagaagtaaattgtgtcagatttgtgctctcgctggagacctttgccccttgcgtgcccctggccgatgggagggcggtggaggctctgtaccctggccctgctggagcatctcccccaagcccactccaggccctgggaatggccagagtctaggagaggtagaaacgatcctatcagcttctctcccacccaattaggcccagagagacaaagacagatctgaaagcaaatgcaacagagaagagacacttcttagagtaaaatgtgtctcatctctatcagccatcgcctttcatcttcccaggggcctcagaagaaggaattaagttaggctgaacaggcctcagagttaggccctggctgcttgattggctgagggggaaagagttcccttttctcattcagaaaccaaggtgctgtgtctagtcagggagccttggagatgcctggactagttggaggaatcgttggcagaggatcagagaccagcagcaggctgtctgccctgtctagagctcttcccctcaacttgtctgggcccatctgggggttgccacacaacacctaacttaccttttcctgaaagaagttgggaaaccatcatcactagaggcctttgctcagagaggagctgccttaggagtcttgggtcggaggacggggctaggaattgaccagggctttgcctgccgccctcagcagtgtcgggtacattctgacctcgcctgcagctgggctgtggattcttcctgacattcagatgtgagctgttttgggagtcagctagtatggagtacgagatgcaacccagcccccaaacctacattctgcactcaaattccaaaacactgctttactgtaaagaagaggcccctggcacccaatctccctgtccttcactgtcccctcagacctgggcggggaggggggggggcctgtgaccacctgagacatacgctcgtgacactgccccaccccagccacctccacttgcttcctcctccttccctccgctgctctttccccacggcccagaatttagctgctctgacagccacttttgagaccagctggctttgtagtcacttcagagagctggagcggctgcccactgggccctgactgggagtcccctgccagctcctgatcaggcgctgcgccctggtggcagtgatgactgggagtcccctgccagctcctgtccaggcgctgcatcctggtaacagtgaggccatgttgctgtcatctccacctctgcattcttgctgcctgtgggtcctttttctttcatggagcctgctgggtcttgtctcacctgtgctgagctcctctggggttttgatttcttccttccttatcaggccctttggggtaagcctgctggttgtacctgacatagggaggcagttaggggcagtccctggtggggccgccctggcagcctccagctggcaccatcgtgtgcctggtttccctgcaacacctgcctctctgtccctgctgctgcttggctcaggcccaacaggcagcgtgcatggaggtggttacacacagctgtttccgtgagggtgaccgtgtctgcagcacgcttccgtctccgcatgcacggctgcctctccagccacctctgatacttctctcttggggccatcagagcctcccttgggctgtcacctcccagctcacacacactcttcagtggtttcctctcttcattctcttatagggcgtggtccttcttatttatctaaagggctgaatttaggagactttttacccaggggcaaaaggctcttagggtaatgagatggatggtggcccaggtgcattttccagggcctgggttctccagatcccgtggcttctgttgagtggaggcaactttgctctgtgtgaacctcgcccctgtccctctgccgggcacccctggcaggaagcaggactcccatcctcaccctgacttagactgtcctctgagtcagctcctctccaagacaggagtgggcagccctgggcagtcttctggccccttgctaaagtgaggggcaggaagctggggctgccctccagaaagccggggtaggaactctgaaaaatacctcctctaaacggaagcagggctctccagttccacttggcgccccctcccacaaggcccttcctccctgaggaccccacccccctaccccttccccagcagcctttggaccctcacctctctccggtgtccgtgggtcctcagcccagggtgagctgcagtcaggcgggatgggacgggcaggccagaggtcagccagctcctagcagagaagagccagccagaccccaaccctgtctcttgtccatgccctttgtgatttcagtcttggtagacttgtatttggagttttgtgcttcaaagtttttgtttttgtttgtttggtttttgttttgagggggtggggggggatacagagcagctgatcaatttgtatttatttattttaacattttactaaataaagccaaataaagcctctc

SEQ ID NO: 22061 - DNA, 3675 bp, Homo sapiens
gtgagagagagaggagaggagaggaggaggaggaggagggagaagggaacaacctaccatcttaacacactaatatctaaaaagtgcgagaggcccagagcagcagcagaagcagcagcagcagctccagcttcttccctccctccccatgaagaagagttccctcctcctcctcctcctgcttctcctgctcagagttcctgcctccagctgccaggggggacagccagccagcagcaggaggggggctagagagctgaaggagagccagtttccccaaaattgctgcagtgagaagaggagtttgttactttaaacagaggctgaagaaactatagaattagcagagaaagtggagaaggtagaggatggagttgcagactctacaggaggctcttaaagtggaaattcaggttcaccagaaactggttgctcaaatgaagcaggatccacagaatgctgacttaaagaaacagcttcatgaactccaagccaaaatcacagctttgagtgagaaacagaaaagagtagttgaacagctacggaagaacctgatagtaaagcaagaacaaccggacaagttccaaatacagccattgccacaatctgaaaacaaactacaaacagcacagcagcaaccactacagcaactacaacaacagcagcagtaccaccaccaccacgcccagcagtcagctgcagcctctcccaacctgactgcttcacagaagactgtaactacagcttctatgattaccacaaagacactacctctcgtcttgaaagcagcaactgcgaccatgcctgcctctgtggtgggccagagacctaccattgctatggtgaccgccatcaacagtcagaaggctgtgctcagcactgatgtgcagaacacaccagtcaacctccagacgtctagtaaggtcactgggcctggggcagaggctgtccaaattgtggcaaaaaacacagtcactctgcaggttcaggcaacacctcctcagcccatcaaagtaccacagtttatcccccctcctagactcactccacgtccaaactttcttccacaggttcgacccaagcctgtggcccagaataacattcctattgccccagcaccacctcccatgctcgcagctcctcagcttatccagaggcccgtcatgctgaccaagttcacccccacaacccttcccacatcccagaattccatccaccccgtccgtgtcgtcaatgggcagactgcaaccatagccaaaacgttccccatggcccagctcaccagcattgtgatagctactccagggaccagactcgctggacctcaaactgtacagcttagcaagccaagtcttgaaaaacagacagttaaatctcacacagaaacagatgagaaacaaacagagagccgcaccatcaccccacctgctgcacccaaaccaaaacgggaggagaaccctcagaaacttgccttcatggtgtctctagggttggtaacacatgaccatctagaagaaatccaaagcaagaggcaagagcgaaaaagaagaacaacagcaaatccggtctacagtggagcagtctttgagccagagcgtaagaagagtgcagtgacatacctaaacagcacaatgcaccctgggacccggaagagagccaatgaggaacactggccaaagggtgatattcatgaggatttttgcagcgtttgcagaaaaagtggccagttactgatgtgcgacacatgttcccgtgtatatcatttggactgcttagacccccctctgaaaacaattcccaagggcatgtggatctgtcccagatgtcaggaccagatgctgaagaaggaagaagcaattccatggcctggaactttagcaattgttcattcctatattgcctacaaagcagcaaaagaagaagagaaacagaagttacttaaatggagttcagatttaaaacaagaacgagaacaactagagcaaaaggtgaaacagctcagcaattccataagtaaatgcatggaaatgaagaacaccatcctggcccggcagaaggagatgcacagctccctggagaaggtaaaacagctgattcgcctcatccacggcatcgacctctccaaacctgtagactctgaggccactgtgggggccatctccaatggcccggactgcaccccccctgccaatgccgccacctccacgccggccccttccccctcctcccagagctgcacagcgaactgtaaccagggggaagagactaaataacagagcccctctaggagaagccacgggatcccggcggcaaggagaacagaacactgaagactctagaaaagcaaagccggatttctggaaagtgcagaattcttttggttctttggttccagagagagagaagatgcttgtgccaggtggcaccagagtttgccaattgatccttcttattctgtgtgtacatgcaaagattggaccatgttacatgaaatagtgccagctggaggttctttgccagcaccatgccaagtgaaataatatatttactctctctattatacaccagtgtgtgcctgcagcagcctccacagccacgatgggtttgtttctgttttcttgggtggggagcagggacgggcggagggaggagagcaggtttcagatccttacttgccgagccgtttgtttaggtagagaagacaagtccaaagagtgtgtgggctttcctgtttctaaactttcgctactataaaaccaaaaaaaggaattgagatttcaccaaccccagtgcccagaagagggaaggggagtggctggagggagcagggggtgggacagtgtatcaaataagcagtatttaatcacctctggcgggggcctcgtgcaaggggagactgacaccaagaacagccagtaggttcttctcccctgcactctgctccctgcgcggtaaccccaccactcctgaagcctgcccagtctccttccttccctgcttggtgagtcgcgcatctccgtggttatcccgctgtctcctctccaagaacaagcagagcccgggccactggcccttgcccaaggcagggaagaaggatgtgtgtgtccaggaaggaaaaaaaggtggatcagtgattttacttgaaaacaagctccatcccttttctatatttataagaagagaagatcttgagtgaagcagcacgcgacccaggtgtgtgtgaattgaatggagacgtttcttttctctttctttaatttttgtttttgttctttttttctttaaggaaagttttattttactgttcattttactttcttggtaacaaaaactaaaataaggaatagaaaagctgtttttcaggctgacagtccaattaagggtagccaagaccttgcatggtagagtaggaatcatagtgtcagtgaggtcccgtgagtctttgtgagtccttgtgtcatcgttcgggcactgtttttttatgcaagggcaaaaatctttgtatctggggaaaaaaaacttttttttaaattaaaaaggaaaataaaagatattgaggtcttcctagtgttacttaaattaagatcaaggtaagaaacattgtaaaaaaaaattacaaaagtgctatttgtttcctaaaaacagtgatttctattaaaaaggtgtcagaactgg

SEQ ID NO: 22062 - DNA, 2730 bp, Homo sapiens
cctcctcctcctgcttctcctgctcagagttcctgcctccagctgccaggggggacagccagccagcagcaggaggggggctagagagctgaaggagagccagtttccccaaaattgctgcagtgagaagaggagtttgttactttaaacagaggctgaagaaactatagaattagcagagaaagtggagaaggtagaggatggagttgcagactctacaggaggctcttaaagtggaaattcaggttcaccagaaactggttgctcaaatgaagcaggatccacagaatgctgacttaaagaaacagcttcatgaactccaagccaaaatcacagctttgagtgagaaacagaaaagagtagttgaacagctacggaagaacctgatagtaaagcaagaacaaccggacaagttccaaatacagccattgccacaatctgaaaacaaactacaaacagcacagcagcaaccactacagcaactacaacaacagcagcagtaccaccaccaccacgcccagcagtcagctgcagcctctcccaacctgactgcttcacagaagactgtaactacagcttctatgattaccacaaagacactacctctcgtcttgaaagcagcaactgcgaccatgcctgcctctgtggtgggccagagacctaccattgctatggtgaccgccatcaacagtcagaaggctgtgctcagcactgatgtgcagaacacaccagtcaacctccagacgtctagtaaggtcactgggcctggggcagaggctgtccaaattgtggcaaaaaacacagtcactctggttcaggcaacacctcctcagcccatcaaagtaccacagtttatcccccctcctagactcactccacgtccaaactttcttccacaggttcgacccaagcctgtggcccagaataacattcctattgccccagcaccacctcccatgctcgcagctcctcagcttatccagaggcccgtcatgctgaccaagttcacccccacaacccttcccacatcccagaattccatccaccccgtccgtgtcgtcaatgggcagactgcaaccatagccaaaacgttccccatggcccagctcaccagcattgtgatagctactccagggaccagactcgctggacctcaaactgtacagcttagcaagccaagtcttgaaaaacagacagttaaatctcacacagaaacagatgagaaacaaacagagagccgcaccatcaccccacctgctgcacccaaaccaaaacgggaggagaaccctcagaaacttgccttcatggtgtctctagggttggtaacacatgaccatctagaagaaatccaaagcaagaggcaagagcgaaaaagaagaacaacagcaaatccggtctacagtggagcagtctttgagccagagcgtaagaagagtgcagtgacatacctaaacagcacaatgcaccctgggacccggaagagaggtcgtcctccaaaatacaatgcagtgctggggtttggagcccttaccccaacatccccccaatccagtcatcctgactcccctgaaaatgaaaagacagagaccacattcactttccctgcacctgttcagcctgtgtccctgcccagccccacctccacagacggtgatattcatgaggatttttgcagcgtttgcagaaaaagtggccagttactgatgtgcgacacatgttcccgtgtatatcatttggactgcttagacccccctctgaaaacaattcccaagggcatgtggatctgtcccagatgtcaggaccagatgctgaagaaggaagaagcaattccatggcctggaactttagcaattgttcattcctatattgcctacaaagcagcaaaagaagaagagaaacagaagttacttaaatggagttcagatttaaaacaagaacgagaacaactagagcaaaaggtgaaacagctcagcaattccataagtaaatgcatggaaatgaagaacaccatcctggcccggcagaaggagatgcacagctccctggagaaggtaaaacagctgattcgcctcatccacggcatcgacctctccaaacctgtagactctgaggccactgtgggggccatctccaatggcccggactgcaccccccctgccaatgccgccacctccacgccggccccttccccctcctcccagagctgcacagcgaactgtaaccagggggaagagactaaataacagagcccctctaggagaagccacgggatcccggcggcaaggagaacagaacactgaagactctagaaaagcaaagccggatttctggaaagtgcagaattcttttggttctttggttccagagagagagaagatgcttgtgccaggtggcaccagagtttgccaattgatccttcttattctgtgtgtacatgcaaagattggaccatgttacatgaaatagtgccagctggaggttctttgccagcaccatgccaagtgaaataatatatttactctctctattatacaccagtgtgtgcctgcagcagcctccacagccacgatgggtttgtttctgttttcttgggtggggagcagggacgggcggagggaggagagcaggtttcagatccttacttgccgagccgtttgtttaggtagagaagacaagtccaaagagtgtgtgggctttcctgtttctaaactttcgctactataaaaccaa

SEQ ID NO: 22063 - DNA, 577 bp, Homo sapiens
agccccgtcgtgcacgcagttcccaacacttctcgtcatcctctctttggtctctttattctgctgagcggtgctgttaggatttcttttttttttttttcccctgaccacgttcgcgatgcattgttggaaactgttactacatttttactggaaatactattattcattttaattttgtcttctggaaggagctgcctctgaaatactcttcttctgcttacatgaagatctctaaatgctatccagcaggaggtgctacagcaagataaaggaaatttttgaattttgagggtcttgctacttattacagctctgcttagcttcagctaagcaacaggattaacaccttaaagttccagaaagattttgaggggctagagagctgaaggagagccagtttccccaaaattgctgcagtgagaagaggagtttgttactttaaacagaggctgaagaaactatagaattagcagagaaagtggagaaggtagaggatggagttgcagactctacaggaggctcttaaagtggaaattcaggttcaccagaaactggttgctcaaatgaagcagga

SEQ ID NO: 22064 - DNA, 490 bp, Homo sapiens
actctttccgtttggtccagccccgtcgtgcacgcagttcccaacacttctcgtcatcctctctttggtctctttattctgctgagcggtgctgttaggatttcttttttttttttttcccctgaccacgttcgcgatgtcttctggaaggagctgcctctgaaatactcttcttctgcttacatgaagatctctaaatgctatccagcaggaggtgctacagcaagataaaggaaatttttgaattttgagggtcttgctacttattacagctctgcttagcttcagctaagcaacaggattaacaccttaaagttccagaaagattttgaggggctagagagctgaaggagagccagtttccccaaaattgctgcagtgagaagaggagtttgttactttaaacagaggctgaagaaactatagaattagcagagaaagtggagaaggtagaggatggagttgcagactctacaggaggctcttaaag

SEQ ID NO: 22065 - DNA, 557 bp, Homo sapiens
atctaaaaagtgcgagaggcccagagcagcagcagaagcagcagcagcagctccagcttcttccctccctccccatgaagaagagttccctcctcctcctcctcctgcttctcctgctcagagttcctgcctccagctgccaggggggacagccagccagcagcaggaggctgcagtgagaagaggagtttgttactttaaacagaggctgaagaaactatagaattagcagagaaagtggagaaggtagaggatggagttgcagactctacaggaggctcttaaagtggaaattcaggttcaccagaaactggttgctcaaatgaagcaggatccacagaatgctgacttaaagaaacagcttcatgaactccaagccaaaatcacagctttgagtgagaaacagaaaagagtagttgaacagctacggaagaacctgatagtaaagcaagaacaaccggacaagttccaaatacagccattgccacaatctgaaaacaaactacaaacagcacagcagcaaccactacagcaactacaacaacagcagcagtacc

SEQ ID NO: 22066 - DNA, 546 bp, Homo sapiens
gtgcacgcagttcccaacacttctcgtcatcctctctttggtctctttattctgctgagcggtgctgttaggatttcttttttttttttttcccctgaccacgttcgcgatgcattgttggaaactgttactacatttttactggaaatactattattcattttaattttgctttgaagggtccatcctttttcctattcagtcttctggaaggagctgcctctgaaatactcttcttctgcttacatgaagatctctaaatgctatccagcaggaggtgctacagcaagataaaggaaatttttgaattttgagggtcttgctacttattacagctctgcttagcttcagctaagcaacaggattaacaccttaaagttccagaaagattttgaggggctagagagctgaaggagagccagtttccccaaaattgctgcagtgagaagaggagtttgttactttaaacagaggctgaagaaactatagaattagcagagaaagtggagaaggtagaggatggagttgcagactctacaggaggct

SEQ ID NO: 22067 - DNA, 466 bp, Homo sapiens
gtttggtccagccccgtcgtgcacgcagttcccaacacttctcgtcatcctctctttggtctctttattctgctgagcggtgctgttaggatttcttttttttttttttcccctgaccacgttcgcgatgcattgttggaaactgttactacatttttactggaaatactattattcattttaattttgggggctagagagctgaaggagagccagtttccccaaaattgctgcagtgagaagaggagtttgttactttaaacagaggctgaagaaactatagaattagcagagaaagtggagaaggtagaggatggagttgcagactctacaggaggctcttaaagtggaaattcaggttcaccagaaactggttgctcaaatgaagcaggatccacagaatgctgacttaaagaaacagcttcatgaactccaagccaaaatcacagctttgagtgagaaacag

SEQ ID NO: 22068 - DNA, 637 bp, Homo sapiens
agagggaggtggcggcagcggctagcggactcgagtctcaaccgggctgaggcggacacttctgtggagcgaagcagtgggagcatcgagcactagaggcggcaccgggatccccggctccggggaggggggcgccggaccgggaggaggggagggggcgatgctggaagccatggcggagcccagtcccgaagatccacctccgacccttaagccagagactcagccaccagagaaacggcggagaacaattgaggatttcaacaaattctgcagttttgttttggcatatgctggttacattccccctagcaaagaggaaagtgactggccagcctctggctccagctctccattgcgaggagagagtgcggccgacagtgatggctgggactcggccccctcagatcttcgaaccatccagacttttgttaagaaagcaaagtcatccaagagaagggcagctcaagcaggtcccacccagccaggacccccaaggtccactttctctcgtctgcaggcccccgacagtgctaccttgcttgagaagatgaagctcaaggactctctctttgatctggatgggcccaaagtggcatctcctttgtcccctccctgtgctgccaacaccccctga

SEQ ID NO: 22069 - DNA, 2034 bp, Homo sapiens
aggagggagcaggcggccggcggcgcggggggagggggcccggtccgggagtgcgggaggcagtggtagagggaggtggcggcagcggctagcggactcgagtctcaaccgggctgaggcggacacttctgtggagcgaagcagtgggagcatcgagcactagaggcggcaccgggatccccggctccggggaggggggcgccggaccgggaggaggggagggggcgatgctggaagccatggcggagcccagtcccgaagatccacctccgacccttaagccagagactcagccaccagagaaacggcggagaacaattgaggatttcaacaaattctgcagttttgttttggcatatgctggttacattccccctagcaaagaggaaagtgactggccagcctctggctccagctctccattgcgaggagagagtgcggccgacagtgatggctgggactcggccccctcagatcttcgaaccatccagacttttgttaagaaagcaaagtcatccaagagaagggcagctcaagcaggtcccacccagccaggacccccaaggtccactttctctcgtctgcaggcccccgacagtgctaccttgcttgagaagatgaagctcaaggactctctctttgatctggatgggcccaaagtggcatctcctttgtcccccacatccctgacacatacctcccggccccctgctgctcttacccccgtgcccctttcccagggggacctctcccatcctcctcgaaagaaggaccgaaagaaccgaaagttggggccaggagctggggctggctttggggtgcttcggaggcctcggccaactcctggggatggggaaaagagatctcgaatcaagaagagcaagaagcggaagttaaaaaaggcagaacggggggatagactcccacctcctgggcctccccaggcaccccccagtgatacagactctgaagaggaggaggaagaggaggaagaggaagaagaagaagagatggcaacagtggtagggggtgaagccccagtccctgtgctgccaacaccccctgaggctcctaggccccctgccacagtgcaccctgaaggagtccctcctgctgacagtgaaagcaaggaggtgggcagcactgaaacaagccaagatggagatgccagctccagtgaaggcgagatgcgggtcatggacgaggacatcatggtagaatcaggtgatgactcatgggatctgatcacatgttactgtcgaaagccctttgcagggcggcccatgattgagtgcagcctgtgtgggacgtggatccacctctcctgtgctaagattaagaagaccaacgtccccgacttcttttattgccagaaatgcaaggaactgaggccagaggcccggcggttaggggggcctcccaaatctggagagccctgatggcaccaactttagcctggaacttccaaatgacaacatgatttgggaactgagcctcagggtcctcagcctatcccctggagcttggatactgtctgcacttcaaggcaggaattctcaagggagacttgtttgaaaatgagtgtctcactttcccaccctatccttcctccccactctgtggacttgaaattgaatccattacggttggggatgggaggctgtctgtgtcccgacacataatctctgtctcttggacctgccaccatcactttctgggtcaggattggaattgggatggaatgggacagttgtctataaaactctagtgtaaatattagcactcccctccctcatcttttcttctatttcactccccatttattttcttctacaccggttgtatttttaattttggacttcccctattgggcatggcagctcaaaggtggagtactagagcctggccaagtgaggaaggaaagcagaaaggtgacgattctcactcacctcttttgtttttaataatatcggccgctgtttgtacagacagcctgcgtgttgtaaataaagcagagtgggctcttttgtgttt

SEQ ID NO: 22070 - DNA, 1662 bp, Homo sapiens
agtggccggagagttgctcaggagggaggacgtagaagaggctgagtgaggggcccggtagttcgccgaggtggggtagtttgtggcggtggtaccggagctccgagtagttgccgccggagaatgcccggtgattgtcggagagatccacctccgacccttaagccagagactcagccaccagagaaacggcggagaacaattgaggatttcaacaaattctgcagttttgttttggcatatgctggttacattccccctagcaaagaggaaagtgactggccagcctctggctccagctctccattgcgaggagagagtgcggccgacagtgatggctgggactcggccccctcagatcttcgaaccatccagacttttgttaagaaagcaaagtcatccaagagaagggcagctcaagcaggtcccacccagccaggacccccaaggtccactttctctcgtctgcaggcccccgacagtgctaccttgcttgagaagatgaagctcaaggactctctctttgatctggatgggcccaaagtggcatctcctttgtcccccacatccctgacacatacctcccggccccctgctgctcttacccccgtgcccctttcccagggggacctctcccatcctcctcgaaagaaggaccgaaagaaccgaaagttggggccaggagctggggctggctttggggtgcttcggaggcctcggccaactcctggggatggggaaaagagatctcgaatcaagaagagcaagaagcggaagttaaaaaaggcagaacggggggatagactcccacctcctgggcctccccaggcaccccccagtgatacagactctgaagaggaggaggaagaggaggaagaggaagaagaagaagagatggcaacagtggtagggggtgaagccccagtccctgtgctgccaacaccccctgaggctcctaggccccctgccacagtgcaccctgaaggagtccctcctgctgacagtgaaagcaaggaggtgggcagcactgaaacaagccaagatggagatgccagctccagtgaaggcgagatgcgggtcatggacgaggacatcatggtagaatcaggtgatgactcatgggatctgatcacatgttactgtcgaaagccctttgcagggcggcccatgattgagtgcagcctgtgtgggacgtggatccacctctcctgtgctaagattaagaagaccaacgtccccgacttcttttattgccagaaatgcaaggaactgaggccagaggcccggcggttaggggggcctcccaaatctggagagccctgatggcaccaactttagcctggaacttccaaatgacaacatgatttgggaactgagcctcagggtcctcagcctatcccctggagcttggatactgtctgcacttcaaggcaggaattctcaagggagacttgtttgaaaatgagtgtctcactttcccaccctatccttcctccccactctgtggacttgaaattgaatccattacggttggggatgggaggctgtctgtgtcccgacacataatctctgtctcttggacctgccaccatcactttctgggtcaggattggaattgggatggaatgggacagttgtctataaaactctagtgtaaatatt

SEQ ID NO: 22071 - DNA, 8233 bp, Homo sapiens
ccgcgccgccgccgcacgccgatggctgcggggtctcgcgccgtcgcaccgtccccacgcggcaagcgaccttcgggctcagggcggcggcggctgcaacgaggattaggagggcggcgcggaagccaagaatagtgtcgtcagcagcagccatttggtcccaggaggaaaagaggctgtggcagcgacgccgacgtcctgcgcgtaccccctctccgcggcacccaccgggccccctcctcctcctcttcggcggcggcagcgtccaccatcttcctcttgctgccagtggtagcgctcgtctggcggagctggggctgaaagacacacagaagtcttcatggatatagttgatacatttaatcatttaattcctactgaacacttagatgatgccctatttctaggatccaacctggagaatgaagtctgtgaggattttagtgcaagtcaaaatgtcttagaggactcgctgaagaacatgctcagcgataaggatcctatgctaggatctgcaagtaaccagttctgtttgcctgttttggatagcaatgatcccaatttccagatgccttgttcaacagttgttggtcttgacgatattatggatgaaggagttgttaaagaaagtggcaatgataccattgatgaagaagaactgattttacctaacaggaacttaagggacaaggtagaagaaaattcagtgagatctccaagaaaatcacctcgtttaatggcacaagaacaagtaagaagtttgcgacagagcactattgccaagcgttcaaatgcagcaccattaagtaacacaaaaaaagcatctgggaagactgtatctactgctaaagcaggagtgaaacaaccagaaaggagtcaggttaaagaagaagtatgtatgtcactgaaacctgagtaccataaggagaatagaaggtgcagccgaaatagcggacaaattgaagtggtacctgaagtatcagtgtcttcaagtcattcttcagtgtcatcttgtcttgaaatgaaggatgaagatggattagattctaagcataagtgtaataatccgggagaaatagatgtgccatctcatgaattaaattgttcacttctttcagagacttgtgttactattggagaaaagaaaaatgaagctttgatggaatgtaaagccaagcctgttggtagtccattgtttaagttttcagataaagaagaacatgaacaaaatgattccatttcaggtaaaacgggtgagactgttgttgaagaaatgatagcaacaagaaaagttgaacaagattcaaaggagacagtaaaattatcccatgaagatgaccatattcttgaggacgctggatcttctgatatttctagtgatgctgcttgtacaaatccaaataagacagaaaacagccttgtaggtttgcctagttgtgtagatgaagtgactgaatgtaatttggaattgaaggataccatgggtattgctgataaaactgagaacacccttgaaagaaataaaattgaaccgttgggttattgtgaagatgcggagtctaataggcagttggagagcactgagtttaataaatcaaacttagaggtggttgatactagtacttttggaccggaaagtaatatcttggaaaatgctatttgtgatgtgcctgaccaaaattcaaaacagttgaatgctatagaaagtactaaaatagagtcccatgaaacagcaaaccttcaggatgacagaaacagccagtcaagtagcgtttcttacttagagtcaaaaagtgtaaaatccaaacatacaaaacctgtaattcattctaagcaaaacatgaccacagatgctccgaagaaaattgttgcagcaaagtatgaagtaatacatagcaaaactaaagttaatgtcaaaagtgtgaaacgaaatactgatgtaccagaatctcagcaaaattttcataggccagtcaaagtcagaaaaaaacaaattgataaggagccaaagattcagagttgcaattctggggttaaatctgtgaaaaaccaagctcattctgtactgaaaaaaacattacaggatcaaactttagtacaaattttcaagcccttaactcattctttgagtgataagtcacacgctcatcctggttgcttgaaagaacctcatcatcctgcacaaactggacatgtatcacattctagccagaaacagtgtcataagcctcagcaacaggccccagcaatgaaaaccaatagtcacgtgaaggaagagcttgaacacccaggcgttgagcattttaaggaagaggataaactgaaactgaaaaaacctgagaagaacctacaaccccgccaaagaagaagcagcaaaagtttttctttagatgagccaccattgttcattccagataacatagctaccataagaagagaaggctctgatcatagctcctcatttgaaagcaaatatatgtggactcccagcaagcagtgtgggttttgcaaaaaaccacatggcaacaggtttatggttggctgtgggagatgtgatgactggtttcatggtgattgtgttgggttaagtctttctcaagcacagcagatgggcgaggaagacaaagaatatgtctgtgtaaaatgttgtgctgaagaagacaaaaagactgaaatactagatccagatactttggaaaaccaagctacagttgaattccatagtggagataaaacaatggagtgtgaaaagcttggattatcaaaacacacaacaaatgatagaaccaaatatatagatgatacagtgaagcacaaggtcaaaattttaaaacgggagtctggtgaaggcagaaattcatcagactgtagagataatgaaattaaaaaatggcagctagctcctcttcgtaagatgggacaaccagttttacctcggagatcctcagaagaaaaaagtgaaaaaataccgaaagagtctacaactgttacttgcacaggagaaaaagcttcaaaaccaggtactcatgagaagcaagagatgaaaaagaagaaagttgaaaaaggagtgcttaatgtacatcctgctgcttctgcttccaagccttctgcagatcagatcaggcaaagtgtcagacattctctcaaagacattcttatgaagagacttacagactcaaatttgaaggtaccagaggaaaaggcagcaaaagttgccacaaaaattgagaaagagcttttctctttttttcgggacacagatgctaaatataagaacaaatatagaagtttgatgtttaatttgaaagatcctaaaaacaatatattatttaaaaaagtactgaaaggagaagtaactcctgatcatcttatcagaatgagtccagaagaactagcttctaaagagttagctgcttggagacgaagagaaaacagacataccatagaaatgattgagaaagagcagagagaagtggaacgacggccaatcaccaaaataactcataaaggtgaaatagaaattgagagtgatgccccaatgaaagaacaggaagcagccatggagattcaggaaccagccgccaataagtcattggagaagccagaaggatctgaaaaacaaaaagaggaggttgactctatgtctaaagataccactagtcaacacagacagcatctttttgatctcaactgcaaaatctgcataggtcgaatggcaccacctgtagatgatctttctccaaaaaaagtaaaagttgttgtaggagtagctcgcaaacattcagacaatgaagcagaaagtatagcagatgcattatcttcaacctcaaatattttggcttctgaattctttgaggaggagaaacaggagtctccaaagtcaacgttctctcctgctccacgtccagagatgcctggaactgttgaagttgagtctacctttctggctcgattgaacttcatctggaaaggttttatcaacatgccttctgtggcaaaatttgttaccaaagcctatccagtatctggctccccagaatacctgacagaggacctaccagatagtattcaagtaggtggcaggatatcacctcagacagtttgggattatgtggaaaaaataaaagcatcaggaaccaaggaaatttgtgtggttcgcttcacaccagtaactgaagaagatcaaatttcttatactttgctctttgcatacttcagtagcagaaagcgctatggagtagctgctaacaacatgaagcaggttaaagatatgtaccttattcctttgggtgccacagataaaattccacaccctcttgtgccttttgatggacctgggcttgaactgcatagacctaatctattgttgggcttaattattcgtcagaaactgaagcgacagcacagtgcctgtgctagtactagtcatatagctgagactcctgaaagtgcaccaccaatagcattgccacctgataaaaaaagtaaaatagaagtttctacagaagaagcaccagaggaagaaaatgacttttttaattcttttacaactgtattacacaagcagagaaataaacctcagcagaatcttcaggaagaccttccaacagcagttgaacctttaatggaagtcaccaaacaggagccaccaaaacctttaagatttcttcctggcgtgttgattggctgggagaatcaacctactactctggaattagcaaataaacctcttcctgtggatgatatacttcaaagccttttgggcaccactggtcaagtatatgaccaggcccagtcagtgatggaacaaaacactgttaaagaaattccatttttaaatgagcagaccaactcaaaaatagagaaaacagataatgtggaagtaactgatggtgaaaacaaggagataaaagttaaagtagataatatttcagaatctacagataagtcagcagaaatagaaacatcagtagtagggtcctcttccatttctgcagggtctttgacgagtcttagtctcagaggtaagccaccagatgtttctacagaagcatttttaacaaatttatcaattcagtcaaaacaagaggaaactgtggagagtaaagagaaaacattaaaaagacagcttcaggaagatcaagagaataatttgcaagataaccagacttcaaatagttctccatgcagatctaatgtaggaaaaggaaacatagatggtaatgtgagctgtagtgaaaaccttgttgctaatacagcgaggtctccacagtttatcaacctgaaaagggatcctaggcaagcagcaggacgaagtcagcctgtaactacttcagaaagcaaagatggagatagttgccggaatggagaaaaacacatgctgcctggcctgtcacacaacaaggagcacttaacagaacaaatcaatgtagaggaaaagttgtgttctgcagagaaaaactcgtgtgttcagcagagtgacaatttaaaagttgcacaaaactcaccatcagtagaaaacatacagacttctcaagcagaacaagcaaaacccttacaggaggatattttaatgcaaaatattgaaactgtgcacccatttcgaagaggatcagcagtagcgacatctcattttgaagttggaaacacatgtccatcagaatttccttctaaaagcatcacctttacttccagaagcaccagccccagaacaagtacaaacttttcacccatgaggccacagcagcccaaccttcagcatctcaagtctagcccacctggatttccatttccagggcctcctaattttcccccacaaagcatgtttggatttccaccacatttgccacctccattacttccccctccaggctttggctttgctcaaaatcccatggttccctggccacctgttgttcatctcccaggtcagccacagcgtatgatgggtcctctctcacaagcatcaaggtatataggcccgcagaatttttaccaggttaaagacattcggaggccagaaaggcgccatagtgacccttggggtaggcaagaccaacagcaactggataggccatttaataggggtaaaggggaccgccagagattttatagtgattcacaccatttgaaaagagagcgacatgaaaaggaatgggagcaagaatctgaaaggcatagacgcagagacagaagccaagacaaggacagagacagaaaaagcagggaggaagggcacaaagataaagagagggcacggttatcacatggtgatcgaggaacagatggaaaagcaagcagagatagtaggaatgtagacaagaagccagataaacctaaaagtgaagactatgagaaggacaaagaacgagagaaaagtaaacacagagaaggagaaaaggacagggataggtaccacaaagatagggaccacactgacagaactaaaagcaaaaggtaaaatttgcaggctgcttcaggattacatttaaataactgttaaaatgttgtatcttgtaaacaaaagaaagattgcctgctaggattgtgccatctttaaaatttttactattggtcatttgcagaacagtaaattctgtgtgttggtacagagtgctctgtaccagtgctcatcatcccttcttcataccaacggtccctagttataggaatttaatatttttaaaagttttacattgctgtatattcaaagatttgttttattaatatgcaataaaggcttagaaattttagttttattccttaattggtaaatatggttaactatggaatatatttacttcctctagtgaatgtcctttatataatgactaatttgggagtaatgtgtgctctgtaagtttgttttaaattgcactgtttttaaagaaactgtagaggagcaacaaaaatccaagcaacttcataatcagattatgctaatcatttagttgagcagtttttgaccaagaatcagaagcccaaggggtacatttattgctttaatctgcactcattgaagtcatttattaccatatactacagctttgtggtaggccattattttcattttcatttttggctcttcagaaacttgaatacttaagcttgtacatgatcttgtgttttgctatcctttttactgtaaaatgtaaatattttaagggatattttgattctaaatatgataaaataatttctcacctattttgtgtgtgtgacttgaaattcagtagtaaaagaatttcttctttaaagctttaattaccttcagacattgattttttgttactcagccaagaacatatagaaatagctatctatgtcaggcattagatgaggggaaaaacaatttttttaaaatcttaaattgtaggctgagatgaattgtgtagttctaaagaggctagaatttagaactacctgtgaaacactgtgcagctatagcccactttataggtaagtttctgaaaacttttacaccatcgcaatttggtactctgactcactaatcattaaaattaaagaccgcagaacttgaagagaaatatgttttgaatccttttataaaatgtgcgatttagcctaattcgtaaagtaactgtacagtttcatatgccagttttacttgaaaaaaaaatatgaaaactattgttaattcaaatctaaatttatttaaaccctaaaacacatggttttgatggctgtaatttaaagtaagagctatcaaatgatgctgacaaaagaaaaaccttccaaaatacaaaagaaagagaactctattatttacttacctgtattaatgaagaaaaatataaataattccacaaaattgattgttttcctaaagagcttaaagattagagttaaaaattggttttgaaacagaattatccttgttatttttgctggagagaagggaggaaattcagaaccaaacattctatttaatttgcaatgacttgcagtacttttttccctatccttatcctgtgaaacttactatcataaggttctaaaacagagaacttgtgtttaaataaagcccgtttaactttggtccacttttcttttggaaattaacttgttagaaaacaaagttagttcccaaacaaaacaaaatctaagttataatttgcaccattacaaagaaattgctgtcagggttttacacattttaaaaacatttcaatttcaaatgtgtatatcgtcaataaatctacctttactgata

SEQ ID NO: 22072 - DNA, 6947 bp, Homo sapiens
gggctgaaagacacacagaagtcttcatggatatagttgatacatttaatcatttaattcctactgaacacttagatgatgccctatttctaggatccaacctggagaatgaagtctgtgaggattttagtgcaagtcaaaatgtcttagaggactcgctgaagaacatgctcagcgataaggatcctatgctaggatctgcaagtaaccagttctgtttgcctgttttggatagcaatgatcccaatttccagatgccttgttcaacagttgttggtcttgacgatattatggatgaaggagttgttaaagaaagtggcaatgataccattgatgaagaagaactgattttacctaacaggaacttaagggacaaggtagaagaaaattcagtgagatctccaagaaaatcacctcgtttaatggcacaagaacaagtaagaagtttgcgacagagcactattgccaagcgttcaaatgcagcaccattaagtaacacaaaaaaagcatctgggaagactgtatctactgctaaagcaggagtgaaacaaccagaaaggagtcaggttaaagaagaagtatgtatgtcactgaaacctgagtaccataaggagaatagaaggtgcagccgaaatagcggacaaattgaagtggtacctgaagtatcagtgtcttcaagtcattcttcagtgtcatcttgtcttgaaatgaaggatgaagatggattagattctaagcataagtgtaataatccgggagaaatagatgtgccatctcatgaattaaattgttcacttctttcagagacttgtgttactattggagaaaagaaaaatgaagctttgatggaatgtaaagccaagcctgttggtagtccattgtttaagttttcagataaagaagaacatgaacaaaatgattccatttcaggtaaaacgggtgagactgttgttgaagaaatgatagcaacaagaaaagttgaacaagattcaaaggagacagtaaaattatcccatgaagatgaccatattcttgaggacgctggatcttctgatatttctagtgatgctgcttgtacaaatccaaataagacagaaaacagccttgtaggtttgcctagttgtgtagatgaagtgactgaatgtaatttggaattgaaggataccatgggtattgctgataaaactgagaacacccttgaaagaaataaaattgaaccgttgggttattgtgaagatgcggagtctaataggcagttggagagcactgagtttaataaatcaaacttagaggtggttgatactagtacttttggaccggaaagtaatatcttggaaaatgctatttgtgatgtgcctgaccaaaattcaaaacagttgaatgctatagaaagtactaaaatagagtcccatgaaacagcaaaccttcaggatgacagaaacagccagtcaagtagcgtttcttacttagagtcaaaaagtgtaaaatccaaacatacaaaacctgtaattcattctaagcaaaacatgaccacagatgctccgaagaaaattgttgcagcaaagtatgaagtaatacatagcaaaactaaagttaatgtcaaaagtgtgaaacgaaatactgatgtaccagaatctcagcaaaattttcataggccagtcaaagtcagaaaaaaacaaattgataaggagccaaagattcagagttgcaattctggggttaaatctgtgaaaaaccaagctcattctgtactgaaaaaaacattacaggatcaaactttagtacaaattttcaagcccttaactcattctttgagtgataagtcacacgctcatcctggttgcttgaaagaacctcatcatcctgcacaaactggacatgtatcacattctagccagaaacagtgtcataagcctcagcaacaggccccagcaatgaaaaccaatagtcacgtgaaggaagagcttgaacacccaggcgttgagcattttaaggaagaggataaactgaaactgaaaaaacctgagaagaacctacaaccccgccaaagaagaagcagcaaaagtttttctttagatgagccaccattgttcattccagataacatagctaccataagaagagaaggctctgatcatagctcctcatttgaaagcaaatatatgtggactcccagcaagcagtgtgggttttgcaaaaaaccacatggcaacaggtttatggttggctgtgggagatgtgatgactggtttcatggtgattgtgttgggttaagtctttctcaagcacagcagatgggcgaggaagacaaagaatatgtctgtgtaaaatgttgtgctgaagaagacaaaaagactgaaatactagatccagatactttggaaaaccaagctacagttgaattccatagtggagataaaacaatggagtgtgaaaagcttggattatcaaaacacacaacaaatgatagaaccaaatatatagatgatacagtgaagcacaaggtcaaaattttaaaacgggagtctggtgaaggcagaaattcatcagactgtagagataatgaaattaaaaaatggcagctagctcctcttcgtaagatgggacaaccagttttacctcggagatcctcagaagaaaaaagtgaaaaaataccgaaagagtctacaactgttacttgcacaggagaaaaagcttcaaaaccaggtactcatgagaagcaagagatgaaaaagaagaaagttgaaaaaggagtgcttaatgtacatcctgctgcttctgcttccaagccttctgcagatcagatcaggcaaagtgtcagacattctctcaaagacattcttatgaagagacttacagactcaaatttgaaggtaccagaggaaaaggcagcaaaagttgccacaaaaattgagaaagagcttttctctttttttcgggacacagatgctaaatataagaacaaatatagaagtttgatgtttaatttgaaagatcctaaaaacaatatattatttaaaaaagtactgaaaggagaagtaactcctgatcatcttatcagaatgagtccagaagaactagcttctaaagagttagctgcttggagacgaagagaaaacagacataccatagaaatgattgagaaagagcagagagaagtggaacgacggccaatcaccaaaataactcataaaggtgaaatagaaattgagagtgatgccccaatgaaagaacaggaagcagccatggagattcaggaaccagccgccaataagtcattggagaagccagaaggatctgaaaaacaaaaagaggaggttgactctatgtctaaagataccactagtcaacacagacagcatctttttgatctcaactgcaaaatctgcataggtcgaatggcaccacctgtagatgatctttctccaaaaaaagtaaaagttgttgtaggagtagctcgcaaacattcagacaatgaagcagaaagtatagcagatgcattatcttcaacctcaaatattttggcttctgaattctttgaggaggagaaacaggagtctccaaagtcaacgttctctcctgctccacgtccagagatgcctggaactgttgaagttgagtctacctttctggctcgattgaacttcatctggaaaggttttatcaacatgccttctgtggcaaaatttgttaccaaagcctatccagtatctggctccccagaatacctgacagaggacctaccagatagtattcaagtaggtggcaggatatcacctcagacagtttgggattatgtggaaaaaataaaagcatcaggaaccaaggaaatttgtgtggttcgcttcacaccagtaactgaagaagatcaaatttcttatactttgctctttgcatacttcagtagcagaaagcgctatggagtagctgctaacaacatgaagcaggttaaagatatgtaccttattcctttgggtgccacagataaaattccacaccctcttgtgccttttgatggacctgggcttgaactgcatagacctaatctattgttgggcttaattattcgtcagaaactgaagcgacagcacagtgcctgtgctagtactagtcatatagctgagactcctgaaagtgcaccaccaatagcattgccacctgataaaaaaagtaaaatagaagtttctacagaagaagcaccagaggaagaaaatgacttttttaattcttttacaactgtattacacaagcagagaaataaacctcagcagaatcttcaggaagaccttccaacagcagttgaacctttaatggaagtcaccaaacaggagccaccaaaacctttaagatttcttcctggcgtgttgattggctgggagaatcaacctactactctggaattagcaaataaacctcttcctgtggatgatatacttcaaagccttttgggcaccactggtcaagtatatgaccaggcccagtcagtgatggaacaaaacactgttaaagaaattccatttttaaatgagcagaccaactcaaaaatagagaaaacagataatgtggaagtaactgatggtgaaaacaaggagataaaagttaaagtagataatatttcagaatctacagataagtcagcagaaatagaaacatcagtagtagggtcctcttccatttctgcagggtctttgacgagtcttagtctcagaggtaagccaccagatgtttctacagaagcatttttaacaaatttatcaattcagtcaaaacaagaggaaactgtggagagtaaagagaaaacattaaaaagacagcttcaggaagatcaagagaataatttgcaagataaccagacttcaaatagttctccatgcagatctaatgtaggaaaaggaaacatagatggtaatgtgagctgtagtgaaaaccttgttgctaatacagcgaggtctccacagtttatcaacctgaaaagggatcctaggcaagcagcaggacgaagtcagcctgtaactacttcagaaagcaaagatggagatagttgccggaatggagaaaaacacatgctgcctggcctgtcacacaacaaggagcacttaacagaacaaatcaatgtagaggaaaagttgtgttctgcagagaaaaactcgtgtgttcagcagagtgacaatttaaaagttgcacaaaactcaccatcagtagaaaacatacagacttctcaagcagaacaagcaaaacccttacaggaggatattttaatgcaaaatattgaaactgtgcacccatttcgaagaggatcagcagtagcgacatctcattttgaagttggaaacacatgtccatcagaatttccttctaaaagcatcacctttacttccagaagcaccagccccagaacaagtacaaacttttcacccatgaggccacagcagcccaaccttcagcatctcaagtctagcccacctggatttccatttccagggcctcctaattttcccccacaaagcatgtttggatttccaccacatttgccacctccattacttccccctccaggctttggctttgctcaaaatcccatggttccctggccacctgttgttcatctcccaggtcagccacagcgtatgatgggtcctctctcacaagcatcaaggtatataggcccgcagaatttttaccaggttaaagacattcggaggccagaaaggcgccatagtgacccttggggtaggcaagaccaacagcaactggataggccatttaataggggtaaaggggaccgccagagattttatagtgattcacaccatttgaaaagagagcgacatgaaaaggaatgggagcaagaatctgaaaggcatagacgcagagacagaagccaagacaaggacagagacagaaaaagcagggaggaagggcacaaagataaagagagggcacggttatcacatggtgatcgaggaacagatggaaaagcaagcagagatagtaggaatgtagacaagaagccagataaacctaaaagtgaagactatgagaaggacaaagaacgagagaaaagtaaacacagagaaggagaaaaggacagggataggtaccacaaagatagggaccacactgacagaactaaaagcaaaaggtaaaatttgcaggctgcttcaggattacatttaaataactgttaaaatgttgtatcttgtaaacaaaagaaagattgcctgctaggattgtgccatctttaaaatttttactattggtcatttgcagaacagtaaattctgtgtgttggtacagagtgctctgtaccagtgctcatcatcccttcttcataccaacggtccctagttataggaatttaatatttttaaaagttttacattgctgtatattcaaagatttgttttattaatatgcaataaaggcttagaaattttagttttattccttaattggtaaatatggttaactatggaatatatttacttcctctagtgaatgtcctttatataatgactaatttgggagtaatgtgtgctctgtaagtttgttttaaattgcactgtttttaaagaaactgtagaggagcaacaaaaatccaagcaacttcataatcagattatgctaatcatttagttgagcagtttttgaccaagaatcagaagcccaaggggtacatttattgctttaatctgcactcattgaagtcatttattaccatatactacagctttgtggtaggccattattttcattttcatttttggctcttcagaaacttgaatacttaagcttgtacatgatcttgtgttttgctatcctttttactgtaaaatgtaaatattttaagggatattttgattctaaatatgataaaataatttctcacctattttgtgtgtgtgacttgaaattcagtagtaaaagaatttcttctttaaagcttt

SEQ ID NO: 22073 - DNA, 4759 bp, Homo sapiens
aagggcgctccgcgagcccgtctctcctcgaatgaaaggaaacaacctccggcgacagagccccgctctcaggcactgctggagaaccgagaccgacttctttctctttaccctcattggcgcttctctcctgcagtccgcctctgggccctgccgcatttcttgagacttaaagtggcattctaaaggcaatttaaaaatcatgtcaagctcagttgaacagaaaaaagggcctacaagacagcgcaaatgtggcttttgtaagtcaaatagagacaaggaatgtggacagttactaatatctgaaaaccagaaggtggcagcgcaccataagtgcatgctcttttcatctgctttggtatcatcacactctgataatgaaagtcttggtggattttctattgaagatgtccaaaaggaaattaaaagaggcacgaagctgatgtgttctttgtgccattgtcctggagcaacaattggttgtgatgtgaaaacatgtcacaggacataccactaccactgtgcattgcatgataaagctcaaatacgagagaaaccttcacaaggaatttacatggtctattgccgaaaacacaagaaaactgcacataactccgaagctgatttagaagaaagttttaatgaacatgaactggagccctcatcacctaaaagtaaaaagaaaagtcgcaaaggaaggccaagaaaaactaattttaaagggctgtcagaagataccaggtccacatcctcccatggaacagatgaaatggaaagtagttcctatagagataggtctccacacagaagcagccctagtgacaccaggcctaaatgtggattttgccatgtaggggaggaagaaaatgaagcacgaggaaaactgcatatatttaatgccaagaaggcagctgcccattataagtgcatgttgttttcttctggcacagtccagctcacaacaacatcaagagcagaatttggagactttgatattaaaactgtacttcaggagattaaacgaggaaaaagaatgaaatgtacactttgcagtcagcctggtgctactattggatgtgaaataaaagcctgtgttaagacttaccattaccactgtggagtacaagacaaagctaaatacattgaaaatatgtcacgaggaatttacaaactatactgtaaaaatcatagtggaaatgatgagagagatgaagaagatgaggaacgagagagtaaaagccgaggaaaagtagaaattgatcagcaacaactaactcagcagcaacttaatggaaactaggtatgaaagttaattatatgggatctgttgtcaggatacaatacacactgatatatacatgttgaagtaatggtatgcagtaagattttttttaatcctattatgtttagttaagagcatgttactaaaatgctgaggattttgtaggcttgcatagtagttgttttttaactagctgattttgtaaccataaaaacaagctatctgctttatcaataagtgtagttgtaatgtcaaatcaataagatattcacactcctcaataacattatattgattgtgttcccctcaagcatcatattttacatttttttatcatcttttaaacaggttcatgggacagagttagaaaactgggaatgaataagacatccataactactattcttttttcactgttttctaaaatcaaaaagggtttgtaactttttactgcccaactcttagatccttcattgaactgcctaaaaatgtcttgtttgttttatgagccctcactagaaggctgagtttgacatgttgatattacgtagctatagtttgcagtttctgggaagcaattgaaacactattaaccctgtgtatagtgtcaacagttaaagcagacgaaacgaagtaagctatatttctggactgaacaaagctctgctgtttagagcatttaagtttgtttagtggatccatactcaaaggaaagcataagcaaattttcctttacaatgcaaacatgccactggtggcagcacatggtaatttgtggatttttttttcatactcaagtaatggaggctagaaatgaagagaaccttctttttctcttgactttgacagcacatgctaaaaatctcttccaagaagtatgctaaagcttttcatttggttcctgttaaagttgttctcactgaccagcatggactcaggcaactggtaatgataagctatgagctccagtgcttttgccaaaattctcttgacagcacacctcctctctttccatgttatacaaaggacttctggcaaaatgattgagtccttcaagtttaaactaacatttggcaacagcaaattaaacgtttttaagatgtaaagaaagggttaccgcttgctaaggacttcagacaccatgtccgaaacctgttcctctcaagtgccctgttgtgtggaacacttcacatattggcgcacagtacgtaaggaggtctcatgtgctgtaggagtaaaaaagtctttgcataaaacagtatttatttttacttttgtgaccactattttagaaactttatttaatattttaatgttttcagtcattgctttggttatctataaaataggcttttgtgccctacttttcttcttgtagggcttggtggtgttttatcgattgtcagaattgtttttgaaagcctaagaacccagctttttagaaaggattttcacactggcatttctaggtagtgatattttcttccacttacctgctgaagcacatttatgcatttctttatggcaaaaccaaataactttagttgtggtctgcctgatactaccatagcacctcagtaccaaggggagggattttgactagttgaattattaagccaccacaataaagcagatttttaaataagaaataataatgttaacttgactgtacattgagatattctgcagctgatagagcagcattttaaaaatgtaacaggtggaaaattacactgtgcttaatgactgatttttttttaaactgcgagtcccttaagatcacgtttgtcaagtgtgtattcacacatttacttaaatcaagggactcaatgcttgcttttattttaaccatcttttactatttttagaaggaaactagctttagtagtgggttgccctgtatgttttctctttttgctcttaatatgccattgggtttttgtgtgtatgtgattttcaaaattcatgacttgaagtgcaaggacagatctagatgtttgtttaccaagctatgtgacttctcccaaaggatctgtactttctttccttacaacagcttgaaaatcattattttaaaatccttaaatcactgtgtctagatcattttttacattgtgtgccatagacttacccatgggacaacagagctccttcatttttggacaactactgtaatcattttttttttaggaaaaatggaaggtgccgggggtaatcatggccagtcaataattatataaaggagttcaaatactatagctgtcagttgatgaatttgttatgtagtaaaatgtatgactttgtatgggtttcttcagccctttttctgccactagcaaccagaatagcactttaccttttggttggctagataagtggctgactacctgtttttctcactgtggtgtgattggctaaacaatctcgcattaaaaattcaaatgtaaattgaattcacatgaaaaatcatgtttggttgtaaacctccaatgttttgattctctaatcatgttttcgtcacatgctgagtaaaagtgccttacaatgtaaaaattgtacagtacttatgttcccaagtagcatcatcatcttctgggtagtaattacattgtggtattaatatttagaaaaatggacctcagcagtgtatttactgtacatctcttaagtccttaactgtagttttaataagcatgacattatttgataagtatataacatttacatcatttcaaaaaatactgccgttactgtcttttatgcatattttagcctgaaattttgaagcgtcttttttctttcttttttctttttttgttttgttttttgttattgatattaaacagtgtaatctttgcaagcgtatattgaagattattctggagcatttattgccttaccagaaatgttagtaggaaatgttctttagagtagaaagatagacttgagtttctatacttttaagaagagctctttgttcctgggggaggggggcagggggtgaattttactttcatctcaagttattaaaaacccacaactgaagtaaattttatttcaagaatcagcagttttagaatttcagatagtacttgctcagaagtacatgctactcaagatattaagagataacaagatctgtagatctgctattgaatcagaatctgtgtacttgaacaaatgtgtgaatctcaaatatctcaaagcaaaagaaaaagtgttctagagtgttgttgcttttttaaaaaaagcgctgaagttagaccaaggtatacagttttgttctaacagacatttaggttaattgtaaagataaggaatgcattatgggtcaaaaatcaaacattcctctcatgttatgtatattttgttcctgttatattggctttattttcaaaattgtagtttgtagtattagtttccttttattggtattcttgcatatactattcattcaataaatgacttatgactttc

SEQ ID NO: 22074 - DNA, 4186 bp, Homo sapiens
tccgcgagcccgtctctcctcgaatgaaaggaaacaacctccggcgacagagccccgctctcaggcactgctggagaaccgagaccgacttctttctctttaccctcattggcgcttctctcctgcagtccgcctctgggccctgccgcatttcttgagacttaaagtggcattctaaaggcaatttaaaaatcatgtcaagctcagttgaacagaaaaaagggcctacaagacagcgcaaatgtggcttttgtaagtcaaatagagacaaggaatgtggacagttactaatatctgaaaaccagaaggtggcagcgcaccataagtgcatgctcttttcatctgctttggtatcatcacactctgataatgaaagtcttggtggattttctattgaagatgtccaaaaggaaattaaaagaggcacgaagctgatgtgttctttgtgccattgtcctggagcaacaattggttgtgatgtgaaaacatgtcacaggacataccactaccactgtgcattgcatgataaagctcaaatacgagagaaaccttcacaaggaatttacatggtctattgccgaaaacacaagaaaactgcacataactccgaagcagctgatttagaagaaagttttaatgaacatgaactggagccctcatcacctaaaagtaaaaagaaaagtcgcaaaggaaggccaagaaaaactaattttaaagggctgtcagaagataccaggtccacatcctcccatggaacagatgaaatggaaagtagttcctatagagataggtctccacacagaagcagccctagtgacaccaggcctaaatgtggattttgccatgtaggggaggaagaaaatgaagcacgaggaaaactgcatatatttaatgccaagaaggcagctgcccattataagtgcatgttgttttcttctggcacagtccagctcacaacaacatcaagagcagaatttggagactttgatattaaaactgtacttcaggagattaaacgaggaaaaagaatgaaatgtacactttgcagtcagcctggtgctactattggatgtgaaataaaagcctgtgttaagacttaccattaccactgtggagtacaagacaaagctaaatacattgaaaatatgtcacgaggaatttacaagtaagaaaacaacagttgtctatttccctaaacatgttagtaaccgtccttaaatagatgacattagtttactcagtctctgttcttaaatggtgtttagttaagtatagaatactgagcacattatgtaaggaatgagtactacaattggcattttcctctgactacatatccctggattagcattcatccatccaatattagttaggcttcctatgtgccagccattgtgcttgaagctgggcatatgccagtgatcaaaactacatacactgggccgggtgcggtggctcacatctgtaatcccagcactttgggaggccgaggcgggtgaatcacctgaggtcagaagttcgagaccagcctgaccaacatggtgaaaccccgtctctactaaaatacaaaaattacccaggtgtggtggcaggcacctgtaatcccagctactcgggaggctgaggcaggagaatcgcttgaacccaggaggcagaggttgcagtgagccaagattgcgccattgcactccagcctgagcaacaagagtgaaattccatctcaaacaaacaaaaaaaaaacactacatatactctcctcatgaagcttacagtctattgggagagacctattatttaagtggccaaatatgcaattacaacatagcagcgtaagtgttctaaagaagttacaaagtgttatgagagcgtataagaaggaagagctaacctagtctgtagtggggagtatttaaaatgttctgaaggaaatagtgctcagctttaagctgagatattaaggacaaaggtgagccttggttgggggaggtattctgggcagagagaagagcatatgcaagagccccgggtgagacagaagcagaggtggaaatggggagatgtgttaggaggctagtgctggtggtccaggtgagaattattggtagcttagaataggatatggtagacagaaggcaaaagattctcttgagaagatggtgaaaaagtaaagtatgaagatttgggattgggggtcaccctcttttttatgggtcttccacttacctgtgctgccttgtgctaggtggtgttaatgtatatctgtaatggttccatttgtttaatcgactggagtataagttggtagggactcttgaagttttgatttgccatccagagttgtaaagcacttccttactctcacatgcctagaatgcaataaaccaatgacttccgggtctagtattctgtgtaaaagacaatgtacacaagcagtcaccaagtcatttgggtgcctacataaggcgctatgctgtataataaaatttgccaaattctgtttaataataaaggcacaaatgttttcaagtgagttctataaagcctttaaggaacaaataatcccaatgttatttaagaggtccagcacatagcaagagatggaaaacttattgattcattctgtaaagcttacataactgtggtaccaaacctaacaaagatacgttaaaagaaaaacaaacaaactgtagaccaatctccccttttttttttttttttactttgagacaggatctgactctgttgtccaggctggagtgcagtagtgtgatcatgactcactgcagccttgaccttctgccctcacgtgatcctcccaactcagcctcccgagtagctgggactataggcgcatgccatcatgcccagctaattttttttgttttgttttttgaggaggaggaagggttttgttttgttgcccagactggtctcaaactcctgggctcaagcgttctccctgcctcagtcttctaaagtgctaggattacaggcatgagccatgcccagccacaatctcacttttataaatatacaaaaattctaaataaaatattagtaaatcaaatccagctctgtattctaagaattgaaagactgttcaggctgggcacagtggctcacacttataatctcaacactttgggaggcttaggtgggaggattgcttgaggccaggagttccagatcagtgtgggcaacaaagcgagactctcatctctatataattttaaaaatagaaagaaaaaagactgttcaaaattaggaaatatattaatataatttattagaattagtagagtaaataatcttatcaccttccttatagatggtgaaaagacatttgataacattcaacatcaatttctgaattttaaagtaacgagtgctcttggtaagctaggaatcttaataggtgtttatgagaaaaacaacagcaaataacttatttattattaaagtgaaggagcaatggttcttaaccaggagtgagcctcagaatcactgtggggtggataaggccctcttttaaaatgttcatgtctaagccctacctgtagagatttaaatttagtaggtctgggttggtgcccaaaccatgcacttttctgactccccaggtgattcttatgttcccctctaattgagaaccattagactatactttaattcagattaggaagaagacaaggatgccaactactagcatgacttttaacattcttctagagggttaagctgatgcaagacaaaaagaaagaggcccagtgcattgactcacgtctataatcccacacttgggaggccaaagcgagaggattgcttgaggccaggaattcgagaccaacctgggcaacatagtgagaccccatctctacacaacatttaaaaattagccaggcaaagtggcacacgcctgtagccccagctatacaggaggcccagactggaggattgcctgagccctggaggtagagaccagcctgggcaacatagtgagaccctgtctcaatttaaaaaataaaagaaggccgggcgcagtggctcacgcctgtaatctcaacactttgggaggccgaggctggcagatcacgaggtcaggagtttgagaccagcttcgagatcgccccactgcactccagcctgggcgacagagcgaaactctgtctcaaaaaaaaaaaaaaaa

SEQ ID NO: 22075 - DNA, 1150 bp, Homo sapiens
cccgctctcaggcactgctggagaaccgagaccgacttctttctctttaccctcattggcgcttctctcctgcagtccgcctctgggccctgccgcatttcttgagacttaaagtggcattctaaaggcaatttaaaaatcatgtcaagctcagttgaacagaaaaaagggcctacaagacagcgcaaatgtggcttttgtaagtcaaatagagacaaggaatgtggacagttactaatatctgaaaaccagaaggtggcagcgcaccataagtgcatgctcttttcatctgctttggtatcatcacactctgataatgaaagtcttggtggattttctattgaagatgtccaaaaggaaattaaaagaggcacgaagctgatgtgttctttgtgccattgtcctggagcaacaattggttgtgatgtgaaaacatgtcacaggacataccactaccactgtgcattgcatgataaagctcaaatacgagagaaaccttcacaaggaatttacatggtctattgccgaaaacacaagaaaactgcacataactccgaagcagctgatttagaagaaagttttaatgaacatgaactggagccctcatcacctaaaagtaaaaagaaaagtcgcaaaggaaggccaagaaaaactaattttaaagggctgtcagaagataccaggtccacatcctcccatggaacagatgaaatggaaagtagttcctatagagataggtctccacacagaagcagccctagtgacaccaggcctaaatgtggattttgccatgtaggggaggaagaaaatgaagcacgaggaaaactgcatatatttaatgccaagaaggcagctgcccattataagtgcatgttgttttcttctggcacagtccagctcacaacaacatcaagagcagaatttggagactttgatattaaaactgtacttcaggagattaaacgaggaaaaagaatggtctgtagtttttatatttgttatgcaacattacacttgatttgctgctttaaatttagagtacatcccaaatttatccagtcatcagaaaatttaaagtagttcgtatgttaaagcaaagtatatatttgacttatttgtaatataataaaggatgctgatgttactgaaa

SEQ ID NO: 22076 - DNA, 4489 bp, Homo sapiens
cggcgcgctcgggacgtatcaacgctctgtgggtcgtgtgcgtgcgaggggggcgacgtaagggcgctccgcgagcccgtctctcctcgaatgaaaggaaacaacctccggcgacagagccccgctctcaggcactgctggagaaccgagaccgacttctttctctttaccctcattggcgcttctctcctgcagtccgcctctgggccctgccgcatttcttgagacttaaagtggcattctaaaggcaatttaaaaatcatgtcaagctcagttgaacagaaaaaagggcctacaagacagcgcaaatgtggcttttgtaagtcaaatagagacaaggaatgtggacagttactaatatctgaaaaccagaaggtggcagcgcaccataagtgcatgctcttttcatctgctttggtatcatcacactctgataatgaaagtcttggtggattttctattgaagatgtccaaaaggaaattaaaagaggcacgaagctgatgtgttctttgtgccattgtcctggagcaacaattggttgtgatgtgaaaacatgtcacaggacataccactaccactgtgcattgcatgataaagctcaaatacgagagaaaccttcacaaggaatttacatggtctattgccgaaaacacaagaaaactgcacataactccgaagctgatttagaagaaagttttaatgaacatgaactggagccctcatcacctaaaagtaaaaagaaaagtcgcaaaggaaggccaagaaaaactaattttaaagggctgtcagaagataccaggtccacatcctcccatggaacagatgaaatggaaagtagttcctatagagataggtctccacacagaagcagccctagtgacaccaggcctaaatgtggattttgccatgtaggggaggaagaaaatgaagcacgaggaaaactgcatatatttaatgccaagaaggcagctgcccattataagtgcatgttgttttcttctggcacagtccagctcacaacaacatcaagagcagaatttggagactttgatattaaaactgtacttcaggagattaaacgaggaaaaagaatgaaatgtacactttgcagtcagcctggtgctactattggatgtgaaataaaagcctgtgttaagacttaccattaccactgtggagtacaagacaaagctaaatacattgaaaatatgtcacgaggaatttacaaactatactgtaaaaatcatagtggaaatgatgagagagatgaagaagatgaggaacgagagagtaaaagccgaggaaaagtagaaattgatcagcaacaactaactcagcagcaacttaatggaaactaggttcatgggacagagttagaaaactgggaatgaataagacatccataactactattcttttttcactgttttctaaaatcaaaaagggtttgtaactttttactgcccaactcttagatccttcattgaactgcctaaaaatgtcttgtttgttttatgagccctcactagaaggctgagtttgacatgttgatattacgtagctatagtttgcagtttctgggaagcaattgaaacactattaaccctgtgtatagtgtcaacagttaaagcagacgaaacgaagtaagctatatttctggactgaacaaagctctgctgtttagagcatttaagtttgtttagtggatccatactcaaaggaaagcataagcaaattttcctttacaatgcaaacatgccactggtggcagcacatggtaatttgtggatttttttttcatactcaagtaatggaggctagaaatgaagagaaccttctttttctcttgactttgacagcacatgctaaaaatctcttccaagaagtatgctaaagcttttcatttggttcctgttaaagttgttctcactgaccagcatggactcaggcaactggtaatgataagctatgagctccagtgcttttgccaaaattctcttgacagcacacctcctctctttccatgttatacaaaggacttctggcaaaatgattgagtccttcaagtttaaactaacatttggcaacagcaaattaaacgtttttaagatgtaaagaaagggttaccgcttgctaaggacttcagacaccatgtccgaaacctgttcctctcaagtgccctgttgtgtggaacacttcacatattggcgcacagtacgtaaggaggtctcatgtgctgtaggagtaaaaaagtctttgcataaaacagtatttatttttacttttgtgaccactattttagaaactttatttaatattttaatgttttcagtcattgctttggttatctataaaataggcttttgtgccctacttttcttcttgtagggcttggtggtgttttatcgattgtcagaattgtttttgaaagcctaagaacccagctttttagaaaggattttcacactggcatttctaggtagtgatattttcttccacttacctgctgaagcacatttatgcatttctttatggcaaaaccaaataactttagttgtggtctgcctgatactaccatagcacctcagtaccaaggggagggattttgactagttgaattattaagccaccacaataaagcagatttttaaataagaaataataatgttaacttgactgtacattgagatattctgcagctgatagagcagcattttaaaaatgtaacaggtggaaaattacactgtgcttaatgactgatttttttttaaactgcgagtcccttaagatcacgtttgtcaagtgtgtattcacacatttacttaaatcaagggactcaatgcttgcttttattttaaccatcttttactatttttagaaggaaactagctttagtagtgggttgccctgtatgttttctctttttgctcttaatatgccattgggtttttgtgtgtatgtgattttcaaaattcatgacttgaagtgcaaggacagatctagatgtttgtttaccaagctatgtgacttctcccaaaggatctgtactttctttccttacaacagcttgaaaatcattattttaaaatccttaaatcactgtgtctagatcattttttacattgtgtgccatagacttacccatgggacaacagagctccttcatttttggacaactactgtaatcattttttttttaggaaaaatggaaggtgccgggggtaatcatggccagtcaataattatataaaggagttcaaatactatagctgtcagttgatgaatttgttatgtagtaaaatgtatgactttgtatgggtttcttcagccctttttctgccactagcaaccagaatagcactttaccttttggttggctagataagtggctgactacctgtttttctcactgtggtgtgattggctaaacaatctcgcattaaaaattcaaatgtaaattgaattcacatgaaaaatcatgtttggttgtaaacctccaatgttttgattctctaatcatgttttcgtcacatgctgagtaaaagtgccttacaatgtaaaaattgtacagtacttatgttcccaagtagcatcatcatcttctgggtagtaattacattgtggtattaatatttagaaaaatggacctcagcagtgtatttactgtacatctcttaagtccttaactgtagttttaataagcatgacattatttgataagtatataacatttacatcatttcaaaaaatactgccgttactgtcttttatgcatattttagcctgaaattttgaagcgtcttttttctttcttttttctttttttgttttgttttttgttattgatattaaacagtgtaatctttgcaagcgtatattgaagattattctggagcatttattgccttaccagaaatgttagtaggaaatgttctttagagtagaaagatagacttgagtttctatacttttaagaagagctctttgttcctgggggaggggggcagggggtgaattttactttcatctcaagttattaaaaacccacaactgaagtaaattttatttcaagaatcagcagttttagaatttcagatagtacttgctcagaagtacatgctactcaagatattaagagataacaagatctgtagatctgctattgaatcagaatctgtgtacttgaacaaatgtgtgaatctcaaatatctcaaagcaaaagaaaaagtgttctagagtgttgttgcttttttaaaaaaagcgctgaagttagaccaaggtatacagttttgttctaacagacatttaggttaattgtaaagataaggaatgcattatgggtcaaaaatcaaacattcctctcatgttatgtatattttgttcctgttatattggctttattttcaaaattgtagtttgtagtattagtttccttttattggtattcttgcatatactattcattcaataaatgacttatgactttca

SEQ ID NO: 22077 - DNA, 4432 bp, Homo sapiens
aagggcgctccgcgagcccgtctctcctcgaatgaaaggaaacaacctccggcgacagagccccgctctcaggcactgctggagaaccgagaccgacttctttctctttaccctcattggcgcttctctcctgcagtccgcctctgggccctgccgcatttcttgagacttaaagtggcattctaaaggcaatttaaaaatcatgtcaagctcagttgaacagaaaaaagggcctacaagacagcgcaaatgtggcttttgtaagtcaaatagagacaaggaatgtggacagttactaatatctgaaaaccagaaggtggcagcgcaccataagtgcatgctcttttcatctgctttggtatcatcacactctgataatgaaagtcttggtggattttctattgaagatgtccaaaaggaaattaaaagaggcacgaagctgatgtgttctttgtgccattgtcctggagcaacaattggttgtgatgtgaaaacatgtcacaggacataccactaccactgtgcattgcatgataaagctcaaatacgagagaaaccttcacaaggaatttacatggtctattgccgaaaacacaagaaaactgcacataactccgaagcagctgatttagaagaaagttttaatgaacatgaactggagccctcatcacctaaaagtaaaaagaaaagtcgcaaaggaaggccaagaaaaactaattttaaagggctgtcagaagataccaggtccacatcctcccatggaacagatgaaatggaaagtagttcctatagagataggtctccacacagaagcagccctagtgacaccaggcctaaatgtggattttgccatgtaggggaggaagaaaatgaagcacgaggaaaactgcatatatttaatgccaagaaggcagctgcccattataagtgcatgttgttttcttctggcacagtccagctcacaacaacatcaagagcagaatttggagactttgatattaaaactgtacttcaggagattaaacgaggaaaaagaatgaaatgtacactttgcagtcagcctggtgctactattggatgtgaaataaaagcctgtgttaagacttaccattaccactgtggagtacaagacaaagctaaatacattgaaaatatgtcacgaggaatttacaaactatactgtaaaaatcatagtggaaatgatgagagagatgaagaagatgaggaacgagagagtaaaagccgaggaaaagtagaaattgatcagcaacaactaactcagcagcaacttaatggaaactaggttcatgggacagagttagaaaactgggaatgaataagacatccataactactattcttttttcactgttttctaaaatcaaaaagggtttgtaactttttactgcccaactcttagatccttcattgaactgcctaaaaatgtcttgtttgttttatgagccctcactagaaggctgagtttgacatgttgatattacgtagctatagtttgcagtttctgggaagcaattgaaacactattaaccctgtgtatagtgtcaacagttaaagcagacgaaacgaagtaagctatatttctggactgaacaaagctctgctgtttagagcatttaagtttgtttagtggatccatactcaaaggaaagcataagcaaattttcctttacaatgcaaacatgccactggtggcagcacatggtaatttgtggatttttttttcatactcaagtaatggaggctagaaatgaagagaaccttctttttctcttgactttgacagcacatgctaaaaatctcttccaagaagtatgctaaagcttttcatttggttcctgttaaagttgttctcactgaccagcatggactcaggcaactggtaatgataagctatgagctccagtgcttttgccaaaattctcttgacagcacacctcctctctttccatgttatacaaaggacttctggcaaaatgattgagtccttcaagtttaaactaacatttggcaacagcaaattaaacgtttttaagatgtaaagaaagggttaccgcttgctaaggacttcagacaccatgtccgaaacctgttcctctcaagtgccctgttgtgtggaacacttcacatattggcgcacagtacgtaaggaggtctcatgtgctgtaggagtaaaaaagtctttgcataaaacagtatttatttttacttttgtgaccactattttagaaactttatttaatattttaatgttttcagtcattgctttggttatctataaaataggcttttgtgccctacttttcttcttgtagggcttggtggtgttttatcgattgtcagaattgtttttgaaagcctaagaacccagctttttagaaaggattttcacactggcatttctaggtagtgatattttcttccacttacctgctgaagcacatttatgcatttctttatggcaaaaccaaataactttagttgtggtctgcctgatactaccatagcacctcagtaccaaggggagggattttgactagttgaattattaagccaccacaataaagcagatttttaaataagaaataataatgttaacttgactgtacattgagatattctgcagctgatagagcagcattttaaaaatgtaacaggtggaaaattacactgtgcttaatgactgatttttttttaaactgcgagtcccttaagatcacgtttgtcaagtgtgtattcacacatttacttaaatcaagggactcaatgcttgcttttattttaaccatcttttactatttttagaaggaaactagctttagtagtgggttgccctgtatgttttctctttttgctcttaatatgccattgggtttttgtgtgtatgtgattttcaaaattcatgacttgaagtgcaaggacagatctagatgtttgtttaccaagctatgtgacttctcccaaaggatctgtactttctttccttacaacagcttgaaaatcattattttaaaatccttaaatcactgtgtctagatcattttttacattgtgtgccatagacttacccatgggacaacagagctccttcatttttggacaactactgtaatcattttttttttaggaaaaatggaaggtgccgggggtaatcatggccagtcaataattatataaaggagttcaaatactatagctgtcagttgatgaatttgttatgtagtaaaatgtatgactttgtatgggtttcttcagccctttttctgccactagcaaccagaatagcactttaccttttggttggctagataagtggctgactacctgtttttctcactgtggtgtgattggctaaacaatctcgcattaaaaattcaaatgtaaattgaattcacatgaaaaatcatgtttggttgtaaacctccaatgttttgattctctaatcatgttttcgtcacatgctgagtaaaagtgccttacaatgtaaaaattgtacagtacttatgttcccaagtagcatcatcatcttctgggtagtaattacattgtggtattaatatttagaaaaatggacctcagcagtgtatttactgtacatctcttaagtccttaactgtagttttaataagcatgacattatttgataagtatataacatttacatcatttcaaaaaatactgccgttactgtcttttatgcatattttagcctgaaattttgaagcgtcttttttctttcttttttctttttttgttttgttttttgttattgatattaaacagtgtaatctttgcaagcgtatattgaagattattctggagcatttattgccttaccagaaatgttagtaggaaatgttctttagagtagaaagatagacttgagtttctatacttttaagaagagctctttgttcctgggggaggggggcagggggtgaattttactttcatctcaagttattaaaaacccacaactgaagtaaattttatttcaagaatcagcagttttagaatttcagatagtacttgctcagaagtacatgctactcaagatattaagagataacaagatctgtagatctgctattgaatcagaatctgtgtacttgaacaaatgtgtgaatctcaaatatctcaaagcaaaagaaaaagtgttctagagtgttgttgcttttttaaaaaaagcgctgaagttagaccaaggtatacagttttgttctaacagacatttaggttaattgtaaagataaggaatgcattatgggtcaaaaatcaaacattcctctcatgttatgtatattttgttcctgttatattggctttattttcaaaattgtagtttgtagtattagtttccttttattggtattcttgcatatactattcattcaataaatgacttatgactttc

SEQ ID NO: 22078 - DNA, 1626 bp, Homo sapiens
aaggaaacaacctccggcgacagagccccgctctcaggcactgctggagaaccgagaccgacttctttctctttaccctcattggcgcttctctcctgcagtccgcctctgggccctgccgcatttcttgagacttaaagtggcattctaaaggcaatttaaaaatcatgtcaagctcagttgaacagaaaaaagggcctacaagacagcgcaaatgtggcttttgtaagtcaaatagagacaaggaatgtggacagttactaatatctgaaaaccagaaggtggcagcgcaccataagtgcatgatgtgttctttgtgccattgtcctggagcaacaattggttgtgatgtgaaaacatgtcacaggacataccactaccactgtgcattgcatgataaagctcaaatacgagagaaaccttcacaaggaatttacatggtctattgccgaaaacacaagaaaactgcacataactccgaagctgatttagaagaaagttttaatgaacatgaactggagccctcatcacctaaaagtaaaaagaaaagtcgcaaaggaaggccaagaaaaactaattttaaagggctgtcagaagataccaggtccacatcctcccatggaacagatgaaatggaaagtagttcctatagagataggtctccacacagaagcagccctagtgacaccaggcctaaatgtggattttgccatgtaggggaggaagaaaatgaagcacgaggaaaactgcatatatttaatgccaagaaggcagctgcccattataagtgcatgttgttttcttctggcacagtccagctcacaacaacatcaagagcagaatttggagactttgatattaaaactgtacttcaggagattaaacgaggaaaaagaatgaaatgtacactttgcagtcagcctggtgctactattggatgtgaaataaaagcctgtgttaagacttaccattaccactgtggagtacaagacaaagctaaatacattgaaaatatgtcacgaggaatttacaaactatactgtaaaaatcatagtggaaatgatgagagagatgaagaagatgaggaacgagagagtaaaagccgaggaaaagtagaaattgatcagcaacaactaactcagcagcaacttaatggaaactaggttcatgggacagagttagaaaactgggaatgaataagacatccataactactattcttttttcactgttttctaaaatcaaaaagggtttgtaactttttactgcccaactcttagatccttcattgaactgcctaaaaatgtcttgtttgttttatgagccctcactagaaggctgagtttgacatgttgatattacgtagctatagtttgcagtttctgggaagcaattgaaacactattaaccctgtgtatagtgtcaacagttaaagcagacgaaacgaagtaagctatatttctggactgaacaaagctctgctgtttagagcatttaagtttgtttagtggatccatactcaaaggaaagcataagcaaattttcctttacaatgcaaacatgccactggtggcagcacatggtaatttgtggatttttttttcatactcaagtaatggaggctag

SEQ ID NO: 22079 - DNA, 6062 bp, Homo sapiens
gcggccgccagactaggcccaagccgcggtctccagtaggcccgaacggccgggccgaggggaatgttgtggaggaggctgctctgaagcaccgttgagcggctggcgccgcgcgacccagcggggggctcgaggggaaggcgagcgaggttcccggcggtacggggactatcccagaattcgacgcgcgtcgccgtaggggccggaactaccggacgagcctccgctgaggcgcttcgcagtcccggagctagcccggctgccggcgtgtcgctggggctgagctccgcgggcgtggagtccttgcagcccaaagcatgaggaggtccctgtaggattctggactgaagacgttcttgtcaggtttggggcgtgaggaggttcctgtcagttggggaagcgttaagattcctctatcgtccagagaggacgcgtgctgccgcctcccgcccctcttgacacgacgaacctggccggccgcagaacgctccagggccgagcgaagatggcctcggtgccggtgtattgcctctgccggctgccttacgatgtgacccgcttcatgatcgagtgtgacatgtgccaggactggtttcatggcagttgtgttggtgttgaagaggagaaggctgctgacattgacctctaccactgccccaactgtgaagtcttgcatgggccctccattatgaaaaaacgccgtggatcttcaaaggggcatgatacacacaaggggaaaccagtgaagaccgggagccctacgttcgtcagagagctccggagtaggacttttgacagctcagatgaagtgattctgaagcccactggaaatcaactgaccgtggaattcctggaagaaaatagcttcagtgtgcccatcctggtcctgaagaaggatgggttgggcatgacgctgccctcgccatcattcactgtgagggatgttgaacactatgttggttctgacaaagagattgatgtgattgatgtgacccgccaggctgactgcaagatgaagcttggtgattttgtgaaatactattacagcgggaagagggagaaagtcctcaatgtcattagtttggaattctctgataccagactttctaaccttgtggagacaccgaagattgttcgaaagctgtcatgggtcgaaaacttgtggccagaggaatgtgtctttgagagacccaatgtacagaagtactgcctcatgagtgtgcgagatagctatacagactttcacattgactttggtggcacctctgtctggtaccatgtactcaagggtgaaaagatcttctacctgatccgcccaacaaatgccaatctgactctctttgagtgctggagcagttcctctaatcagaatgagatgttctttggggaccaggtggacaagtgctacaagtgttccgtgaagcaaggacagacacttttcattcccacagggtggatccatgctgtgctgacgcctgtggactgccttgcctttggagggaacttcttacacagccttaacatcgagatgcagctcaaagcctatgagattgagaagcggctgagcacagcagacctcttcagattccccaactttgagaccatctgttggtatgtgggaaagcacatcctggacatctttcgcggtttgcgagagaacaggagacaccctgcctcctacctggtccatggtggcaaagccttgaacttggcctttagagcctggacaaggaaagaagctctgccagaccatgaggatgagatcccggagacagtgcgaaccgtacagctcattaaagatctggccagggagatccgcctggtggaagacatcttccaacagaacgttgggaagacgagcaatatctttgggctgcagaggatcttcccagccggctccattcccctaaccaggccagcccattccacttcagtgtccatgtccaggctgtcactgccctccaaaaatggttcaaagaagaaaggcctgaagcccaaggaactcttcaagaaggcagagcgaaagggcaaggagagttcagccttggggcctgctggccagttgagctataatctcatggacacatacagtcatcaggcactgaagacaggctctttccagaaagcaaagttcaacatcactggtgcctgcttgaatgactcagatgacgactcaccagacttggaccttgatggaaatgagagcccattggccctattgatgtctaacggcagtacgaaaagggtgaagagtttatccaaatctcggcgaaccaagatagcaaagaaggtagacaaggctaggctgatggcagaacaggtgatggaagacgaatttgacttggattcagatgatgagctgcagattgacgagagattgggaaaggagaaggcgaccctgataataagaccaaaatttccccggaaattgccccgtgcgaagccttgctctgaccccaaccgagttcgtgaaccaggagaagttgagtttgacattgaggaggactatacaacagatgaggacatggtggaaggggttgaaggcaagcttgggaatggtagtggcgctggtggcattcttgatctgctcaaggccagcaggcaggtggggggacctgactatgctgccctcaccgaggccccagcttctcccagcactcaggaggccatccagggcatgctgtgcatggccaacctgcagtcctcatcgtcctcaccggctacctctagcctgcaggcctggtggactgggggacaggatcgaagcagtgggagctccagcagtgggctgggcacagtgtctaacagtcctgcttcccagcgcaccccagggaagcggcccatcaagcggccagcatactggagaaccgagagcgaggaggaggaggagaacgccagtctggatgaacaggacagcttgggagcgtgcttcaaggatgcagagtatatctatccttcactggagtctgatgatgatgaccctgctttgaaatctcgacccaagaaaaagaagaattcagatgatgctccatggagtcctaaagcccgcgtgaccccaactctgccgaagcaggaccgtcctgtgcgtgaggggacccgggtagcctctattgagacaggtttggctgcagcagctgcaaagctggcccagcaggagctacagaaggcccaaaagaagaaatatatcaagaagaagcctttgctgaaggaggtagaacagcctcgccctcaagactccaatctcagtctgacagtaccagcccccactgtggctgccacaccacaacttgtcacctcctcctcacccctgcctcctcctgagcctaaacaagaggccctgtcaggaagtctcgctgaccatgagtacaccgctcgtcccaatgcctttggcatggcccaggcaaaccgcagcaccacacctatggcccccggtgtcttcttgacccagcggcgcccttcagttggctcccagagcaatcaggcaggacaaggaaagcgtcccaaaaagggcctggccacagcaaagcagagactcggccgtatcctgaaaatccacagaaatggcaaactacttctgtgagccctcctgtgtcccacccctcacccctttacccccattgccttctccattgtcaactcttggggcactcctggatcctatctgccctggacaaggtgctgaggtgcattgtcctgctttcttgggacttaccaaaggcacggacccctccaccgactccttctagttcccttccccactttcactagagcatcctgcctgccttctccactgaggagcaggtaaatgggagaggtttccagctgactagaaccctcttttctactcgtccaaaccactcccgtcacctgccttgtctgttctttattcttcatcccccgctagagctggaaggcaggatgaggagaggtatgaaggagcctgagccatgaagtgggaagcccagtgcttgacactttctgcaactctagccctatatccagaagcctgcccacctccacccattctgtttgccccatttccccagtccagtggacatgccccacctccagacttgctcatgggagaaggctgtggtctctgccccctcttgccaaatgcttcatggaaatgaagaggaaggcctagagcctccttcctgccccactgtgggccatttccagaagtggcctagaaatgccaacttcacttacctttcaaaagaaaggtgattcctatcacttgtcaaggtagggagaggtcagatgcccaagcctttgaccacggttttgtagcctgttggaggaagctacttttagctggctacacatgaggccacttgttttagggtgagctccagggatttgcctggattttgaaatcatgtagaacattatccacgtggctgtggctgtggctgtggctgggccctggcaggtggaaaaccatctcccagaaacctgaaagcacctgccaatgacgcagataaccctggccctacagcctgcttgctccgcctataccacagagcacagcctggacattatggagggtgtggcgggacggcccacacctgggtcctccatcgggaacttttcatgcttctttctccacctgaggtcttggtctgaagaagacctcaggactcacatcttcactcctgggcctttgcacttccagacgacaggtcatcgttcaagcagaatgcagacaggccattcacgagcccaagttgaagagaagagacgcccatccgtgaaggagcagaccatccatccgatcctccccttcccctgtccttccttcgtggattgtctccattgtccagacagtgcccccacctcccaccgccttgcctcactggcaatctggactcgatggagaacatccccccacctccatttggcactacccaagtggagtgtacccttgccctttccacctgtaccacccactccaacctcaccccagcttgcccaatgcttctggggaatttaatagctaccatgcaggccacagggaatttgtgaggcttcttttgtcatctttgtatctccagtttgtctttcttttctccatagccctgcctctactttccttccttggaatcaggggttcctttagcccatttgctttctctaccttggggaccccaggggccaagcagttctccatctagtcacaccaaaggcaaaaagcctggctacctcccccctagcacgtgagtccctactcccctcccctctgtttctgcccagctttgcttattttggggatttcaaggcagcagagggtagtgaggggagagcaggagaagcctctgtcctgtataggcaactgcctgactatgcggtgactgctgtaaccaagatcaggtccccagcccttttgtccattaacaccccttcttgatctttcaaaggcagctaattgctagcaaatccccccgattccggccttttccctctatttctttgttagaagttttctgtggagctgaaacccagcctctgtttgactgggtttcatttagcttagttgggttcttagagccccctgtttgttgttttgtgttgtttccaatgaaaagcaagtttaccctcagagttatgcttttccaaagaggctgatgtctttgtttttgttttttttaatgtttcaggttctaagtgaagtgagttggggaggggttgggagtgttagtaatcaaggtttagaacaccatgagatagttacccctgatctccagtccctagctgggggctggacagggggaagggagagaggatttctattcacctttaatatatttttacaaaaaaagcaaacaatttaaaaacaagcccaccgcttctgtacatgtctaaatatatttttagaagtgggtaggattgtgaatttctgatgcagggcctttttataaataggttagggtagcatcattcagacttctctgttgtttttgtccctgtctttttcttatgttgtgttactaatgtaatttatattttttttagatcctccctttcctatagagataaaagtgatttatcttggcaattgc

SEQ ID NO: 22080 - DNA, 4651 bp, Homo sapiens
gcggccgccagactaggcccaagccgcggtctccagtaggcccgaacggccgggccgaggggaatgttgtggaggaggctgctctgaagcaccgttgagcggctggcgccgcgcgacccagcggggggctcgaggggaaggcgagcgaggttcccggcggtacggggactatcccagaattcgacgcgcgtcgccgtaggggccggaactaccggacgagcctccgctgaggcgcttcgcagtcccggagctagcccggctgccggcgtgtcgctggggctgagctccgcgggcgtggagtccttgcagcccaaagcatgaggaggtccctgtaggattctggactgaagacgttcttgtcaggtttggggcgtgaggaggttcctgtcagttggggaagcgttaagattcctctatcgtccagagaggacgcgtgctgccgcctcccgcccctcttgacacgacgaacctggccggccgcagaacgctccagggccgagcgaagatggcctcggtgccggtgtattgcctctgccggctgccttacgatgtgacccgcttcatgatcgagtgtgacatgtgccaggactggtttcatggcagttgtgttggtgttgaagaggagaaggctgctgacattgacctctaccactgccccaactgtgaagtcttgcatgggccctccattatgaaaaaacgccgtggatcttcaaaggggcatgatacacacaaggggaaaccagtgaagaccgggagccctacgttcgtcagagagctccggagtaggacttttgacagctcagatgaagtgattctgaagcccactggaaatcaactgaccgtggaattcctggaagaaaatagcttcagtgtgcccatcctggtcctgaagaaggatgggttgggcatgacgctgccctcgccatcattcactgtgagggatgttgaacactatgttggttctgacaaagagattgatgtgattgatgtgacccgccaggctgactgcaagatgaagcttggtgattttgtgaaatactattacagcgggaagagggagaaagtcctcaatgtcattagtttggaattctctgataccagactttctaaccttgtggagacaccgaagattgttcgaaagctgtcatgggtcgaaaacttgtggccagaggaatgtgtctttgagagacccaatgtacagaagtactgcctcatgagtgtgcgagatagctatacagactttcacattgactttggtggcacctctgtctggtaccatgtactcaagggtgaaaagatcttctacctgatccgcccaacaaatgccaatctgactctctttgagtgctggagcagttcctctaatcagaatgagatgttctttggggaccaggtggacaagtgctacaagtgttccgtgaagcaaggacagacacttttcattcccacagggtggatccatgctgtgctgacgcctgtggactgccttgcctttggagggaacttcttacacagccttaacatcgagatgcagctcaaagcctatgagattgagaagcggctgagcacagcagacctcttcagattccccaactttgagaccatctgttggtatgtgggaaagcacatcctggacatctttcgcggtttgcgagagaacaggagacaccctgcctcctacctggtccatggtggcaaagccttgaacttggcctttagagcctggacaaggaaagaagctctgccagaccatgaggatgagatcccggagacagtgcgaaccgtacagctcattaaagatctggccagggagatccgcctggtggaattcaacatcactggtgcctgcttgaatgactcagatgacgactcaccagacttggaccttgatggaaatgagagcccattggccctattgatgtctaacggcagtacgaaaagggtgaagagtttatccaaatctcggcgaaccaagatagcaaagaaggtagacaaggctaggctgatggcagaacaggtgatggaagacgaatttgacttggattcagatgatgagctgcagattgacgagagattgggaaaggagaaggcgaccctgataataagaccaaaatttccccggaaattgccccgtgcgaagccttgctctgaccccaaccgagttcgtgaaccaggagaagttgagtttgacattgaggaggactatacaacagatgaggacatggtggaaggggttgaaggcaagcttgggaatggtagtggcgctggtggcattcttgatctgctcaaggccagcaggcaggtggggggacctgactatgctgccctcaccgaggccccagcttctcccagcactcaggaggccatccagggcatgctgtgcatggccaacctgcagtcctcatcgtcctcaccggctacctctagcctgcaggcctggtggactgggggacaggatcgaagcagtgggagctccagcagtgggctgggcacagtgtctaacagtcctgcttcccagcgcaccccagggaagcggcccatcaagcggccagcatactggagaaccgagagcgaggaggaggaggagaacgccagtctggatgaacaggacagcttgggagcgtgcttcaaggatgcagagtatatctatccttcactggagtctgatgatgatgaccctgctttgaaatctcgacccaagaaaaagaagaattcagatgatgctccatggagtcctaaagcccgcgtgaccccaactctgccgaagcaggaccgtcctgtgcgtgaggggacccgggtagcctctattgagacaggtttggctgcagcagctgcaaagctggcccagcaggagctacagaaggcccaaaagaagaaatatatcaagaagaagcctttgctgaaggaggtagaacagcctcgccctcaagactccaatctcagtctgacagtaccagcccccactgtggctgccacaccacaacttgtcacctcctcctcacccctgcctcctcctgagcctaaacaagaggccctgtcaggaagtctcgctgaccatgagtacaccgctcgtcccaatgcctttggcatggcccaggcaaaccgcagcaccacacctatggcccccggtgtcttcttgacccagcggcgcccttcagttggctcccagagcaatcaggcaggacaaggaaagcgtcccaaaaagggcctggccacagcaaagcagagactcggccgtatcctgaaaatccacagaaatggcaaactacttctacgacaggtcatcgttcaagcagaatgcagacaggccattcacgagcccaagttgaagagaagagacgcccatccgtgaaggagcagaccatccatccgatcctccccttcccctgtccttccttcgtggattgtctccattgtccagacagtgcccccacctcccaccgccttgcctcactggcaatctggactcgatggagaacatccccccacctccatttggcactacccaagtggagtgtacccttgccctttccacctgtaccacccactccaacctcaccccagcttgcccaatgcttctggggaatttaatagctaccatgcaggccacagggaatttgtgaggcttcttttgtcatctttgtatctccagtttgtctttcttttctccatagccctgcctctactttccttccttggaatcaggggttcctttagcccatttgctttctctaccttggggaccccaggggccaagcagttctccatctagtcacaccaaaggcaaaaagcctggctacctcccccctagcacgtgagtccctactcccctcccctctgtttctgcccagctttgcttattttggggatttcaaggcagcagagggtagtgaggggagagcaggagaagcctctgtcctgtataggcaactgcctgactatgcggtgactgctgtaaccaagatcaggtccccagcccttttgtccattaacaccccttcttgatctttcaaaggcagctaattgctagcaaatccccccgattccggccttttccctctatttctttgttagaagttttctgtggagctgaaacccagcctctgtttgactgggtttcatttagcttagttgggttcttagagccccctgtttgttgttttgtgttgtttccaatgaaaagcaagtttaccctcagagttatgcttttccaaagaggctgatgtctttgtttttgttttttttaatgtttcaggttctaagtgaagtgagttggggaggggttgggagtgttagtaatcaaggtttagaacaccatgagatagttacccctgatctccagtccctagctgggggctggacagggggaagggagagaggatttctattcacctttaatatatttttacaaaaaaagcaaacaatttaaaaacaagcccaccgcttctgtacatgtctaaatatatttttagaagtgggtaggattgtgaatttctgatgcagggcctttttataaataggttagggtagcatcattcagacttctctgttgtttttgtccctgtctttttcttatgttgtgttactaatgtaatttatattttttttagatcctccctttcctatagagataaaagtgatttatcttggc

SEQ ID NO: 22081 - DNA, 6024 bp, Homo sapiens
tttcctctcatcccccctcctctcccctcccctcaggctatagtcagaaaattgtgggacaggtgcaaacaaatccttgaactgtatttgaactgaagtgaaacagtagggtcaaagaagagttcagagggagttgtggagttggcagcagctttacagaggaactacactgagggcctggggacagaacgcgggtagcacagggcacaaggttcaacgtccctgctccgggactcaagtcacttggcttctcgaagcccctgccttcatttggtgataatcacagagcttccttcacagggggaagaaccaacaacgcagagaccgtgggaaagagcccagcctatcgaaggtgctcaatgaacaggagccgcgctatcgtccagagaggacgcgtgctgccgcctcccgcccctcttgacacgacgaacctggccggccgcagaacgctccagggccgagcgaagatggcctcggtgccggtgtattgcctctgccggctgccttacgatgtgacccgcttcatgatcgagtgtgacatgtgccaggactggtttcatggcagttgtgttggtgttgaagaggagaaggctgctgacattgacctctaccactgccccaactgtgaagtcttgcatgggccctccattatgaaaaaacgccgtggatcttcaaaggggcatgatacacacaaggggaaaccagtgaagaccgggagccctacgttcgtcagagagctccggagtaggacttttgacagctcagatgaagtgattctgaagcccactggaaatcaactgaccgtggaattcctggaagaaaatagcttcagtgtgcccatcctggtcctgaagaaggatgggttgggcatgacgctgccctcgccatcattcactgtgagggatgttgaacactatgttggttctgacaaagagattgatgtgattgatgtgacccgccaggctgactgcaagatgaagcttggtgattttgtgaaatactattacagcgggaagagggagaaagtcctcaatgtcattagtttggaattctctgataccagactttctaaccttgtggagacaccgaagattgttcgaaagctgtcatgggtcgaaaacttgtggccagaggaatgtgtctttgagagacccaatgtacagaagtactgcctcatgagtgtgcgagatagctatacagactttcacattgactttggtggcacctctgtctggtaccatgtactcaagggtgaaaagatcttctacctgatccgcccaacaaatgccaatctgactctctttgagtgctggagcagttcctctaatcagaatgagatgttctttggggaccaggtggacaagtgctacaagtgttccgtgaagcaaggacagacacttttcattcccacagggtggatccatgctgtgctgacgcctgtggactgccttgcctttggagggaacttcttacacagccttaacatcgagatgcagctcaaagcctatgagattgagaagcggctgagcacagcagacctcttcagattccccaactttgagaccatctgttggtatgtgggaaagcacatcctggacatctttcgcggtttgcgagagaacaggagacaccctgcctcctacctggtccatggtggcaaagccttgaacttggcctttagagcctggacaaggaaagaagctctgccagaccatgaggatgagatcccggagacagtgcgaaccgtacagctcattaaagatctggccagggagatccgcctggtggaagacatcttccaacagaacgttgggaagacgagcaatatctttgggctgcagaggatcttcccagccggctccattcccctaaccaggccagcccattccacttcagtgtccatgtccaggctgtcactgccctccaaaaatggttcaaagaagaaaggcctgaagcccaaggaactcttcaagaaggcagagcgaaagggcaaggagagttcagccttggggcctgctggccagttgagctataatctcatggacacatacagtcatcaggcactgaagacaggctctttccagaaagcaaagttcaacatcactggtgcctgcttgaatgactcagatgacgactcaccagacttggaccttgatggaaatgagagcccattggccctattgatgtctaacggcagtacgaaaagggtgaagagtttatccaaatctcggcgaaccaagatagcaaagaaggtagacaaggctaggctgatggcagaacaggtgatggaagacgaatttgacttggattcagatgatgagctgcagattgacgagagattgggaaaggagaaggcgaccctgataataagaccaaaatttccccggaaattgccccgtgcgaagccttgctctgaccccaaccgagttcgtgaaccaggagaagttgagtttgacattgaggaggactatacaacagatgaggacatggtggaaggggttgaaggcaagcttgggaatggtagtggcgctggtggcattcttgatctgctcaaggccagcaggcaggtggggggacctgactatgctgccctcaccgaggccccagcttctcccagcactcaggaggccatccagggcatgctgtgcatggccaacctgcagtcctcatcgtcctcaccggctacctctagcctgcaggcctggtggactgggggacaggatcgaagcagtgggagctccagcagtgggctgggcacagtgtctaacagtcctgcttcccagcgcaccccagggaagcggcccatcaagcggccagcatactggagaaccgagagcgaggaggaggaggagaacgccagtctggatgaacaggacagcttgggagcgtgcttcaaggatgcagagtatatctatccttcactggagtctgatgatgatgaccctgctttgaaatctcgacccaagaaaaagaagaattcagatgatgctccatggagtcctaaagcccgcgtgaccccaactctgccgaagcaggaccgtcctgtgcgtgaggggacccgggtagcctctattgagacaggtttggctgcagcagctgcaaagctggcccagcaggagctacagaaggcccaaaagaagaaatatatcaagaagaagcctttgctgaaggaggtagaacagcctcgccctcaagactccaatctcagtctgacagtaccagcccccactgtggctgccacaccacaacttgtcacctcctcctcacccctgcctcctcctgagcctaaacaagaggccctgtcaggaagtctcgctgaccatgagtacaccgctcgtcccaatgcctttggcatggcccaggcaaaccgcagcaccacacctatggcccccggtgtcttcttgacccagcggcgcccttcagttggctcccagagcaatcaggcaggacaaggaaagcgtcccaaaaagggcctggccacagcaaagcagagactcggccgtatcctgaaaatccacagaaatggcaaactacttctgtgagccctcctgtgtcccacccctcacccctttacccccattgccttctccattgtcaactcttggggcactcctggatcctatctgccctggacaaggtgctgaggtgcattgtcctgctttcttgggacttaccaaaggcacggacccctccaccgactccttctagttcccttccccactttcactagagcatcctgcctgccttctccactgaggagcaggtaaatgggagaggtttccagctgactagaaccctcttttctactcgtccaaaccactcccgtcacctgccttgtctgttctttattcttcatcccccgctagagctggaaggcaggatgaggagaggtatgaaggagcctgagccatgaagtgggaagcccagtgcttgacactttctgcaactctagccctatatccagaagcctgcccacctccacccattctgtttgccccatttccccagtccagtggacatgccccacctccagacttgctcatgggagaaggctgtggtctctgccccctcttgccaaatgcttcatggaaatgaagaggaaggcctagagcctccttcctgccccactgtgggccatttccagaagtggcctagaaatgccaacttcacttacctttcaaaagaaaggtgattcctatcacttgtcaaggtagggagaggtcagatgcccaagcctttgaccacggttttgtagcctgttggaggaagctacttttagctggctacacatgaggccacttgttttagggtgagctccagggatttgcctggattttgaaatcatgtagaacattatccacgtggctgtggctgtggctgtggctgggccctggcaggtggaaaaccatctcccagaaacctgaaagcacctgccaatgacgcagataaccctggccctacagcctgcttgctccgcctataccacagagcacagcctggacattatggagggtgtggcgggacggcccacacctgggtcctccatcgggaacttttcatgcttctttctccacctgaggtcttggtctgaagaagacctcaggactcacatcttcactcctgggcctttgcacttccagacgacaggtcatcgttcaagcagaatgcagacaggccattcacgagcccaagttgaagagaagagacgcccatccgtgaaggagcagaccatccatccgatcctccccttcccctgtccttccttcgtggattgtctccattgtccagacagtgcccccacctcccaccgccttgcctcactggcaatctggactcgatggagaacatccccccacctccatttggcactacccaagtggagtgtacccttgccctttccacctgtaccacccactccaacctcaccccagcttgcccaatgcttctggggaatttaatagctaccatgcaggccacagggaatttgtgaggcttcttttgtcatctttgtatctccagtttgtctttcttttctccatagccctgcctctactttccttccttggaatcaggggttcctttagcccatttgctttctctaccttggggaccccaggggccaagcagttctccatctagtcacaccaaaggcaaaaagcctggctacctcccccctagcacgtgagtccctactcccctcccctctgtttctgcccagctttgcttattttggggatttcaaggcagcagagggtagtgaggggagagcaggagaagcctctgtcctgtataggcaactgcctgactatgcggtgactgctgtaaccaagatcaggtccccagcccttttgtccattaacaccccttcttgatctttcaaaggcagctaattgctagcaaatccccccgattccggccttttccctctatttctttgttagaagttttctgtggagctgaaacccagcctctgtttgactgggtttcatttagcttagttgggttcttagagccccctgtttgttgttttgtgttgtttccaatgaaaagcaagtttaccctcagagttatgcttttccaaagaggctgatgtctttgtttttgttttttttaatgtttcaggttctaagtgaagtgagttggggaggggttgggagtgttagtaatcaaggtttagaacaccatgagatagttacccctgatctccagtccctagctgggggctggacagggggaagggagagaggatttctattcacctttaatatatttttacaaaaaaagcaaacaatttaaaaacaagcccaccgcttctgtacatgtctaaatatatttttagaagtgggtaggattgtgaatttctgatgcagggcctttttataaataggttagggtagcatcattcagacttctctgttgtttttgtccctgtctttttcttatgttgtgttactaatgtaatttatattttttttagatcctccctttcctatagagataaaagtgatttatcttggcaattgc

SEQ ID NO: 22082 - DNA, 2726 bp, Homo sapiens
atgagtgtgcgagatagctatacagactttcacattgactttggtggcacctctgtctggtaccatgtactcaagggtgaaaagatcttctacctgatccgcccaacaaatgccaatctgactctctttgagtgctggagcagttcctctaatcagaatgagatgttctttggggaccaggtggacaagtgctacaagtgttccgtgaagcaaggacagacacttttcattcccacagggtggatccatgctgtgctgacgcctgtggactgccttgcctttggagggaacttcttacacagccttaacatcgagatgcagctcaaagcctatgagattgagaagcggctgagcacagcagacctcttcagattccccaactttgagaccatctgttggtatgtgggaaagcacatcctggacatctttcgcggtttgcgagagaacaggagacaccctgcctcctacctggtccatggtggcaaagccttgaacttggcctttagagcctggacaaggaaagaagctctgccagaccatgaggatgagatcccggagacagtgcgaaccgtacagctcattaaagatctggccagggagatccgcctggtggaagacatcttccaacagaacgttgggaagacgagcaatatctttgggctgcagaggatcttcccagccggctccattcccctaaccaggccagcccattccacttcagtgtccatgtccaggctgtcactgccctccaaaaatggttcaaagaagaaaggcctgaagcccaaggaactcttcaagaaggcagagcgaaagggcaaggagagttcagccttggggcctgctggccagttgagctataatctcatggacacatacagtcatcaggcactgaagacaggctctttccagaaagcaaagttcaacatcactggtgcctgcttgaatgactcagatgacgactcaccagacttggaccttgatggaaatgagagcccattggccctattgatgtctaacggcagtacgaaaagggtgaagagtttatccaaatctcggcgaaccaagatagcaaagaaggtagacaaggctaggctgatggcagaacaggtgatggaagacgaatttgacttggattcagatgatgagctgcagattgacgagagattgggaaaggagaaggcgaccctgataataagaccaaaatttccccggaaattgccccgtgcgagccttgctctgaccccaaccgagttcgtgaaccaggagaagttgagtttgacattgaggaggactatacaacagatgaggacatggtggaaggggttgaaggcaagcttgggaatggtagtggcgctggtggcattcttgatctgctcaaggccagcaggcaggtggggggacctgactatgctgccctcaccgaggccccagcttctcccagcactcaggaggccatccagggcatgctgtgcatggccaacctgcagtcctcatcgtcctcaccggctacctctagcctgcaggcctggtggactgggggacaggatcgaagcagtgggagctccagcagtgggctgggcacagtgtctaacagtcctgcttcccagcgcaccccagggaagcggcccatcaagcggccagcatactggagaaccgagagcgaggaggaggaggagaacgccagtctggatgaacaggacagcttgggagcgtgcttcaaggatgcagagtatatctatccttcactggagtctgatgatgatgaccctgctttgaaatctcgacccaagaaaaagaagaattcagatgatgctccatggagtcctaaagcccgcgtgaccccaactctgccgaagcaggaccgtcctgtgcgtgaggggacccgggtagcctctattgagacaggtttggctgcagcagctgcaaagctggcccagcaggtgaagaaaatgaagctctcattaactgactcaggataatacagccagtaaatggaggagacaactcaaactcatatcctctaacttcaaatttcatattactttctatttaaataaatgcttatgtagttcagtcattacatcctatttaaatagtgtttaaatctttggcaatcttctttgaccagaacttctgtctcttatgtatatcccaatacagtgtaagctgtaatttgaaaaagggggttctactgttttatataaatataaattaagtaaagctgtgaaaattactcttagtgccttttaaggagctaaattctgtttgggatgatcagagataacctcaaagaagaggttttgaaattggggaggggctttgcaagctaagcttctggtaggggccagggaggcattctaaaagaagggacttccttcgtatagcacacaaagccctcttaaagtcctcttgatttggtctctagtcatctccctgacctccttccagcccctcatgcacaccttttatacagccatagtgcactgcaatactcatagtcccctcagtgagtatatcagattgtctcatgcttttgtgcctttacacaagatgttccttttacccattgagaatcataccctatcagatcccttacctaacagcccttcatactacctaccaccactttatttcagaggcctttttctatatgcttctacaacattcgtggtacttacaatcataaatgtatgttttggtgtttcttattaaactatgaatacttc

SEQ ID NO: 22083 - DNA, 5753 bp, Homo sapiens
gcggccgccagactaggcccaagccgcggtctccagtaggcccgaacggccgggccgaggggaatgttgtggaggaggctgctctgaagcaccgttgagcggctggcgccgcgcgacccagcggggggctcgaggggaaggcgagcgaggttcccggcggtacggggactatcccagaattcgacgcgcgtcgccgtaggggccggaactaccggacgagcctccgctgaggcgcttcgcagtcccggagctagcccggctgccggcgtgtcgctggggctgagctccgcgggcgtggagtccttgcagcccaaagcatgaggaggtccctgtaggattctggactgaagacgttcttgtcaggtttggggcgtgaggaggttcctgtcagttggggaagcgttaagattcctctatcgtccagagaggacgcgtgctgccgcctcccgcccctcttgacacgacgaacctggccggccgcagaacgctccagggccgagcgaagatggcctcggtgccggtgtattgcctctgccggctgccttacgatgtgacccgcttcatgatcgagtgtgacatgtgccaggactggtttcatggcagttgtgttggtgttgaagaggagaaggctgctgacattgacctctaccactgccccaactgtgaagtcttgcatgggccctccattatgaaaaaacgccgtggatcttcaaaggggcatgatacacacaaggggaaaccagtgaagaccgggagccctacgttcgtcagagagctccggagtaggacttttgacagctcagatgaagtgattctgaagcccactggaaatcaactgaccgtggaattcctggaagaaaatagcttcagtgtgcccatcctggtcctgaagaaggatgggttgggcatgacgctgccctcgccatcattcactgtgagggatgttgaacactatgttggttctgacaaagagattgatgtgattgatgtgacccgccaggctgactgcaagatgaagcttggtgattttgtgaaatactattacagcgggaagagggagaaagtcctcaatgtcattagtttggaattctctgataccagactttctaaccttgtggagacaccgaagattgttcgaaagctgtcatgggtcgaaaacttgtggccagaggaatgtgtctttgagagacccaatgtacagaagtactgcctcatgagtgtgcgagatagctatacagactttcacattgactttggtggcacctctgtctggtaccatgtactcaagggtgaaaagatcttctacctgatccgcccaacaaatgccaatctgactctctttgagtgctggagcagttcctctaatcagaatgagatgttctttggggaccaggtggacaagtgctacaagtgttccgtgaagcaaggacagacacttttcattcccacagggtggatccatgctgtgctgacgcctgtggactgccttgcctttggagggaacttcttacacagccttaacatcgagatgcagctcaaagcctatgagattgagaagcggctgagcacagcagacctcttcagattccccaactttgagaccatctgttggtatgtgggaaagcacatcctggacatctttcgcggtttgcgagagaacaggagacaccctgcctcctacctggtccatggtggcaaagccttgaacttggcctttagagcctggacaaggaaagaagctctgccagaccatgaggatgagatcccggagacagtgcgaaccgtacagctcattaaagatctggccagggagatccgcctggtggaattcaacatcactggtgcctgcttgaatgactcagatgacgactcaccagacttggaccttgatggaaatgagagcccattggccctattgatgtctaacggcagtacgaaaagggtgaagagtttatccaaatctcggcgaaccaagatagcaaagaaggtagacaaggctaggctgatggcagaacaggtgatggaagacgaatttgacttggattcagatgatgagctgcagattgacgagagattgggaaaggagaaggcgaccctgataataagaccaaaatttccccggaaattgccccgtgcgaagccttgctctgaccccaaccgagttcgtgaaccaggagaagttgagtttgacattgaggaggactatacaacagatgaggacatggtggaaggggttgaaggcaagcttgggaatggtagtggcgctggtggcattcttgatctgctcaaggccagcaggcaggtggggggacctgactatgctgccctcaccgaggccccagcttctcccagcactcaggaggccatccagggcatgctgtgcatggccaacctgcagtcctcatcgtcctcaccggctacctctagcctgcaggcctggtggactgggggacaggatcgaagcagtgggagctccagcagtgggctgggcacagtgtctaacagtcctgcttcccagcgcaccccagggaagcggcccatcaagcggccagcatactggagaaccgagagcgaggaggaggaggagaacgccagtctggatgaacaggacagcttgggagcgtgcttcaaggatgcagagtatatctatccttcactggagtctgatgatgatgaccctgctttgaaatctcgacccaagaaaaagaagaattcagatgatgctccatggagtcctaaagcccgcgtgaccccaactctgccgaagcaggaccgtcctgtgcgtgaggggacccgggtagcctctattgagacaggtttggctgcagcagctgcaaagctggcccagcaggagctacagaaggcccaaaagaagaaatatatcaagaagaagcctttgctgaaggaggtagaacagcctcgccctcaagactccaatctcagtctgacagtaccagcccccactgtggctgccacaccacaacttgtcacctcctcctcacccctgcctcctcctgagcctaaacaagaggccctgtcaggaagtctcgctgaccatgagtacaccgctcgtcccaatgcctttggcatggcccaggcaaaccgcagcaccacacctatggcccccggtgtcttcttgacccagcggcgcccttcagttggctcccagagcaatcaggcaggacaaggaaagcgtcccaaaaagggcctggccacagcaaagcagagactcggccgtatcctgaaaatccacagaaatggcaaactacttctgtgagccctcctgtgtcccacccctcacccctttacccccattgccttctccattgtcaactcttggggcactcctggatcctatctgccctggacaaggtgctgaggtgcattgtcctgctttcttgggacttaccaaaggcacggacccctccaccgactccttctagttcccttccccactttcactagagcatcctgcctgccttctccactgaggagcaggtaaatgggagaggtttccagctgactagaaccctcttttctactcgtccaaaccactcccgtcacctgccttgtctgttctttattcttcatcccccgctagagctggaaggcaggatgaggagaggtatgaaggagcctgagccatgaagtgggaagcccagtgcttgacactttctgcaactctagccctatatccagaagcctgcccacctccacccattctgtttgccccatttccccagtccagtggacatgccccacctccagacttgctcatgggagaaggctgtggtctctgccccctcttgccaaatgcttcatggaaatgaagaggaaggcctagagcctccttcctgccccactgtgggccatttccagaagtggcctagaaatgccaacttcacttacctttcaaaagaaaggtgattcctatcacttgtcaaggtagggagaggtcagatgcccaagcctttgaccacggttttgtagcctgttggaggaagctacttttagctggctacacatgaggccacttgttttagggtgagctccagggatttgcctggattttgaaatcatgtagaacattatccacgtggctgtggctgtggctgtggctgggccctggcaggtggaaaaccatctcccagaaacctgaaagcacctgccaatgacgcagataaccctggccctacagcctgcttgctccgcctataccacagagcacagcctggacattatggagggtgtggcgggacggcccacacctgggtcctccatcgggaacttttcatgcttctttctccacctgaggtcttggtctgaagaagacctcaggactcacatcttcactcctgggcctttgcacttccagacgacaggtcatcgttcaagcagaatgcagacaggccattcacgagcccaagttgaagagaagagacgcccatccgtgaaggagcagaccatccatccgatcctccccttcccctgtccttccttcgtggattgtctccattgtccagacagtgcccccacctcccaccgccttgcctcactggcaatctggactcgatggagaacatccccccacctccatttggcactacccaagtggagtgtacccttgccctttccacctgtaccacccactccaacctcaccccagcttgcccaatgcttctggggaatttaatagctaccatgcaggccacagggaatttgtgaggcttcttttgtcatctttgtatctccagtttgtctttcttttctccatagccctgcctctactttccttccttggaatcaggggttcctttagcccatttgctttctctaccttggggaccccaggggccaagcagttctccatctagtcacaccaaaggcaaaaagcctggctacctcccccctagcacgtgagtccctactcccctcccctctgtttctgcccagctttgcttattttggggatttcaaggcagcagagggtagtgaggggagagcaggagaagcctctgtcctgtataggcaactgcctgactatgcggtgactgctgtaaccaagatcaggtccccagcccttttgtccattaacaccccttcttgatctttcaaaggcagctaattgctagcaaatccccccgattccggccttttccctctatttctttgttagaagttttctgtggagctgaaacccagcctctgtttgactgggtttcatttagcttagttgggttcttagagccccctgtttgttgttttgtgttgtttccaatgaaaagcaagtttaccctcagagttatgcttttccaaagaggctgatgtctttgtttttgttttttttaatgtttcaggttctaagtgaagtgagttggggaggggttgggagtgttagtaatcaaggtttagaacaccatgagatagttacccctgatctccagtccctagctgggggctggacagggggaagggagagaggatttctattcacctttaatatatttttacaaaaaaagcaaacaatttaaaaacaagcccaccgcttctgtacatgtctaaatatatttttagaagtgggtaggattgtgaatttctgatgcagggcctttttataaataggttagggtagcatcattcagacttctctgttgtttttgtccctgtctttttcttatgttgtgttactaatgtaatttatattttttttagatcctccctttcctatagagataaaagtgatttatcttggc

SEQ ID NO: 22084 - DNA, 687 bp, Homo sapiens
gcgacccagcggggggctcgaggggaaggcgagcgaggttcccggcggtacggggactatcccagaattcgacgcgcgtcgccgtaggggccggaactaccggacgagcctccgctgaggcgcttcgcagtcccggagctagcccggctgccggcgtgtcgctggggctgagctccgcgggcgtggagtccttgcagcccaaagcatgaggaggtccctgtaggattctggactgaagacgttcttgtcagctatcgtccagagaggacgcgtgctgccgcctcccgcccctcttgacacgacgaacctggccggccgcagaacgctccagggccgagcgaagatggcctcggtgccggtgtattgcctctgccggctgccttacgatgtgacccgcttcatgatcgagtgtgacatgtgccaggactggtttcatggcagttgtgttggtgttgaagaggagaaggctgctgacattgacctctaccactgccccaactgtgaagtcttgcatgggccctccattatgaaaaaacgccgtggatcttcaaaggggcatgatacacacaaggggaaaccagtgaagaccgggagccctacgttcgtcagagagctccggagtaggacttttgacagctcagatgaagtgattctgaagcccactggaaatcaactgaccgtggaatt

SEQ ID NO: 22085 - DNA, 565 bp, Homo sapiens
gaaagaaattctaagggccgggtggactttctctggttgccccctacagccgcaccagctgtgttgcatcccggcggcgtgttatttgtgcctagctatcgtccagagaggacgcgtgctgccgcctcccgcccctcttgacacgacgaacctggccggccgcagaacgctccagggccgagcgaagatggcctcggtgccggtgtattgcctctgccggctgccttacgatgtgacccgcttcatgatcgagtgtgacatgtgccaggactggtttcatggcagttgtgttggtgttgaagaggagaaggctgctgacattgacctctaccactgccccaactgtgaagtcttgcatgggccctccattatgaaaaaacgccgtggatcttcaaaggggcatgatacacacaaggggaaaccagtgaagaccgggagccctacgttcgtcagagagctccggagtaggacttttgacagctcagatgaagtgattctgaagcccactggaaatcaactgaccgtggaattcctggaagaaaatagcttcagtgtgcccatcctg

SEQ ID NO: 22086 - DNA, 555 bp, Homo sapiens
gtgtgaaagaaattctaagggccgggtggactttctctggttgccccctacagccgcaccagctgtgttgcatcccggcggcggtaactctattggagaactgagggttggtgcaagggggtggggggcgggggctgattcactctgtaaaaagtgttatttgtgcctagctatcgtccagagaggacgcgtgctgccgcctcccgcccctcttgacacgacgaacctggccggccgcagaacgctccagggccgagcgaagatggcctcggtgccggtgtattgcctctgccggctgccttacgatgtgacccgcttcatgatcgagtgtgacatgtgccaggactggtttcatggcagttgtgttggtgttgaagaggagaaggctgctgacattgacctctaccactgccccaactgtgaagtcttgcatgggccctccattatgaaaaaacgccgtggatcttcaaaggggcatgatacacacaaggggaaaccagtgaagaccgggagccctacgttcgtcagagagctccggagtaggacttttgacag

SEQ ID NO: 22087 - DNA, 555 bp, Homo sapiens
atatatgtagagaaatgaattggaaaagatcctgctgaggttccctctagagagggggaagaaccaacaacgcagagaccgtgggaaagagcccagcctatcgaaggtgctcaatgaacaggagccgcgagaggacgcgtgctgccgcctcccgcccctcttgacacgacgaacctggccggccgcagaacgctccagggccgagcgaagatggcctcggtgccggtgtattgcctctgccggctgccttacgatgtgacccgcttcatgatcgagtgtgacatgtgccaggactggtttcatggcagttgtgttggtgttgaagaggagaaggctgctgacattgacctctaccactgccccaactgtgaagtcttgcatgggccctccattatgaaaaaacgccgtggatcttcaaaggggcatgatacacacaaggggaaaccagtgaagaccgggagccctacgttcgtcagagagctccggagtaggacttttgacagctcagatgaagtgattctgaagcccactggaaatcaactgaccgtggaattc

SEQ ID NO: 22088 - DNA, 475 bp, Homo sapiens
agtgagagatgaaagaagcttcccgaaaaggcttcaggtattttcttgaaacccggaaagaagttatcactgacaacggggccgaagaagctatcgtccagagaggacgcgtgctgccgcctcccgcccctcttgacacgacgaacctggccggccgcagaacgctccagggccgagcgaagatggcctcggtgccggtgtattgcctctgccggctgccttacgatgtgacccgcttcatgatcgagtgtgacatgtgccaggactggtttcatggcagttgtgttggtgttgaagaggagaaggctgctgacattgacctctaccactgccccaactgtgaagtcttgcatgggccctccattatgaaaaaacgccgtggatcttcaaaggggcatgatacacacaaggggaaaccagtgaagaccgggagccctacgttcgtcagagagctccggagtaggacttttgacag

SEQ ID NO: 22089 - DNA, 534 bp, Homo sapiens
aaaagatcctgctgaggttccctctagagagggggaagaaccaacaacgcagagaccgtgggaaagagcccagcctatcgaaggtgctcaatgaacaggagccgcgctatcgtccagagaggacgcgtgctgccgcctcccgcccctcttgacacgacgaacctggccggccgcagaacgctccagggccgagcgaagatggcctcggtgccggtgtattgcctctgccggctgccttacgatgtgacccgcttcatgatcgagtgtgacatgtgccaggactggtttcatggcagttgtgttggtgttgaagaggagaaggctgctgacattgacctctaccactgccccaactgtgaagtcttgcatgggccctccattatgaaaaaacgccgtggatcttcaaaggggcatgatacacacaaggggaaaccagtgaagaccgggagccctacgttcgtcagagagctccggagtaggacttttgacagctcagatgaagtgattctgaagcccactggaaatcaactgacc

SEQ ID NO: 22090 - DNA, 2921 bp, Homo sapiens
ataatagagggagccctgtgaaacaggggtcagctaggggagggttcagtgagagatgaaagaagcttcccgaaaaggcttcagctatcgtccagagaggacgcgtgctgccgcctcccgcccctcttgacacgacgaacctggccggccgcagaacgctccagggccgagcgaagatggcctcggtgccggtgtattgcctctgccggctgccttacgatgtgacccgcttcatgatcgagtgtgacatgtgccaggactggtttcatggcagttgtgttggtgttgaagaggagaaggctgctgacattgacctctaccactgccccaactgtgaagtcttgcatgggccctccattatgaaaaaacgccgtggatcttcaaaggggcatgatacacacaaggggaaaccagtgaagaccgggagccctacgttcgtcagagagctccggagtaggacttttgacagctcagatgaagtgattctgaagcccactggaaatcaactgaccgtggaattcctggaagaaaatagcttcagtgtgcccatcctggtcctgaagaaggatgggttgggcatgacgctgccctcgccatcattcactgtgagggatgttgaacactatgttggttctgacaaagagattgatgtgattgatgtgacccgccaggctgactgcaagatgaagcttggtgattttgtgaaatactattacagcgggaagagggagaaagtcctcaatgtcattagtttggaattctctgataccagactttctaaccttgtggagacaccgaagattgttcgaaagctgtcatgggtcgaaaacttgtggccagaggaatgtgtctttgagagacccaatgtacagaagtactgcctcatgagtgtgcgagatagctatacagactttcacattgactttggtggcacctctgtctggtaccatgtactcaagggtgaaaagatcttctacctgatccgcccaacaaatgccaatctgactctctttgagtgctggagcagttcctctaatcagaatgagatgttctttggggaccaggtggacaagtgctacaagtgttccgtgaagcaaggacagacacttttcattcccacagggtggatccatgctgtgctgacgcctgtggactgccttgcctttggagggaacttcttacacagccttaacatcgagatgcagctcaaagcctatgagattgagaagcggctgagcacagcagacctcttcagattccccaactttgagaccatctgttggtatgtgggaaagcacatcctggacatctttcgcggtttgcgagagaacaggagacaccctgcctcctacctggtccatggtggcaaagccttgaacttggcctttagagcctggacaaggaaagaagctctgccagaccatgaggatgagatcccggagacagtgcgaaccgtacagctcattaaagatctggccagggagatccgcctggtggaagacatcttccaacagaacgttgggaagacgagcaatatctttgggctgcagaggatcttcccagccggctccattcccctaaccaggccagcccattccacttcagtgtccatgtccaggctgtcactgccctccaaaaatggttcaaagaagaaaggcctgaagcccaaggaactcttcaagaaggcagagcgaaagggcaaggagagttcagccttggggcctgctggccagttgagctataatctcatggacacatacagtcatcaggcactgaagacaggctctttccagaaagcaaagttcaacatcactggtgcctgcttgaatgactcagatgacgactcaccagacttggaccttgatggaaatgagagcccattggccctattgatgtctaacggcagtacgaaaagggtgaagagtttatccaaatctcggcgaaccaagatagcaaagaaggtagacaaggctaggctgatggcagaacaggtgatggaagacgaatttgacttggattcagatgatgagctgcagattgacgagagattgggaaaggagaaggcgaccctgataataagaccaaaatttccccggaaattgccccgtgcgaagccttgctctgaccccaaccgagttcgtgaaccaggagaagttgagtttgacattgaggaggactatacaacagatgaggacatggtggaaggggttgaaggctatcagacagcaacccccgctcccgcccaaggtgccagcgaggccccagcttctcccagcactcaggaggccatccagggcatgctgtgcatggccaacctgcagtcctcatcgtcctcaccggctacctctagcctgcaggcctggtggactgggggacaggatcgaagcagtgggagctccagcagtgggctgggcacagtgtctaacagtcctgcttcccagcgcaccccagggaagcggcccatcaagcggccagcatactggagaaccgagagcgaggaggaggaggagaacgccagtctggatgaacaggacagcttgggagcgtgcttcaaggatgcagagtatatctatccttcactggagtctgatgatgatgaccctgctttgaaatctcgacccaagaaaaagaagaattcagatgatgctccatggagtcctaaagcccgcgtgaccccaactctgccgaagcaggaccgtcctgtgcgtgaggggacccgggtagcctctattgagacaggtttggctgcagcagctgcaaagctggcccagcaggtgaagaaaatgaagctctcattaactgactcaggataatacagccagtaaatggaggagacaactcaaactcatatcctctaacttcaaatttcatattactttctatttaaataaatgcttatgtagttcagtcattacatccta

SEQ ID NO: 22091 - DNA, 2352 bp, Homo sapiens
attttgagaacttgcaaaaacagcttgcaaggaaaatgaagcttcctattttcatagcagatgcattcacagcaagagcatttcgtgggaatcctgctgctgtttgcctcctagaaaatgaattggatgaagacatgcatcagaaaattgcaagggagatgaacctctctgaaactgcttttatccgaaaactgcacccgacagacaactttgcacaaaaaaacatgaatagcacgctcacgtttgtcactctgagtggagaactaagggccagacgagcagaggatggcatcgtcctggacttgcctctttatccagcccacccccaggacttccatgaagtagaggacttgataaagactgccataggcaacacactggtccaggacatctgttattctccagatacccaaaagctcctcgtccgcctcagtgacgtttacaacaggtaagatttttggctgcatcagcactttggggagggctgagtacccagatttatagctcttccttagtctggctgtgctgtgtccagtcaaaccatgatttacgcagccagagtgtttctttccctgataggaagacattcccacttgttcttccttcccctcctgttaagctctttgagcaagctgcaccctggcctgcttcacagagtctgtgtggtgagtgggctgtgaaatgggtttgtcctaatccatcttgtttatgaacaaggtcgtttctggagaacctgaaagtgaacacggagaatctgctgcaagttgaaaacacagggaaggtgaaagggcttattcttacccttaaaggagagcctggtgggcagacccaagcatttgacttttactcaagatattttgcaccgtgggttggtgtggctgaagacccagtgacaggtactttttacttgagcccaggggagggttaaacaatggaagaggaggatcacaaatagttatttaagtgcacttcctgtgacctttcaggtggcttgagttttgagctgccttgttcctctatctttccccatccctgccatcccttcactgaagtcttccatgaaaaacataaaatagagcaggtggataacagggttaaacctgagtgtcagacagcctgggtttacattcctagcttcctagcttttgaccttgggcaagtgacttgacttttaaaagtctcagttccctcctctataaattgtatataatacctcatagggctataaaagcacaatgcatgttaagggcttaatacagtgcctggcacctagtaagtgcccaataactactagctattatattgtattattatatctttttgagacatagtctcacttcatcacccaggctagaacggagtggcatgatcccggctcactgcaacctcagcctcccaggttcaagtgattctcctgccttggcctccccagtagctggaactacaggcgtctgccactacacccggctaatttttgtatttttactagagataggatttcatcatgttggccaggatggtcccaaactcctgacctcaaatgatccctcctcggcctcccaaagtgctgggattacaggcatgagccactgcgcctagctaactactagctattttaataataacaacaaaactagctccttgagccaacacttctagattgtccaccacctgggagcagagggatgagtcaaaggtgggcagaaatgtcatgactcctactctccctctctttgggaacagtgggctgcactgcaaaggacgagaatgcttgatgtgggaggatggtgggtgggatggtgaaggggccacaggaggctgggcagacccttcagggctcctgttctggtcagatggcagggcctggatggctcagttactctctgagtaacaaaacacgtgaaattcaaaactcagcaaacaagcacttttaagactcaggaaaatgcccaaccatatccagagtgcagcttccccatggaagaaaagttccaagcagattgcacaagcacagctgcttcacaaagattttaattggcacagagtgcaagtttgtttgtttgtttgtttgtttgtttttccccgtaatgcttttctagagtataaaggcctttggactttgataaccaacatctgagtttgcttgggactgaagggtttctcagggctcagaactttcagtgctaaaaccagaacagtctcaggcaaaccaggcaggatggttggttgccttacttgaacatcccataacacttttttttttttttttttgcccaggctggagtgcaatggcacgttctcagctccctgcaacctctatctcccaagttcaagagattctcctgcctcagc

SEQ ID NO: 22092 - DNA, 2165 bp, Homo sapiens
gcctcctttgtcctggatttgggagttgagcaccttcgtcgccattggctttcctcccccagctccagcctctctcatcttgggaatctgcgtcagaagtcactcgcagtcccgtcagcccagaagaagacgtaaagcaggctaccagcaattttgagaacttgcaaaaacagcttgcaaggaaaatgaagcttcctattttcatagcagatgcattcacagcaagagcatttcgtgggaatcctgctgctgtttgcctcctagaaaatgaattggatgaagacatgcatcagaaaattgcaagggagatgaacctctctgaaactgcttttatccgaaaactgcacccgacagacaactttgcacaaagttcctgctttggactgagatggtttacaccagcgagtgaggtcccactctgtggccatgccaccctggcttctgcagctgtgctgtttcacaaaataaaaaacatgaatagcacgctcacgtttgtcactctgagtggagaactaagggccagacgagcagaggatggcatcgtcctggacttgcctctttatccagcccacccccaggacttccatgaagtagaggacttgataaagactgccataggcaacacactggtccaggacatctgttattctccagatacccaaaagctcctcgtccgcctcagtgacgtttacaacaggtcgtttctggagaacctgaaagtgaacacggagaatctgctgcaagttgaaaacacagggaaggtgaaagggcttattcttacccttaaaggagagcctggtgggcagacccaagcatttgacttttactcaagatattttgcaccgtgggttggtgtggctgaagacccagtgacagggtctgcacacgctgttctcagcagctactggtcccagcatctggggaagaaagaaatgcatgcttttcagtgttcccaccgaggaggagagctgggaatttcccttcgtccagacggaagggttgacattagaggaggtgcagctgttgttttagagggcacactgacagcctagaggtggttatgctgtgacgctgctgtctctaaccaccaagtattttctgcttaaaaagaaatgtaaggggctgcctttagcaaatgtgcgtagtagtctacttaatcctcatgttaaaaatcgaaaaatgggccaggcgcagtggctcatgcctgtaatcgtagcactttgagaggccaaggtgggtggatcacctgaggtcaggggttcgacaccagcctggccaacatggtgaaacctcgtctctactacaaatacaaaaattagctgggtgtggtgccacatgcctgtaattccagctacttgggaggctgaggcatggagaatcgcttgaacccaggaggcagaagttgcagtgagcagagatcacaccactgcactccagcctgggcaacagagtaagactccatccacacacacacacacacacacaaaattgaaaagtgaagacattttaatggagatttaatagtgcttccagactaatgaactaatggagttttggctccactcatgagtgtatttgaaatgtaagtaaccagctacaaagaataatgtcacttcatttgattatgactaccaatcaagagaaggaggaatacatttctgaggagtgatactaaaccatttgagcttaaatgagtacctgattttgcagccattaaaatgagtcaataactatgtggaaatatagaaaaatattttataatataatactaagaaagaggacagtaggccataaagtgttagcagtgttatgctatgtctatataaataagcatgggccattaaaaatagcaaactgaaaacagttcatgtgtggggggcaagtttagaagtaattttaatgtatctaagaagtgatttcctttattgttgtactcaggtacgaagactaaaaatcaggatgaatccagaaaattaacacaaaaaagtatgtattaggctacttcctgtcatagtgaaattaaacactcaaagtaatgtaatctcagctgggcgtggcggctcatgcctgtaatcccagcactttggcaggacaaggcaggaggatcacttgaacctaggagttcgagaccagcctgggcaacacagcgagaacttgtctctatt

SEQ ID NO: 22093 - DNA, 2449 bp, Homo sapiens
aagtgccttgaattccttggtaattatttccttttaagcgtgtaactcttattattgctaaactgctttttaagttaatggtagttgttgtccaaaggaagtctgatctgtgtttttgaaacctcaatgatcgtctgtttctaattaaggaattggatgaagacatgcatcagaaaattgcaagggagatgaacctctctgaaactgcttttatccgaaaactgcacccgacagacaactttgcacaaagttcctgctttggactgagatggtttacaccagcgagtgaggtcccactctgtggccatgccaccctggcttctgcagctgtgctgtttcacaaaataaaaaacatgaatagcacgctcacgtttgtcactctgagtggagaactaagggccagacgagcagaggatggcatcgtcctggacttgcctctttatccagcccacccccaggacttccatgaagtagaggacttgataaagactgccataggcaacacactggtccaggacatctgttattctccagatacccaaaagctcctcgtccgcctcagtgacgtttacaacaggtcgtttctggagaacctgaaagtgaacacggagaatctgctgcaagttgaaaacacagggaaggtgaaagggcttattcttacccttaaaggagagcctggtgggcagacccaagcatttgacttttactcaagatattttgcaccgtgggttggtgtggctgaagacccagtgacagggtctgcacacgctgttctcagcagctactggtcccagcatctggggaagaaagaaatgcatgcttttcagtgttcccaccgaggaggagagctgggaatttcccttcgtccagacggaagggttgacattagaggaggtgcagctgttgttttagagggcacactgacagcctagaggtggttatgctgtgacgctgctgtctctaaccaccaagtattttctgcttaaaaagaaatgtaaggggctgcctttagcaaatgtgcgtagtagtctacttaatcctcatgttaaaaatcgaaaaatgggccaggcgcagtggctcatgcctgtaatcgtagcactttgagaggccaaggtgggtggatcacctgaggtcaggggttcgacaccagcctggccaacatggtgaaacctcgtctctactacaaatacaaaaattagctgggtgtggtgccacatgcctgtaattccagctacttgggaggctgaggcatggagaatcgcttgaacccaggaggcagaagttgcagtgagcagagatcacaccactgcactccagcctgggcaacagagtaagactccatccacacacacacacacacacacaaaattgaaaagtgaagacattttaatggagatttaatagtgcttccagactaatgaactaatggagttttggctccactcatgagtgtatttgaaatgtaagtaaccagctacaaagaataatgtcacttcatttgattatgactaccaatcaagagaaggaggaatacatttctgaggagtgatactaaaccatttgagcttaaatgagtacctgattttgcagccattaaaatgagtcaataactatgtggaaatatagaaaaatattttataatataatactaagaaagaggacagtaggccataaagtgttagcagtgttatgctatgtctatataaataagcatgggccattaaaaatagcaaactgaaaacagttcatgtgtggggggcaagtttagaagtaattttaatgtatctaagaagtgatttcctttattgttgtactcaggtacgaagactaaaaatcaggatgaatccagaaaattaacacaaaaaagtatgtattaggctacttcctgtcatagtgaaattaaacactcaaagtaatgtaatctcagctgggcgtggcggctcatgcctgtaatcccagcactttggcaggacaaggcaggaggatcacttgaacctaggagttcgagaccagcctgggcaacacagcgagaacttgtctctattaaaaaaaaaaaaaggaatgtaatttcaatctttttcttgatatatggcttgagaatgataatgtaaaaggaattcttctcttacttcaataaaatgggttttaacataactttaaattcagttaaatatacaatattgaatacctatagttgactttgggatggggactttttcaagtcattaagagtgtttgtttaaggtgatctcattgatggtagttctcagccgtctcaaaaactgcaagctaatcagtcagacattctttaatgaccccaattttttcactttaattgttaccatgttttctatttttactgatttttgctaaagcatgtaagagtgaatttattatagcagtaatcttgtgtttctcctgatgtgcaataaatcaataattcaccagc

SEQ ID NO: 22094 - DNA, 2587 bp, Homo sapiens
gaattacaaaggaggccgtctgcctcctttgtcctggatttgggagttgagcaccttcgtcgccattggctttcctcccccagctccagcctctctcatcttgggaatctgcgtcagaagtcactcgcagtcccgtcagcccagaagacgtaaagcaggctaccagcaattttgagaacttgcaaaaacagcttgcaaggaaaatgaagcttcctattttcatagcagatgcattcacagcaagagcatttcgtgggaatcctgctgctgtttgcctcctagaaaatgaattggatgaagacatgcatcagaaaattgcaagggagatgaacctctctgaaactgcttttatccgaaaactgcacccgacagacaactttgcacaaagttcctgctttggactgagatggtttacaccagcgagtgaggtcccactctgtggccatgccaccctggcttctgcagctgtgctgtttcacaaaataaaaaacatgaatagcacgctcacgtttgtcactctgagtggagaactaagggccagacgagcagaggatggcatcgtcctggacttgcctctttatccagcccacccccaggacttccatgaagtagaggacttgataaagactgccataggcaacacactggtccaggacatctgttattctccagatacccaaaagctcctcgtccgcctcagtgacgtttacaacaggtcgtttctggagaacctgaaagtgaacacggagaatctgctgcaagttgaaaacacagggaaggtgaaagggcttattcttacccttaaaggagagcctggtgggcagacccaagcatttgacttttactcaagatattttgcaccgtgggttggtgtggctgaagacccagtgacagggtctgcacacgctgttctcagcagctactggtcccagcatctggggaagaaagaaatgcatgcttttcagtgttcccaccgaggaggagagctgggaatttcccttcgtccagacggaagggttgacattagaggaggtgcagctgttgttttagagggcacactgacagcctagaggtggttatgctgtgacgctgctgtctctaaccaccaagtattttctgcttaaaaagaaatgtaaggggctgcctttagcaaatgtgcgtagtagtctacttaatcctcatgttaaaaatcgaaaaatgggccaggcgcagtggctcatgcctgtaatcgtagcactttgagaggccaaggtgggtggatcacctgaggtcaggggttcgacaccagcctggccaacatggtgaaacctcgtctctactacaaatacaaaaattagctgggtgtggtgccacatgcctgtaattccagctacttgggaggctgaggcatggagaatcgcttgaacccaggaggcagaagttgcagtgagcagagatcacaccactgcactccagcctgggcaacagagtaagactccatccacacacacacacacacacacaaaattgaaaagtgaagacattttaatggagatttaatagtgcttccagactaatgaactaatggagttttggctccactcatgagtgtatttgaaatgtaagtaaccagctacaaagaataatgtcacttcatttgattatgactaccaatcaagagaaggaggaatacatttctgaggagtgatactaaaccatttgagcttaaatgagtacctgattttgcagccattaaaatgagtcaataactatgtggaaatatagaaaaatattttataatataatactaagaaagaggacagtaggccataaagtgttagcagtgttatgctatgtctatataaataagcatgggccattaaaaatagcaaactgaaaacagttcatgtgtggggggcaagtttagaagtaattttaatgtatctaagaagtgatttcctttattgttgtactcaggtacgaagactaaaaatcaggatgaatccagaaaattaacacaaaaaagtatgtattaggctacttcctgtcatagtgaaattaaacactcaaagtaatgtaatctcagctgggcgtggcggctcatgcctgtaatcccagcactttggcaggacaaggcaggaggatcacttgaacctaggagttcgagaccagcctgggcaacacagcgagaacttgtctctattaaaaaaaaaaaaaggaatgtaatttcaatctttttcttgatatatggcttgagaatgataatgtaaaaggaattcttctcttacttcaataaaatgggttttaacataactttaaattcagttaaatatacaatattgaatacctatagttgactttgggatggggactttttcaagtcattaagagtgtttgtttaaggtgatctcattgatggtagttctcagccgtctcaaaaactgcaagctaatcagtcagacattctttaatgaccccaattttttcactttaattgttaccatgttttctatttttactgatttttgctaaagcatgtaagagtgaatttattatagcagtaatcttgtgtttctcctgatgtgcaataaatcaataattcaccagc

SEQ ID NO: 22095 - DNA, 1224 bp, Homo sapiens
gaattacaaaggaggccgtctgcctcctttgtcctggatttgggagttgagcaccttcgtcgccattggctttcctcccccagctccagcctctctcatcttgggaatctgcgtcagaagtcactcgcagtcccgtcagcccagaagacgtaaagcaggctaccagcaattttgagaacttgcaaaaacagcttgcaaggaaaatgaagcttcctattttcatagcagatgcattcacagcaagagcatttcgtgggaatcctgctgctgtttgcctcctagaaaatgaattggatgaagacatgcatcagaaaattgcaagggagatgaacctctctgaaactgcttttatccgaaaactgcacccgacagacaactttgcacaaagttcctgctttggactgagatggtttacaccagcgagtgaggtcccactctgtggccatgccaccctggcttctgcagctgtgctgtttcacaaaataaaaaacatgaatagcacgctcacgtttgtcactctgagtggagaactaagggccagacgagcagaggatggcatcgtcctggacttgcctctttatccagcccacccccaggacttccatgaagtagaggacttgataaagactgccataggcaacacactggtccaggacatctgttattctccagatacccaaaagctcctcgtccgcctcagtgacgtttacaacaggtcgtttctggagaacctgaaagtgaacacggagaatctgctgcaagttgaaaacacagggaaggtgaaagggcttattcttacccttaaaggagagcctggtgggcagacccaagcatttgacttttactcaagatattttgcaccgtgggttggtgtggctgaagacccagtgacagggtctgcacacgctgttctcagcagctactggtcccagcatctggggaagaaagaaatgcatggtaggacagctctttaccaatttcttttttatttgcctaattcgaagctagtgttccttctcatatgtactatccccttgaaaatgtaatacaatgtcatgtatcacccatgtgaaaatgaaaggttttaaaattccttcacccttaaagatcctccaccccaaacagccttcacctctgcctcccccaacatacagagactgtacagacacagatacagtaactgcccaataagtgtttgttgaataaaatagctgtataactttg

SEQ ID NO: 22096 - DNA, 1841 bp, Homo sapiens
tttcaagggtgacttgatttcgcctgatcctggtcggcagggtggggtttcttggcattcctcaggccgggggatgcgacgtctgggtgtggaggtgatgagctaggggttctgtggcactccggctctgctcagggcgacctgcgtaggggcctctggggcaggcccgctttctgtcaaaatggcagcgcccagcgtgcgcgggtatctctgaagttggggtttaagattcttgcccgtgagagcgaacgagcctgccgtacttctgattttgaaacacctgggtctgggcttcccgggcgagcggtggaacctgtgagaagtttctacaatggtgggctcagctctcaggagaggtgcccatgcatatgtctacctggtgagtaaggccagtcacatctccagaggccatcagcaccaggcctggggatcgaggcctcctgcagcagagtgtgccacccaaagagctccaggcagtgtggtggagctgctgggcaaatcctaccctcaggacgaccacagcaacctcacccggaaggtcctcaccagagttggcaggaacctgcacaaccagcagcatcaccctctgtggctgatcaaggagagggtgaaggagcacttctacaagcagtatgtgggccgctttgggaccccgttgttctcggtctacgacaacctttctccagtggtcacgacctggcagaactttgacagcctgctcatcccagctgatcaccccagcaggaagaagggggacaactattacctgaatcggactcacatgctgagagcgcacacgtctgcacaccagtgggacttgctgcacgcgggactggatgccttcctggtggtgggtgatgtctacaggcgtgaccagatcgactcccagcactaccctattttccaccagctggaggccgtgcggctcttctccaagcatgagttatttgctggtataaaggatggagaaagcctgcagctctttgaacaaagttctcgctctgcgcataaacaagagacacacaccatggaggccgtgaagcttgtagagtttgatcttaagcaaacgcttaccaggctcatggcacatctttttggagatgagctggagataagatgggtagactgctacttcccttttacacatccttcctttgagatggagatcaactttcatggagaatggctggaagttcttggctgcggggtgatggaacaacaactggtcaattcagctggtgctcaagaccgaatcggctgggcttttggcctaggattagaaaggctagccatgatcctctacgacatccctgatatccgtctcttctggtgtgaggacgagcgcttcctgaagcagttctgtgtatccaacattaatcagaaggtgaagtttcagcctcttagcaaatatccggctgtgatcaatgatatttcattctggttgccctctgagaattacgcagaaaatgatttctatgacttagtccgaacaattggaggagacctggtggaaaaggttgatctcatagacaagtttgtacatccaaagacgcacaagaccagccactgctaccgcatcacgtaccgccacatggaacggactctgtcccagagagaggtcaggcacatccaccaggccttgcaggaggctgcagtccagctgttgggtgtggagggcaggttctgatgtcaccacttcactcaggctgcagccctcttggggctccaggatttgctgaaagagaaaaagatatggtttgtgaactggggcatcaatcatcttttgataaatggatcagttttaggactttcagaaaataaaagatcgctcttgaaaagct

SEQ ID NO: 22097 - DNA, 1528 bp, Homo sapiens
aacctgtgagaagtttctacaatggtgggctcagctctcaggagaggtgcccatgcatatgtctacctggtgagtaaggccagtcacatctccagaggccatcagcaccaggcctggggatcgaggcctcctgcagcagagtgtgccacccaaagagctccaggcagtgtggtggagctgctgggcaaatcctaccctcaggacgaccacagcaacctcacccggaaggtcctcaccagagttggcaggaacctgcacaaccagcagcatcaccctctgtggctgatcaaggagagggtgaaggagcacttctacaagcagtatgtgggccgctttgggaccccgttgttctcggtctacgacaacctttctccagtggtcacgacctggcagaactttgacagcctgctcatcccagctgatcaccccagcaggaagaagggggacaactattacctgaatcggactcacatgctgagagcgcacacgtctgcacaccagtgggacttgctgcacgcgggactggatgccttcctggtggtgggtgatgtctacaggcgtgaccagatcgactcccagcactaccctattttccaccagctggaggccgtgcggctcttctccaagcatgagttatttgctggtataaaggatggagaaagcctgcagctctttgaacaaagttctcgctctgcgcataaacaagagacacacaccatggaggccgtgaagcttgtagagtttgatcttaagcaaacgcttaccaggctcatggcacatctttttggagatgagctggagataagatgggtagactgctacttcccttttacacatccttcctttgagatggagatcaactttcatggagaatggctggaagttcttggctgcggggtgatggaacaacaactggtcaattcagctggtgctcaagaccgaatcggctgggcttttggcctaggattagaaaggctagccatgatcctctacgacatccctgatatccgtctcttctggtgtgaggacgagcgcttcctgaagcagttctgtgtatccaacattaatcagaaggtgaagtttcagcctcttagcaaatatccggctgtgatcaatgatatttcattctggttgccctctgagaattacgcagaaaatgatttctatgacttagtccgaacaattggaggagacctggtggaaaaggttgatctcatagacaagtttgtacatccaaagacgcacaagaccagccactgctaccgcatcacgtaccgccacatggaacggactctgtcccagagagaggtcaggcacatccaccaggccttgcaggaggctgcagtccagctgttgggtgtggagggcaggttctgatgtcaccacttcactcaggctgcagccctcttggggctccaggatttgctgaaagagaaaaagatatggtttgtgaactggggcatcaatcatcttttgataaatggatcagttttaggactttcagaaaataaaagatcgctcttgaaaa

SEQ ID NO: 22098 - DNA, 1249 bp, Homo sapiens
tttcaagggtgacttgatttcgcctgatcctggtcggcagggtggggtttcttggcattcctcaggccgggggatgcgacgtctgggtgtggaggtgatgagctaggggttctgtggcactccggctctgctcagggcgacctgcgtaggggcctctggggcaggcccgctttctgtcaaaatggcagcgcccagcgtgcgcgggtatctctgaagttggggtttaagattcttgcccgtgagagcgaacgagcctgccgtacttctgattttgaaacacctgggtctgggcttcccgggcgagcggtggaacctgtgagaagtttctacaatggtgggctcagctctcaggagaggtgcccatgcatatgtctacctggtgagtaaggccagtcacatctccagaggccatcagcaccaggcctggggatcgaggcctcctgcagcagagtgtgccacccaaagagctccaggcagtgtggtggagctgctgggcaaatcctaccctcaggacgaccacagcaacctcacccggaaggtcctcaccagagttggcaggaacctgcacaaccagcagcatcaccctctgtggctgatcaaggagagggtgaaggagcacttctacaagcagtatgtgggccgctttgggaccccgttgttctcggtctacgacaacctttctccagtggtcacgacctggcagaactttgacagcctgctcatcccagctgatcaccccagcaggaagaagggggacaactattacctgaatcggactcacatgctgagagcgcacacgtctgcacaccagtgggacttgctgcacgcgggactggatgccttcctggtggtgggtgatgtctacaggcgtgaccagatcgactcccagcactaccctattttccaccagctggaggccgtgcggctcttctccaagcatgagttatttgctggtataaaggatggagaaagcctgcagctctttgaacaaagttctcgctctgcgcataaacaagagacacacaccatggaggccgtgaagcttgtagagtttgatcttaagcaaacgcttaccaggctcatggcacatctttttggagatgagctggagataagatgggtagactgctacttcccttttacacatccttcctttgagatggagatcaactttcatggagaatggctggaagttcttggctgcggggtgatggaacaacaactggtcaattcaggcggcgccacctga

SEQ ID NO: 22099 - DNA, 434 bp, Homo sapiens
ttatttgctggtataaaggatggagaaagcctgcagctctttgaacaaagttctcgctctgcgcataaacaagagacacacaccatggaggccgtgaagcttgtagagtttgatcttaagcaaacgcttaccaggctcatggcacatctttttggagatgagctggagataagatgggtagactgctacttcccttttacacatccttcctttgagatggagatcaactttcatggagaatggctggaagttcttggctgcggggtgatggaacaacaactggtcaattcaggcggcgccacctgactgagagaaaatggaaacacgaggttgctgattgaattctacgcatatctataggcatttcagaaagatctgtctggctcttttctgtaagaccattgcttaataaaaatgatggcttctaaatgtaa

SEQ ID NO: 22100 - DNA, 1157 bp, Homo sapiens
ggacgattgccgctgcagccgccgccccactcacctccggtgtgtctgcagcccggacactaagggagatggatgaatgggtggggaggatgcggcgcacatggccccgggcggctcggcggtcagctgccgcccccacagcggaccggtcggggcgggggtcgggcggtagaaaaaagggccgcgaggcgagcggggcactgggcggaccgcggcggcagcatgagcggcgcagaccgtagccccaatgcgggcgcagcccctgactcggccccgggccaggcggcggtggcttcggcctaccagcgcttcgagccgcgcgcctacctccgcaacaactacgcgccccctcgcggggacctgtgcaacccgaacggcgtcgggccgtggaagctgcgctgcttggcgcagaccttcgccaccggtgaagtgtccggacgcaccctcatcgacattggttcaggccccaccgtgtaccagctgctcagtgcctgcagccactttgaggacatcaccatgacagatttcctggaggtcaaccgccaggagctggggcgctggctgcaggaggagccgggggccttcaactggagcatgtacagccaacatgcctgcctcattgagggcaagggggaatgctggcaggataaggagcgccagctgcgagccagggtgaaacgggtcctgcccatcgacgtgcaccagccccagcccctgggtgctgggagcccagctcccctgcctgctgacgccctggtctctgccttctgcttggaggctgtgagcccagatcttgccagctttcagcgggccctggaccacatcaccacgctgctgaggcctggggggcacctcctcctcatcggggccctggaggagtcgtggtacctggctggggaggccaggctgacggtggtgccagtgtctgaggaggaggtgagggaggccctggtgcgtagtggctacaaggtccgggacctccgcacctatatcatgcctgcccaccttcagacaggcgtagatgatgtcaagggcgtcttcttcgcctgggctcagaaggttgggctgtgagggctgtacctggtgccctgtggcccccacccacctggattccctgttctttgaagtggcacctaataaagaaataataccctgcc

SEQ ID NO: 22101 - DNA, 821 bp, Homo sapiens
gctgcgagggggaaactggggaaagggcctaattccccagtctccacctcgaatcaggaaagagaaggggcgggctgctgggcaaaagaggtgaagtgtccggacgcaccctcatcgacattggttcaggccccaccgtgtaccagctgctcagtgcctgcagccactttgaggacatcaccatgacagatttcctggaggtcaaccgccaggagctggggcgctggctgcaggaggagccgggggccttcaactggagcatgtacagccaacatgcctgcctcattgagggcaagggggaatgctggcaggataaggagcgccagctgcgagccagggtgaaacgggtcctgcccatcgacgtgcaccagccccagcccctgggtgctgggagcccagctcccctgcctgctgacgccctggtctctgccttctgcttggaggctgtgagcccagatcttgccagctttcagcgggccctggaccacatcaccacgctgctgaggcctggggggcacctcctcctcatcggggccctggaggagtcgtggtacctggctggggaggccaggctgacggtggtgccagtgtctgaggaggaggtgagggaggccctggtgcgtagtggctacaaggtccgggacctccgcacctatatcatgcctgcccaccttcagacaggcgtagatgatgtcaagggcgtcttcttcgcctgggctcagaaggttgggctgtgagggctgtacctggtgccctgtggcccccacccacctggattccctgttctttgaagtggcacctaataaagaaataataccctg

SEQ ID NO: 22102 - DNA, 741 bp, Homo sapiens
atggaagaagccaaaagccaaagtttggaggaagactttgaaggacaggccacacatacaggacccaaaggagtaataaatgattggagaaagtttaaattagagagtcaagacagtgattcaattccacctagcaagaaggagattctcaggcaaatgtcttctcctcagagtaggaatggcaaagattcaaaggaacgagtcagcagaaagatgagcattcaagaatatgaactaatccataaagagaaagaggatgaaaactgccttcgtaaataccgtagacagtgtatgcaggatatgcaccagaagctgagttttgggcctagatatgggtttgtgtatgagctggaaactggaaagcaattcctagaaacaattgaaaaggaactgaagatcaccacaattgttgttcacatttatgaagatggtattaagggttgtgatgctctaaacagtagtttaacatgccttgcagcagaataccctatagttaagttttgtaaaataaaagcttcgaatacaggtgctggggaccgcttttccttagatgtacttcctacactgctcatctataaaggtggggaactcataagcaattttattagtgttgctgaacagtttgctgaagaattttttgctggggatgtggagtctttcctaaatgaatatgggttactacctgaaagagaggtacatgtcctagagcataccaaaatagaagaagaagatgttgaatga

SEQ ID NO: 22103 - DNA, 1242 bp, Homo sapiens
acgagttcagtagacagggattctcacccactcaacaaggacaccaggcacagagatccaaactattatatcaaatccagtccctaaaatggaagaagccaaaagccaaagtttggaggaagactttgaaggacaggccacacatacaggacccaaaggagtaataaatgattggagaaagtttaaattagagagtcaagacagtgattcaattccacctagcaagaaggagattctcaggcaaatgtcttctcctcagagtaggaatggcaaagattcaaaggaacgagtcagcagaaagatgagcattcaagaatatgaactaatccataaagagaaagaggatgaaaactgccttcgtaaataccgtagacagtgtatgcaggatatgcaccagaagctgagttttgggcctagatatgggtttgtgtatgagctggaaactggaaagcaattcctagaaacaattgaaaaggaactgaagatcaccacaattgttgttcacatttatgaagatggtattaagggttgtgatgctctaaacagtagtttaacatgccttgcagcagaataccctatagttaagttttgtaaaataaaagcttcgaatacaggtgctggggaccgcttttccttagatgtacttcctacactgctcatctataaaggtggggaactcataagcaattttattagtgttgctgaacagtttgctgaagaattttttgctggggatgtggagtctttcctaaatgaatatgggttactacctgaaagagaggtacatgtcctagagcataccaaaatagaagaagaagatgttgaatgaagattcactatgtcaatatctcatgtttatcctttaggtattggatgatggttttggtagtatctatattgctttagtgaacacagagtatgggcacggctatgctaacttgacaaaaatgactgatgcaacaatcgagttattagcatttcttagtattagttactcaaattgatacaatgcttgactacaaaacagagctgtcttcagcaacattattagtagacaaagaggatgtggataatattatgacatttttcaaaaatccctttcaagttatgttttgtcttttttactccattttccctcatcactgttattatttggacttttcaaattacattattcattataattttctttgtgtaataaaaatgaaatctcatgagaaaataaattttctatttgaagtc

SEQ ID NO: 22104 - DNA, 699 bp, Homo sapiens
gcaagaaggagattctcaggcaaatgtcttctcctcagagtaggaatggcaaagattcaaaggaacgagtcagcagaaagatgagcattcaagaatatgaactaatccataaagagaaagaggatgaaaactgccttcgtaaataccgtagacagtgtatgcaggatatgcaccagaagctgagttttgggcctagatatgggtttgtgtatgagctggaaactggaaagcaattcctagaaacaattgaaaaggaactgaagatcaccacaattgttgttcacatttatgaagatggtattaagggttgtgatgctctaaacagtagtttaacatgccttgcagcagaataccctatagttaagttttgtaaaataaaagcttcgaatacaggtgctggggaccgcttttccttagatgtacttcctacactgctcatctataaaggtggggaactcataagcaattttattagtgttgctgaacagtttgctgaagaattttttgctggggatgtggagtctttcctaaatgaatatgggttactacctgaaagagaggtacatgtcctagagcataccaaaatagaagaagaagatgttgaatgaagattcactatgtcaatatctcatgtttatcctttaggtattggatgatggttttggtagtatctatattgctttagtgaacacagagtat

SEQ ID NO: 22105 - DNA, 1174 bp, Homo sapiens
aaatgtgtggagatttattttataatagcaatgtgaggaataccttcctaattatgacaaaaacaaaaacaacaacaaaaagaccattgaagaaaaggacccaaaggagtaataaatgattggagaaagtttaaattagagagtcaagacagtgattcaattccacctagcaagaaggagattctcaggcaaatgtcttctcctcagagtaggaatggcaaagattcaaaggaacgagtcagcagaaagatgagcattcaagaatatgaactaatccataaagagaaagaggatgaaaactgccttcgtaaataccgtagacagtgtatgcaggatatgcaccagaagctgagttttgggcctagatatgggtttgtgtatgagctggaaactggaaagcaattcctagaaacaattgaaaaggaactgaagatcaccacaattgttgttcacatttatgaagatggtattaagggttgtgatgctctaaacagtagtttaacatgccttgcagcagaataccctatagttaagttttgtaaaataaaagcttcgaatacaggtgctggggaccgcttttccttagatgtacttcctacactgctcatctataaaggtggggaactcataagcaattttattagtgttgctgaacagtttgctgaagaattttttgctggggatgtggagtctttcctaaatgaatatgggttactacctgaaagagaggtacatgtcctagagcataccaaaatagaagaagaagatgttgaatgaagattcactatgtcaatatctcatgtttatcctttaggtattggatgatggttttggtagtatctatattgctttagtgaacacagagtatgggcacggctatgctaacttgacaaaaatgactgatgcaacaatcgagttattagcatttcttagtattagttactcaaattgatacaatgcttgactacaaaacagagctgtcttcagcaacattattagtagacaaagaggatgtggataatattatgacatttttcaaaaatccctttcaagttatgttttgtcttttttactccattttccctcatcactgttattatttggacttttcaaattacattattcattataattttctttgtgtaataaaaatgaaatctcatgagaaaataaa

SEQ ID NO: 22106 - DNA, 2813 bp, Homo sapiens
cgcaggaaggccgcctcattggtccgcgctgtcgggcttcggcggcttttctctttagcgctcagggcgctgacccactgctcttcctcttaagaaagtgctccattccttccggcgcccggagctgctggcccaaagggatccggagcgagctagggcagacaccatgaccacccttgatgataagttgctgggggagaaactgcagtactactatagcagcagtgaggatgaggacagtgaccacgaggacaaggaccgaggcagatgtgccccagccagcagttctgtgcctgcagaggctgagctggcaggcgaaggcatctcagttaacacaggcccaaaaggtgtgatcaatgactggcgccgcttcaagcagttggagacagagcagagggaggagcagtgccgggagatggaaaggctgatcaagaagctgtcaatgacttgcaggtcccatctggatgaagaggaggagcaacagaaacagaaagacctccaggagaagatcagtgggaagatgactctgaaggagtttgccataatgaatgaggaccaagatgatgaagagtttctgcagcagtaccggaagcagcgaatggaagagatgcggcagcagcttcacaaggggccccaattcaagcaggtttttgagatctccagtggagaagggtttttagacatgattgataaagaacagaaaagcattgtcatcatggttcatatttatgaggatggcattccagggaccgaagccatgaatggttgcatgatctgccttgccgcagagtacccagctgtcaagttctgcaaggtgaagagctcagttattggcgccagcagtcagttcaccaggaatgcccttcctgccctgctgatctataaggggggtgaattgatcggcaattttgttcgtgttactgaccagctgggggatgatttctttgctgtggaccttgaagcttttctccaggaatttggattactcccagaaaaggaagtcttggtgctgacatctgtgcgtaactctgccacgtgtcacagtgaggatagcgacctggaaatagattgaactgatagtctagttgcatagatttctcattgtttgggttggaatacacgtcattgtttatttttgttcctttgtcttctggcttttcagctgttctttgtagtcccttttattatgcataaaataaagaaattcttagattaaatcagaatgctgaataaccttgtagctagcaataaggtgacttacagttgtataaacaggaagccaggcttttgaactgtttacttaagattctgtggtgtgacatctctgttattgtttccagtcaatatttacaaagcatcctaaagacagggtcttggaaattgtcttcagatgatcttagaggtctctgccaagtctgagagtataattctgtaggtattgtgttatttgcaacgtaaatagtgcattttcttaatcaaatgattgtaaattatatttacttgtaatcagttccatagctttagacggtggttagattttttttttccccaccagggtcttgtttaaaggggtgagccaccgcacccagtcctgaggggtggcctctgctgctggatttcatgtcttcctccagcatgactaagtctggaacagcaggaagggttgatgcttactgacctggtgatgttagaagacaagtagtttatggatttaaacattagagctggagtggggctggaaatctttgtaaaggaagttctttcagtaagatgcccctgcttgtctttgtctcttttttgtttaacaaggtaactttttgtttaacaaggtaactttttgtttaacctagattttttttaaaactttttttttttttcatattggaaaagtaattcatattcagtagaggaaaactgaccaaaacagaagcaaaaataagaaaattaaaataatctctaatcctactacctagaataaaacactattaatattttggtctgtttcctgccaaggtgttttctgtgtatacatggatattttgtttgtttttaaacaaaacgatgggatcattctgaacatactgttctatagtatggtcagctaataatatatcagacctttttttatattattaaatattctacaactttttaaaaatgtctattaatattccatcgtatagatgtgatataatttgcttgatggttgtctcttaaaaagaaagatagcaaatactttttttaaattacaaaagtgatagatgttcattgtagaaaatgtaataaacactgttaagacttaaaagccatataattccaccaaccaaaattaatcccttttgtcatatttctagtcatttttatagcctttttttctatgtatttataataattatcatttgcgtttttttcctttttttaactttaaaaatgtatattctagggtcaggggaaatgtaatctggaattaaatattagccttaaaattcacaattttgattttcctggcttttcaggaattgactaactgtaaaagagtcttgaaagtatttagtcaacaaacagagtgcattttttttttttttgactaagaaagctcgttgtagtagaaagggtggaatgtattgaaaattattagaagcagggaagtattgttagtctagcttatttcctttcagtcttttttcaatatttttataaacattgagtacttactgaatttagttctgtgctcttccttatttagtgttgtatcataaatactttgatgtttcaaacattctaaataaataattttcagtggcttcataata

SEQ ID NO: 22107 - DNA, 595 bp, Homo sapiens
actgcagtactactatagcagcagtgaggatgaggacagtgaccacgaggacaaggaccgaggcagatgtgccccagccagcagttctgtgcctgcagaggctgagctggcaggcgaaggcatctcagttaacacaggcccaaaaggtgtgatcaatgactggcgccgcttcaagcagttggagacagagcagagggaggagcagtgccgggagatggaaaggctgatcaagaagctgtcaatgacttgcaggtcccatctggatgaagaggaggagcaacagaaacagaaagacctccaggagaagatcagtgggaaggagagatgaggctttgccatgttggccaggctggtcttgaactcctgacctcaagtgatccgctcgtctcagcctcccaaagtgctaggattacaggcgtgagccaccgcgcccggcccatattaactgttatcacgagtgttcagttttcatatttatgctcacttgctggtccgcctgcagatgactctgaaggagtttgccataatgaatgaggaccaagatgatgaagagtttctgcagcagtaccggaagcagcgaatggaagagatgcgg

SEQ ID NO: 22108 - DNA, 404 bp, Homo sapiens
atgtgccccagccagcagttctgtgcctgcagaggctgagctggcaggcgaaggcatctcagttaacacaggcccaaaaggtgtgatcaatgactggcgccgcttcaagcagttggagacagagcagagggaggagcagtgccgggagatggaaaggctgatcaagaagctgtcaatgacttgcaggtcccatctggatgaagaggaggagcaacagaaacagaaagacctccaggagaagatcagtgggaagaaatcttgggcaattctgtaagaagagaattgaagtaactgagaggaattttagggcacaggtttgctgaagactgtgctgaaaccacctttacagggaaatgatcttttaatttatttccacatctttctctattaaaaaaaaatcaatg

SEQ ID NO: 22109 - DNA, 861 bp, Homo sapiens
gaagcgggcgctcttccagcctggagaaggctgcgggtctccatccgtggcgcctcgccagctgcaggacgacgcgggctcttgaggggcagagcagcgcatcatgcaggatcccaatgaagatacagaatggaatgacattttaagagatttcggcattcttcctcctaaagaagagtcaaaagatgaaattgaagaaatggttttacgtttacagaaagaagcaatggtgaaaccatttgaaaagatgactcttgcacagctaaaggaagctgaagatgaatttgatgaagaagatatgcaggctgttgaaacatatagaaagaagcggttacaggaatggaaagctcttaagaaaaaacaaaaatttggagaattaagagaaatttctggaaatcagtatgtgaatgaagtcacaaatgcagaagaagatgtgtgggttataattcatctatacagatcaagcatcccaatgtgtttgttggttaaccagcatcttagtcttctagcaagaaagtttccagaaactaaatttgttaaagccatcgtgaatagctgtattcaacactaccatgacaattgtttaccaacaatttttgtgtataaaaatggtcagatagaagccaaattcattggaattatagaatgtggagggataaatctcaagctggaagaacttgaatggaagctagcagaagttggagcaatacagactgatttggaagaaaaccccagaaaagacatggtagatatgatggtatcttcaattagaaacacttctattcatgatgacagtgatagctccaacagtgataatgataccaaatagagagaaatattcaataaatagcttttagtata

SEQ ID NO: 22110 - DNA, 1337 bp, Homo sapiens
gtctttacaggtttgggccggcagctggaaaaggcacacggccccgggctcctcctccacccagccccacccctcctccgctgaagaccagccctaataaggcagccaccagaattagaaccaggtcaagtgcactccgagcaggacagtaggcagatcctatctggcgcatgcgaacgcttctgtgccagttccttgaagagcaggcgcagactcaaggctgttgcttccgcccttactccccgccgctcgtccctgggcggggcgaaggctgggctgggggaagaggcgtggcggcgctgtgcgcgtgcacaaaagagagctgaggggcgggggcgctgcggcacagctggtttgagcaactgaactggaaacaagatgcaggaccccaacgcagacactgaatggaatgacatcttacgcaaaaagggtatcttaccccccaaggaaagtctgaaagaattggaagaggaggcagaagaggagcagcgcatcctccagcagtcagtggtgaaaacatatgaagatatgactttggaagagctggaggatcatgaagacgagtttaatgaggaggatgaacgtgctattgaaatgtacagacggcggagactggctgagtggaaagcaactaaactgaagaataaattcggagaagttttggagatctcagggaaggattatgttcaagaagttaccaaagctggcgagggcttgtgggtcatcttgcacctttacaaacaaggaattcccctctgtgccctgataaatcagcacctcagtggacttgccaggaagtttcctgatgtcaaatttatcaaagccatttcaacaacctgcatacccaattatcctgataggaatctgcccacgatatttgtttacctggaaggagatatcaaggctcagtttattggtcctctggtgtttggcggcatgaacctgacaagagatgagttggaatggaaactgtctgaatctggagcaattatgacagacctggaggaaaaccctaagaagccgattgaagacgtgttgctgtcctcagtgcggcgctctgtcctcatgaagagggacagcgattccgagggtgactgaggctacagcttctatcacatgccgaactttcttgtgacaaattgtctggattttttaaaaaaggaaaaagcaagaatgaatccttgtggtttttagttttgtataaattatgtttcaaatctttacattttggaaataatcattgctggagattctgttaaatattttggaactctttttttttttaaattatagtatttcctctaaaaaaaattaaaaccagccatttgtatggcaaa

SEQ ID NO: 22111 - DNA, 5597 bp, Homo sapiens
cccgggcgtctccccgcaacctcctcaacttccctagtcagtgacgcggcgccggccagaaatccgaccggaccgggctcgggggagcgtgagttgcagcatgtgccgaagcgccacctcagaagataaaaagaaatgagtctcatatttggcattcttttagttaaaagaagatggatgcacagtgttcagccaaggtcaatgcaaggaagaggagaaaagaggcgcccggacccaacggggcaacagaagaagatggggttccttccaaagtgcagcgctgtgcagtgggcttacggcaaccagctcctttttctgatgaaattgaagttgactttagtaagccctatgtcagggtaactatggaagaagccagcagaggaactccttgtgagcgacctgtgagagtttatgccgatggaatatttgacttatttcactctggtcacgcccgagctctgatgcaagcgaagaaccttttccctaatacgtacctcattgtgggagtttgcagtgatgagctcacacacaacttcaaaggcttcacggtgatgaacgagaatgagcgctatgacgcagtccagcactgccgctacgtggatgaggtggtgaggaatgcgccctggacgctgacacccgagttcctggccgaacaccggattgattttgtagcccatgatgatattccttattcatctgctggcagtgatgatgtttataagcacatcaaggaggcaggcatgtttgctccaacacagaggacagaaggtatctccacatcagacatcatcacccgaattgtgcgggattatgatgtgtatgcgaggcggaacctgcagaggggctacacagcaaaggagctcaatgtcagctttatcaacgagaagaaataccacttgcaggagagggttgacaaagtaaagaagaaagtgaaagatgtggaggaaaagtcaaaagaatttgttcagaaggtggaggaaaaaagcattgacctcattcagaagtgggaggagaagtcccgagaattcattggaagttttctggaaatgtttggtccggaaggagcactgaaacatatgctgaaagaggggaagggccggatgctgcaggccatcagcccgaagcagagccccagcagcagccctactcgcgagcgctccccctccccctctttccgatggcccttctccggcaagacttccccaccttgctccccagcaaatctctccaggcacaaggctgcagcctatgatatcagtgaggatgaagaagactaatgtttcctccctcctttcctgtcctccctttctgtcccattaccttcagaagctctctgttgaattccaaattgtgaccccaacactaaacctaaggacagctacaaaggaaagacaactggggaaagaagacctaggactgggggaacccaaacagcctgtcctgcaagtgacatcactcacccacacgaaggagggggactgcaccttagaagcctgctctgcatccatttacccccccccaagggctttgtttcactgtttatgttcacgtgatctcaacagggaaattgtcattttcattaattttttaaaaaattcgtctttcaaatgtagaactaattttttgcccctgaggagtgggcagaagaaggaggtagtgtaatacgcagaggccttttcttcccggtatactatagcatttgccttccgttctgaagctatgtggcttgccaagtccttcacgaaatgagccacgctgatgggtaatttgtggagaaatatcttaattttgatttccttaaggaaaagcgaaaagcagagttacagtcacaaatcccctgaacgtactgctgtcaccagtgtcattgtggctgcgggaaggagatctgaacctaacttttcttactccctgaggagtttcttgttggacccaatggggtccatgaagacactgatggggatggaagcagacccatggcatcaactgcagtgtttctgctgtgttcatcttctcagaaaactctgtgacccagttctttgggagcttttgtcagtctctttcgtgccatctaccttcgaaggaaggaacacttttagagttacaatgatgaggagaggagcgggacaatactcaatcctataccaagtcgattgagattagtttcctactgggagtaagtgcctggccctgctactcctatttgaatgctattaatattacctagccttttacaaaggatactttgtaaatgtctgctgttggaacttgatgttaatccattttggtcatagccatattagagagatttgcacagaatgtaaaggcaaaagcataggaaacaccttcctttctaaagcaacagccttatcaccttgacctctgtccctcttcagaacattcttccctggaaccagtgctccacatctttcttttcctctgagagctgcagctggcagggacctccctctgctgctcctccagcaagccacagagcataccctcacgtgacaagagtgtggtaggttttctccccacttttcacacacgcctggtggttgtggttccatctgccttgttggcttgcccggggggattcaacacttgactttcaaatcaaagaatgctaatgcttagcacttgctgttgagcatgctctaacttttaaagccctggcctcctgtctccttagctgcttagctacgcggcctagcagatcatcacccatcagtaatcctgtggctagatccaggggaaaattgcttatgtccaggccccacccctgtcactcataaataccccttgtgggggtggaattttagtgttttcagctaagaaaaccacattttctctttccttgcctctgctaggactgtgagcatctcatagtccactccctaaacactttctggtaacacctagttttccgcctgagggtcagaggctagaatcattgcctgcacagcaggactaccttggttcttaaaacttggatcacccaggcaaggcgtggtggctcacgcctgtcatctcagcactttgggagactgaggctggtggatcacttgaggccacgagtttgagaccagcctgaccaacgtggtgaaaccccatctctactaaaaatacaaaaattagccaggcgtggtggtgggcacctgtaatcccagctacttgggaggctgaggcaggagaatcccttgaacccaggaggcggaggttgcagtgagcagagatggtgccgctgcagtccagcctgggtgacagagcgagactctgtctccaaaacaaaacaaaaaccacacacacatacagaaataaagagaaataatcaactagaaaaaaaacaaaacttggatcacccagaaagagcgtcacagaggcgagggagaatgaagcctcttgttatcctgatcgcctatgacaacgacatttctaactcttctttgaagcgcagttcttactcttaaatctggtcatacaagctttggcttggaatcctgtctgtctttgaaacagctgaagttagtgttttcctgtgttacccagtgttacatagtctcatctttgaacttttctgcgtcagccttctctctttgggaatgctgcctgtttctgtctaacttattctccctggtgtggtgtggcagtgaagtctgtgctgaagcccatctgcttggttcctccaagtgcacattatgcaagtgtatttggatagacagggagatgcccggaacgtggttttcctcctccctccctattggagccatacctcctaaatatattgtctgggtcccaaatgtttgagccctcttcctctgctctcagtgggctgctcttggcatgccctgtgcttggaacgggacctgcaggctgacaggcctctgagactgctagggccagcaaacgtacatgttattgggaaactccctttccccttttggtgagcttctaccacctcagtctaatcgttttgactgaaagctatttgtctgactgaaagctaaaatcttttatagtgtggcctgttagatactttggggtaaatgtggtctgaggtgctggactagcacgggtagatggagaaagctgttgggaagttgcataatgtggtcatctgtgcctaattaaatgaggttagaggtgtgcacaccaccacaatgcctgggatctaaatcttcagatattaacgtttgaggctatggagctgtttccctgaatcacacacgagaaagcagtcaacatgggtgggccaaatgtggccaagatgagagagccagaagtgttggccttagagcagagcctctgtgtgtgagacattagaaggccagagccggggaggtgccggcgcagccactgccttccggtgggccggacggaaagcttggtcttatgctagattcagaagcactgaagaatggaggttgacactttagaggactaggaagggatcatttgtgctcttgcagctattgctgatagctagagccaaagaccattatattgctgaggcttgggtaagaaagttagggatgtgaggaggttgaaaatcctgaagaagagaaaaaatatgagggaggctaaggaaacttagccactttctgatcactgatgactccttaggctgcacctgagtgatggtggtgtttttggaggctgtacctgagtgatggtggtttttggggggctgcacctgagcgatagtgatttttttttggaggctgcacagctggtcagaccatctctagatgttctttccacagtggttcatagggcgtcattcccccttcctggattattttgactatgggtagcttattttcaagagctctttgcctttttaatcctgttccagatcacttatccaaaatctttccaaatcaattatattttgctgcttttctttaattccctaaaagccatagcttctagattttctatcagcacacattctcaccagaagttgaaccaatacaggtagaaaaagaaagcccccttaatgtttttaactgatgatatttttttaagcttaccaatataagtatttttaaaggttctatttttcaaagtcataacaatgattgttcttgttttctctcatagaatagactgccatcggataaagagtggtccctagcttctatttttccaagtaaataagtagaacatgttcttgggattataccattaaatgttaattttcttgaagaagaaagattgttgtctgccaagattttatgttagcgctcggattgaggcagaaaacggaagcaccaggtttaacactgggatgacttgggttgtgttcctggaggtttgaagtgggccttcccgccttttgagggggaaaactgactgttttgaacacatatcctggattagttgggttgttttgtattgaggatccctaaaagacaaaagagtcttggaaaggactgctggcttcgtcttgaacgttcgccccatcaccagtgtgagtccgtggggaagtcttcctcaagtggggttcagtctgtaattttcctgtctgttcttagtttgttctgagttattttggattttgttctttagccaaataaaggcagtgtggttttacctga

SEQ ID NO: 22112 - DNA, 1084 bp, Homo sapiens
atcagctgccttccccgggcgtctccccgcaacctcctcaacttccctagtcagtgacgcggcgccggccagaaatccgaccggaccgggctcgggggagcgtgagttgcaggtgtgtgcctatctttgcgtctctgtttgagaggacaaactgtggggctgggaccgcgaggtgactgtgactgaggaagagtgttaaaagaagatggatgcacagtgttcagccaaggtcaatgcaaggaagaggagaaaagaggcgcccggacccaacggggcaacagaagaagatggggttccttccaaagtgcagcgctgtgcagtgggcttacggcaaccagctcctttttctgatgaaattgaagttgactttagtaagccctatgtcagggtaactatggaagaagccagcagaggaactccttgtgagcgacctgtgagagtttatgccgatggaatatttgacttatttcactctggtcacgcccgagctctgatgcaagcgaagaaccttttccctaatacgtacctcattgtgggagtttgcagtgatgagctcacacacaacttcaaaggcttcacggtgatgaacgagaatgagcgctatgacgcagtccagcactgccgctacgtggatgaggtggtgaggaatgcgccctggacgctgacacccgagttcctggccgaacaccggattgattttgtagcccatgatgatattccttattcatctgctggcagtgatgatgtttataagcacatcaaggaggcaggcatgtttgctccaacacagaggacagaaggtatctccacatcagacatcatcacccgaattgtgcgggattatgatgtgtatgcgaggcggaacctgcagaggggctacacagcaaaggagctcaatgtcagctttatcaacgagaagaaataccacttgcaggagagggttgacaaagtaaagaagaaagtgaaagatgtggaggaaaagtcaaaagaatttgttcagaaggtggaggaaaaaagcattgacctcattcagaagtgggaggagaagtcccgagaattcattggaagttttctggaaatgttt

SEQ ID NO: 22113 - DNA, 499 bp, Homo sapiens
gcggccgcgaggggactccgacccagagcagtgacttcgaggggctgacttggagaagaggatggcatccgtgatgggcgatggcgctttaaaagaagatggatgcacagtgttcagccaaggtcaatgcaaggaagaggagaaaagaggcgcccggacccaacggggcaacagaagaagatggggttccttccaaagtgcagcgctgtgcagtgggcttacggcaaccagctcctttttctgatgaaattgaagttgactttagtaagccctatgtcagggtaactatggaagaagccagcagaggaactccttgtgagcgacctgtgagagtttatgccgatggaatatttgacttatttcactctggtcacgcccgagctctgatgcaagcgaagaaccttttccctaatacgtacctcattgtgggagtttgcagtgatgagctcacacacaacttcaaaggcttcacggtgatgaacgagaatgagcgctatga

SEQ ID NO: 22114 - DNA, 1598 bp, Homo sapiens
atcagctgccttccccgggcgtctccccgcaacctcctcaacttccctagtcagtgacgcggcgccggccagaaatccgaccggaccgggctcgggggagcgtgagttgcagttaaaagaagatggatgcacagtgttcagccaaggtcaatgcaaggaagaggagaaaagaggcgcccggacccaacggggcaacagaagaagccagcagaggaactccttgtgagcgacctgtgagagtttatgccgatggaatatttgacttatttcactctggtcacgcccgagctctgatgcaagcgaagaaccttttccctaatacgtacctcattgtgggagtttgcagtgatgagctcacacacaacttcaaaggcttcacggtgatgaacgagaatgagcgctatgacgcagtccagcactgccgctacgtggatgaggtggtgaggaatgcgccctggacgctgacacccgagttcctggccgaacaccggattgattttgtagcccatgatgatattccttattcatctgctggcagtgatgatgtttataagcacatcaaggaggcaggcatgtttgctccaacacagaggacagaaggtatctccacatcagacatcatcacccgaattgtgcgggattatgatgtgtatgcgaggcggaacctgcagaggggctacacagcaaaggagctcaatgtcagctttatcaacgagaagaaataccacttgcaggagagggttgacaaagtaaagaagaaagtgaaagatgtggaggaaaagtcaaaagaatttgttcagaaggtggaggaaaaaagcattgacctcattcagaagtgggaggagaagtcccgagaattcattggaagttttctggaaatgtttggtccggaaggagcactgaaacatatgctgaaagaggggaagggccggatgctgcaggccatcagcccgaagcagagccccagcagcagccctactcgcgagcgctccccctccccctctttccgatggcccttctccggcaagacttccccaccttgctccccagcaaatctctccaggcacaaggctgcagcctatgatatcagtgaggatgaagaagactaatgtttcctccctcctttcctgtcctccctttctgtcccattaccttcagaagctctctgttgaattccaaattgtgaccccaacactaaacctaaggacagctacaaaggaaagacaactggggaaagaagacctaggactgggggaacccaaacagcctgtcctgcaagtgacatcactcacccacacgaaggagggggactgcaccttagaagcctgctctgcatccatttacccccccccaagggctttgtttcactgtttatgttcacgtgatctcaacagggaaattgtcattttcattaattttttaaaaaattcgtctttcaaatgtagaactaattttttgcccctgaggagtgggcagaagaaggaggtagtgtaatacgcagaggccttttcttcccggtatactatagcatttgccttccgttctgaagctatgtggcttgccaagtccttcacgaaatgagccacgctgatgggtaa

SEQ ID NO: 22115 - DNA, 1482 bp, Homo sapiens
atcccgggggcctctgaggaggcggaactactgtgtcaggagtcgtggttttcaaggagaagtcgtggtcggattgacagaggtaggggaagtaggcggaacttccggctggctcttccatcagctgccttccccgggcgtctccccgcaacctcctcaacttccctagtcagtgacgcggcgccggccagaaatccgaccggaccgggctcgggggagcgtgagttgcagttaaaagaagatggatgcacagtgttcagccaaggtcaatgcaaggaagaggagaaaagaggcgcccggacccaacggggcaacagaagaagatggggttccttccaaagtgcagcgctgtgcagtgggcttacggcaaccagctcctttttctgatgaaattgaagttgactttagtaagccctatgtcagggtaactatggaagaagccagcagaggaactccttgtgagcgacctgtgagagtttatgccgatggaatatttgacttatttcactctggtcacgcccgagctctgatgcaagcgaagaaccttttccctaatacgtacctcattgtgggagtttgcagtgatgagctcacacacaacttcaaaggcttcacggtgatgaacgagaatgagcgctatgacgcagtccagcactgccgctacgtggatgaggtggtgaggaatgcgccctggacgctgacacccgagttcctggccgaacaccggattgattttgtagcccatgatgatattccttattcatctgctggcagtgatgatgtttataagcacatcaaggaggcaggcatgtttgctccaacacagaggacagaaggtatctccacatcagacatcatcacccgaattgtgcgggattatgatgtgtatgcgaggcggaacctgcagaggggctacacagcaaaggagctcaatgtcagctttatcaacgagaagaaataccacttgcaggagagggttgacaaagtaaagaagaaagtgaaagatgtggaggaaaagtcaaaagaatttgttcagaaggtggaggaaaaaagcattgacctcattcagaagtgggaggagaagtcccgagaattcattggaagttttctggaaatgtttggtccggaaggagcactgaaacatatgctgaaagaggggaagggccggatgctgcaggccatcagcccgaagcagagccccagcagcagccctactcgcgagcgctccccctccccctctttccgatggcccttctccggcaagacttccccaccttgctccccagcaaatctctccaggcacaaggctgcagcctatgatatcagtgaggatgaagaagactaatgtttcctccctcctttcctgtcctccctttctgtcccattaccttcagaagctctctgttgaattccaaattgtgaccccaacactaaacctaaggacagctacaaaggaaagacaactggggaaagaagacctag

SEQ ID NO: 22116 - DNA, 549 bp, Homo sapiens
acatccgtatcccacttcaaggagacgtcttcgctgcatcctccggttccgggtggaggctgaccctgggccattccgtctccggtctctggtatttctgctgggtcacttcatcccgggggcctctgaggaggcggaactactgtgtcaggagtcgtggttttcaaggagaagtcgtggtcggattgacagagttaaaagaagatggatgcacagtgttcagccaaggtcaatgcaaggaagaggagaaaagaggcgcccggacccaacggggcaacagaagaagatggggttccttccaaagtgcagcgctgtgcagtgggcttacggcaaccagctcctttttctgatgaaattgaagttgactttagtaagccctatgtcagggtaactatggaagaagccagcagaggaactccttgtgagcgacctgtgagagtttatgccgatggaatatttgacttatttcactctggtcacgcccgagctctgatgcaagcgaagaaccttttccctaatacgtacctcattgtgggagtttgcagtgat

SEQ ID NO: 22117 - DNA, 6172 bp, Homo sapiens
aagggactcacacactgaaagaatatctttgatgaagacaattcaggcaagcagaatgattcttgcaacagaattacatgattaattgagatcttgaagtgggtccggtgaatcctggccacctaacttatcatgatttgggggagtttcacgagaatccagttttgataaaacaattgtttttttcctccccaagtgactatacatttaaatagctaaaacatctgttcagcaacatagtaaaacatatatactcggaacgcttgagagaagagcctgccaaacagggactttgctgagggagagcaccaagataaagcaacactgtttgttttgtctagtcagggggaaagccaaggcaaccaatattttggtttttataattttcatttgtgaagaattatttgagaaagggtggcgaggggagatttcctgacggcagtttcttaagctgtccattagtagaagagcaagaaagccttggatgtcaacgcctcgctcttgagaccagccaccaaaccacgaaaagtgactttcttctcgtgtgctctctacggcccttctgatggaagcagaaacagggagcagcgtggagactggaaagaaggccaacagaggcactcgaattgccctggtcgtgtttgtcggtggcaccctagttctgggcacgatcctctttctagtgagtcaaggtctcttaagtctccaagctaaacaggagtactgcctgaagccagaatgcatcgaagcggctgctgccatcttaagtaaagtaaatctgtctgtggatccttgtgataatttcttccggttcgcttgtgatggctggataagcaataatccaattcccgaagatatgccaagctatggggtttatccttggctgagacataatgttgacctcaagttgaaggaacttttggagaaatcaatcagtagaaggcgggacaccgaagccatacagaaagccaaaatcctttattcatcctgcatgaatgagaaagcgattgaaaaagcagatgccaagccactgctacacatcctacggcattcacctttccgctggcccgtgcttgaatctaatattggccctgaaggggtttggtcagagagaaagttcagccttctgcagacacttgcaacgtttcgtggtcaatacagcaattctgtgttcatccgtttgtatgtgtcccctgatgacaaagcatccaatgaacatatcttgaagctggaccaagcaacactctccctggccgtgagggaagactaccttgataacagtacagaagccaagtcttatcgggatgccctttacaagttcatggtggatactgccgtgcttttaggagctaacagttccagagcagagcatgacatgaagtcagtgctcagattggaaattaagatagctgagataatgattccacatgaaaaccgaaccagcgaggccatgtacaacaaaatgaacatttctgaactgagtgctatgattccccagttcgactggctgggctacatcaagaaggtcattgacaccagactctacccccatctgaaagacatcagcccctccgagaatgtggtggtccgcgtcccgcagtactttaaagatttgtttaggatattagggtctgagagaaagaagaccattgccaactatttggtgtggagaatggtttattccagaattccaaaccttagcaggcgctttcagtatagatggctggaattctcaagggtaatccaggggaccacaactttgctgcctcaatgggacaaatgtgtaaactttattgaaagtgccctcccttatgttgttggaaagatgtttgtagatgtgtacttccaggaagataagaaggaaatgatggaggaattggttgagggcgttcgctgggcctttattgacatgctagagaaagaaaatgagtggatggatgcaggaacgaaaaggaaagccaaagaaaaggcgagagctgttttggcaaaagttggctatccagagtttataatgaatgatactcatgttaatgaagacctcaaagctatcaagttttcagaagccgactactttggcaacgtcctacaaactcgcaagtatttagcacagtctgatttcttctggctaagaaaagccgttccaaaaacagagtggtttacaaatccgacgactgtcaatgccttctacagtgcatccaccaaccagatccgatttccagcaggagagctccagaagcctttcttttggggaacagaatatcctcgatctctgagttatggtgctataggagtaattgtcggacatgaatttacacatggatttgataataatggtagaaaatatgataaaaatggaaacctggatccttggtggtctactgaatcagaagaaaagtttaaggaaaaaacaaaatgcatgattaaccagtatagcaactattattggaagaaagctggcttaaatgtcaaggggaagaggaccctgggagaaaatattgctgataatggaggcctgcgggaagcttttagggcttacaggaaatggataaatgacagaaggcagggacttgaggagcctcttctaccaggcatcacattcaccaacaaccagctcttcttcctgagttatgctcatgtgaggtgcaattcctacagaccagaagctgcccgagaacaagtccaaattggtgctcacagtccccctcagtttagggtcaatggtgcaattagtaactttgaagaattccagaaagcttttaactgtccacccaattccacgatgaacagaggcatggactcctgccgactctggtagctgggacgctggtttatggcatcctgagacagttgcacagtgccagcggaggctgcactgagccttcatcgcccattgctttaggcctggagactttcatttttagtgcattttcattatttgggtaggtgacctgcttggatctagacagcatctgttcaaagttgtagggcttataaagtggaatataagaatgaactaagtatgtttctttagaaaatcaaaccaacaaaaataaatccctaggctacttttgttaaaatgctatctgctaaattgttgctattgtccattttagggtgttggccacagttatgtggtacatagcatttcaatctatagctttgtgggaagcctaaattgatgtatcctttaaaagttcaatctattaaacttgtagcctctcaatgatgaagacatgtgcatgaatacctgggagggcttgctgctctgtggaatgcagtgcacgtttttatggacagtaattacacagcattcctcaactgtaaggtagttaaattagaaatatgtttgatctccattttacactttttgatgaagttcttgccttcagctttggagtctgttggaatgaaactgtgtctcacagcttgcatctgatgtagcagattgccctgttcaagtcagcatgaacaaagctcgcagaaaggctactaggtaacggatttgagtttattcagtagaaaaaaagggaatgaggacatatctttaggtcccagaagcagcaaaacctcctagttacataacagcagggaaactaggagatgaaatctccaaaattttgtccagtctgtatgaactgcagtgattgtctgtctgctagacacttttttttagcctaattcttgttcgtttcattaccttcatatgtgtgcattgtactggttttgaaatgagcagacattgagaaaacaattttctgattccccattaggaacatatgattttcatttccctttagtgcaaaggaacaaacatcacattgaggagggagaagtgtacccttctttttcagcttaatgttacctctctttaaaaaaaaaacatttttgaaaaatttcttgactgatgacattctagaatttattgattcaatttaaaattccctgcatagtccaaataaacataatttttactcttcaagtcatctaaagagttgtgagaaagagcagtactatgtgttttatccttagagcattatccttctaagtgaactcctttcttattactgagcgtgtgtgtgtgtgtgtgtgtgtgtgtgtgtgtaggataaaattgtaatggccttaaagttgttacctggcatttttggtttcttaaaataggcatccccctactccctttacattattcattagacatgaggtgctgggttaagtgggccaataggaaaatctcaaaagcaaaatgacaaattcagattaaccacaggaagccattgtgtgtccctgtgatttgtgattcttttaaaaaaaaaaaaaatatatatatatatatatatatatatatatatgtatatctacctaagtgtgtgccatgtccttttgtagccatgggaacgtttgaatggagaaaaatggaggggcaccatcatgaggaaacaattatactgcattagtcagaggagagcgattttccctttgacttcttcctctctgaatggataaacttgtgaagggcagctaccttgtcctcctcttaacctggcttaatgtgaccttagtttgtatttccaaaaacaagcagtattaggttggaattgtatgtgtcttttctctggaggaagcattctgacttggtttagacatataagatactctgttttattcctggacttgggtgtttaaaatcagctgaggtttatcatgcttatatgaatagtgtttcccttctagatttcctttataaactccaaataaacacattcctgcaggtcagagaaagtgtttgataaaagcatagaattatggctttggaaagacaaactaagtcacttgttggtttagcaaaactggttggtgattagttggggccctcacagtttctagatgagaagcttaccttatcctgattaactttacttgctgtaactgttataccgaaaattgtaggtaggatgtccattactcaaacaaagcagaacaaaacaacaaaccaaaagcagcaataccaaatcatcactactagctagaacaatgagaaggattgaatttccaaatacatgcttatgtttaactcaactcttccaattacattctcattgtcctttctcttggataccgattgctaagataaacagacactgattaagtggtagaaagagaaaggtaaaatgcaactggaagggaaagaaaaaagtagggagaagctggcctatggatgtggctttgaagagaagacaggattttggcattccttgctaagcacgttcaatggaggagagccatgaagttttacaaaaataattatggtaaattaaaaggatattagatattggatctcagactagggctgctataatacagttctctgattcgcacaccagatgttctgccagcgaactgttgtctgggcattggaaggagttaggttttttgtgtttgtgaaaatctcctggattagtaaaaaaattttctagatataaagtggttttatttgggctcatgaccattgcccaaagtgtactgagcttttcactaagtgctcagcattggcctcctgttctcatttattcattttatgagatggacttggacatcactaatgcaaacacaggattcataaattattctgaagtttatttagtgccttgcctcaatggagcttaaagcatagcacataaattttatcttatttagccctggagcatcactaagaagcagctaggaactatggcttgccagacagattatgcttgtgccagagaagtggagaagcctgaaatcccttgtcaagtattccacaggaaggaaaggtagtctttgggctttggtctactgacctgtggattaaactctatcccttagattatcccatttctaaatacatttattcaatcagtatttctataatcacttagcatttgataggcttcttccttgatacatttaacataacgcctcagttgcatattacattatggaagaatatacgattgcttcatataacaacattctcatcaccagtgacagtgtcctactggtttgaagaaagatattcttggattatgtgttttatatctaaatggttattctgagactggttgtattttcttctcctactcgtgaaacgatgtgaacaagcattttaaggacaataaaaagttagctggttgaa

SEQ ID NO: 22118 - DNA, 1788 bp, Homo sapiens
accatatggtgttttaggtaggatagggatgctctgaagaatggaggcatgttactttctgtgtttttatttgtttttttttgagacacagtcttgctgtgtcatccaggctggggtgcagtggtgtgatcttggctcattgcaacctctgcctcccgggttcaagtgattctcctgccttagcctctcgagtagctgggattacaggtgccggccaccacacctagctaatttttgtatttttgatagagatgggattggccaggctggtctcaaactcctgacctcaaatgatccacctgcctcggcctcccaaagtgctgggattacagttcgactggctgggctacatcaagaaggtcattgacaccagactctacccccatctgaaagacatcagcccctccgagaatgtggtggtccgcgtcccgcagtactttaaagatttgtttaggatattagggtctgagagaaagaagaccattgccaactatttggtgtggagaatggtttattccagaattccaaaccttagcaggcgctttcagtatagatggctggaattctcaagggtaatccaggggaccacaactttgctgcctcaatgggacaaatgtgtaaactttattgaaagtgccctcccttatgttgttggaaagatgtttgtagatgtgtacttccaggaagataagaaggaaatgatggaggaattggttgagggcgttcgctgggcctttattgacatgctagagaaagaaaatgagtggatggatgcaggaacgaaaaggaaagccaaagaaaaggcgagagctgttttggcaaaagttggctatccagagtttataatgaatgatactcatgttaatgaagacctcaaagctatcaagttttcagaagccgactactttggcaacgtcctacaaactcgcaagtatttagcacagtctgatttcttctggctaagaaaagccgttccaaaaacagagtggtttacaaatccgacgactgtcaatgccttctacagtgcatccaccaaccagatccgatttccagcaggagagctccagaagcctttcttttggggaacagaatatcctcgatctctgagttatggtgctataggagtaattgtcggacatgaatttacacatggatttgataataatggtagaaaatatgataaaaatggaaacctggatccttggtggtctactgaatcagaagaaaagtttaaggaaaaaacaaaatgcatgattaaccagtatagcaactattattggaagaaagctggcttaaatgtcaaggggaagaggaccctgggagaaaatattgctgataatggaggcctgcgggaagcttttagggcttacaggaaatggataaatgacagaaggcagggacttgaggagcctcttctaccaggcatcacattcaccaacaaccagctcttcttcctgagttatgctcatgtgaggtgcaattcctacagaccagaagctgcccgagaacaagtccaaattggtgctcacagtccccctcagtttagggtcaatggtgcaattagtaactttgaagaattccagaaagcttttaactgtccacccaattccacgatgaacagaggcatggactcctgccgactctggtagctgggacgctggtttatggcatcctgagacagttgcacagtgccagcggaggctgcactgagccttcatcgcccattgctttaggcctggagactttcatttttagtgcattttcattatttgggtaggtgacctgctt

SEQ ID NO: 22119 - DNA, 2891 bp, Homo sapiens
atatttgagcatgtatcggaatcacctggggggcttgttaaaccgcagatggctgggccccacccccagggtttctgagtcaagatcttggagtggctttctaacaagcttccaggtgcagcagcagcagctgctgctgctctagagaccacactcttaggagctctggtctagttatactcacttatcttacgtacgagagaactgagtttcaaagcaaccaagagtcttaccaaggttatttagctagcagctagagtctggtttcgtgacattgaaccaactgggttttggaataccgtgtcaacactgagaaggatgaactgatatcaaatatcttgcgtatgtttccgagggtggtttaccggatggtggtctgctacaactcagccatttattgtggtctgttttttcagtgagtcaaggtctcttaagtctccaagctaaacaggagtactgcctgaagccagaatgcatcgaagcggctgctgccatcttaagtaaagtaaatctgtctgtggatccttgtgataatttcttccggttcgcttgtgatggctggataagcaataatccaattcccgaagatatgccaagctatggggtttatccttggctgagacataatgttgacctcaagttgaaggaacttttggagaaatcaatcagtagaaggcgggacaccgaagccatacagaaagccaaaatcctttattcatcctgcatgaatgagaaagcgattgaaaaagcagatgccaagccactgctacacatcctacggcattcacctttccgctggcccgtgcttgaatctaatattggccctgaaggggtttggtcagagagaaagttcagccttctgcagacacttgcaacgtttcgtggtcaatacagcaattctgtgttcatccgtttgtatgtgtcccctgatgacaaagcatccaatgaacatatcttgaagctggaccaagcaacactctccctggccgtgagggaagactaccttgataacagtacagaagccaagtcttatcgggatgccctttacaagttcatggtggatactgccgtgcttttaggagctaacagttccagagcagagcatgacatgaagtcagtgctcagattggaaattaagatagctgagataatgattccacatgaaaaccgaaccagcgaggccatgtacaacaaaatgaacatttctgaactgagtgctatgattccccagttcgactggctgggctacatcaagaaggtcattgacaccagactctacccccatctgaaagacatcagcccctccgagaatgtggtggtccgcgtcccgcagtactttaaagatttgtttaggatattagggtctgagagaaagaagaccattgccaactatttggtgtggagaatggtttattccagaattccaaaccttagcaggcgctttcagtatagatggctggaattctcaagggtaatccaggggaccacaactttgctgcctcaatgggacaaatgtgtaaactttattgaaagtgccctcccttatgttgttggaaagatgtttgtagatgtgtacttccaggaagataagaaggaaatgatggaggaattggttgagggcgttcgctgggcctttattgacatgctagagaaagaaaatgagtggatggatgcaggaacgaaaaggaaagccaaagaaaaggcgagagctgttttggcaaaagttggctatccagagtttataatgaatgatactcatgttaatgaagacctcaaagctatcaagttttcagaagccgactactttggcaacgtcctacaaactcgcaagtatttagcacagtctgatttcttctggctaagaaaagccgttccaaaaacagagtggtttacaaatccgacgactgtcaatgccttctacagtgcatccaccaaccagatccgatttccagcaggagagctccagaagcctttcttttggggaacagaatatcctcgatctctgagttatggtgctataggagtaattgtcggacatgaatttacacatggatttgataataatggtagaaaatatgataaaaatggaaacctggatccttggtggtctactgaatcagaagaaaagtttaaggaaaaaacaaaatgcatgattaaccagtatagcaactattattggaagaaagctggcttaaatgtcaaggggaagaggaccctgggagaaaatattgctgataatggaggcctgcgggaagcttttagggcttacaggaaatggataaatgacagaaggcagggacttgaggagcctcttctaccaggcatcacattcaccaacaaccagctcttcttcctgagttatgctcatgtgaggtgcaattcctacagaccagaagctgcccgagaacaagtccaaattggtgctcacagtccccctcagtttagggtcaatggtgcaattagtaactttgaagaattccagaaagcttttaactgtccacccaattccacgatgaacagaggcatggactcctgccgactctggtagctgggacgctggtttatggcatcctgagacagttgcacagtgccagcggaggctgcactgagccttcatcgcccattgctttaggcctggagactttcatttttagtgcattttcattatttgggtaggtgacctgcttggatctagacagcatctgttcaaagttgtagggcttataaagtggaatataagaatgaactaagtatgtttctttagaaaatcaaaccaacaaaaataaatccctaggctacttttgttaaaatgctatctgctaaattgttgctattgtccattttagggtgttggccacagttatgtggtacatagcatttcaatctatagc

SEQ ID NO: 22120 - DNA, 2511 bp, Homo sapiens
attagtagaagagcaagaaagccttggatgtcaacgcctcgctcttgagaccagccaccaaaccacgaaaagtgactttcttctcgtgtgctctctacggcccttctgatggaagcagaaacagggagcagcgtggagactggaaagaaggccaacagaggcactcgaattgccctggtcgtgtttgtcggtggcaccctagttctgggcacgatcctctttctagtgagtcaaggtctcttaagtctccaagctaaacaggagtactgcctgaagccagaatgcatcgaagcggctgctgccatcttaagtaaagtaaatctgtctgtggatccttgtgataatttcttccggttcgcttgtgatggctggataagcaataatccaattcccgaagatatgccaagctatggggtttatccttggctgagacataatgttgacctcaagttgaaggaacttttggagaaatcaatcagtagaaggcgggacaccgaagccatacagaaagccaaaatcctttattcatcctgcatgaatgagaaagcgattgaaaaagcagatgccaagccactgctacacatcctacggcattcacctttccgctggcccgtgcttgaatctaatattggccctgaaggggtttggtcagagagaaagttcagccttctgcagacacttgcaacgtttcgtggtcaatacagcaattctgtgttcatccgtttgtatgtgtcccctgatgacaaagcatccaatgaacatatcttgaagctggaccaagcaacactctccctggccgtgagggaagactaccttgataacagtacagaagccaagtcttatcgggatgccctttacaagttcatggtggatactgccgtgcttttaggagctaacagttccagagcagagcatgacatgaagtcagtgctcagattggaaattaagatagctgagataatgattccacatgaaaaccgaaccagcgaggccatgtacaacaaaatgaacatttctgaactgagtgctatgattccccagttcgactggctgggctacatcaagaaggtcattgacaccagactctacccccatctgaaagacatcagcccctccgagaatgtggtggtccgcgtcccgcagtactttaaagatttgtttaggatattagggtctgagagaaagaagaccattgccaactatttggtgtggagaatggtttattccagaattccaaaccttagcaggcgctttcagtatagatggctggaattctcaagggtaatccaggggaccacaactttgctgcctcaatgggacaaatgtgtaaactttattgaaagtgccctcccttatgttgttggaaagatgtttgtagatgtgtacttccaggaagataagaaggaaatgatggaggaattggttgagggcgttcgctgggcctttattgacatgctagagaaagaaaatgagtggatggatgcaggaacgaaaaggaaagccaaagaaaaggcgagagctgttttggcaaaagttggctatccagagtttataatgaatgatactcatgttaatgaagacctcaaagctatcaagttttcagaagccgactactttggcaacgtcctacaaactcgcaagtatttagcacagtctgatttcttctggctaagaaaagccgttccaaaaacagagtggtttacaaatccgacgactgtcaatgccttctacagtgcatccaccaaccagatccgatttccagcaggagagctccagaagcctttcttttggggaacagaatatcctcgatctctgagttatggtgctataggagtaattgtcggacatgaatttacacatggatttgataataatggtagaaaatatgataaaaatggaaacctggatccttggtggtctactgaatcagaagaaaagtttaaggaaaaaacaaaatgcatgattaaccagtatagcaactattattggaagaaagctggcttaaatgtcaaggggaagaggaccctgggagaaaatattgctgataatggaggcctgcgggaagcttttagggcttacaggaaatggataaatgacagaaggcagggacttgaggagcctcttctaccaggcatcacattcaccaacaaccagctcttcttcctgagttatgctcatggtcaatggtgcaattagtaactttgaagaattccagaaagcttttaactgtccacccaattccacgatgaacagaggcatggactcctgccgactctggtagctgggacgctggtttatggcatcctgagacagttgcacagtgccagcggaggctgcactgagccttcatcgcccattgctttaggcctggagactttcatttttagtgcattttcattatttgggtaggtgacctgcttggatctagacagcatctgttcaaagttgtagggcttataaagtggaatataagaatgaactaagtatgtttctttagaaaatcaaaccaac

SEQ ID NO: 22121 - DNA, 2959 bp, Homo sapiens
cggaagcggaagaggctgcagggccgggaagcctctgtttggtccggccaggtcccgggatccgggccgccagctgcgatgccaagtccccggaggagcatggagggacggccgctgggcgtctccgcttcgagcagcagcagcagccccggcagcccagcccatggcggcggtggcggcggcagcaggtttgagttccagtccctgctcagcagccgcgccacggccgtggaccccacctgcgcccggctccgtgcatcggagagcccagttcaccgccgcggctccttccccctggccgcggcgggcccctcgcagtcgcccgcgcctccgctgcccgaggaggaccgcatggacttgaacccgtccttcctgggcatcgccctgcgctccctgctggccatcgacctgtggctgtccaagaagctgggggtgtgcgcgggagagagctcgtcgtggggcagcgtgcgaccccttatgaagctgctggagatctcgggacacggcatcccctggctgctgggcaccctctactgcctgtgcaggagcgacagctgggccgggcgcgaggtgctgatgaacctgctcttcgccctgctgttggacctgctgctggtggccttgatcaaagggctggtccgcaggcgccgcccggcccacaaccagatggacatgtttgtcactctctcggtggacaagtactccttcccctcgggccatgccacaagggccgccctgatgtcgaggttcatcctgaaccacctggtgctggccattccactgagggtgctggtggttctgtgggccttcgtcttgggcctatccagggtcatgctggggcggcacaatgtcaccgacgtagcttttggcttttttctgggctacatgcagtacagcatcgtggactattgctggctctcaccccataatgctccggtcctctttttactgtggagtcaacgatgacaccatctcattgattatggcaccaggaagtctgaaggtttccacattcgatgatgtcaacctaaaccagcagccatcccgcttgtccctcttaggcatttcaggcttcctttgggatttcaggtgtcccatgatcttgatgtgctgctaggctggagcacacactggccattactgaacacagccatattagggaaagcaaaaaaacccaaaaaatcctctattgtatatttattcaacaactgtttatgtttccaggacaactgcaaagaaaacaagctgaggtggttatactgttgctgttaaaagttggtatcagtaagatttgtgttttgtgataatccctaaatcaacataccacttgtaaactgaacttcgagaaagaaacatgatgttcattctgtaaatatacatgcagacaggtcatgtactaatcctagtccttttcctgaggtagattttaaacagtatttttaaagtccaagacataggtttttctagtttattccctgaagatctgttgccacagttgggagatttcttcttaatcctgattttcttggtaagcttttttactttattatctctataatttattatctctatccatatttgtggatcgggtagtgggaaaagagattataatacttgtctttctctcctctccctccatccctcaaaagatctttatgcatttcccactactcccttactgtcttttagcattcagagaaaaagccaacttgcttaaagaggaatcacttaaaaggtaggcatatctaagatgctcatagaagaggaagaatgggacatggccccatgcttatttttgtttacaacgtaacatggcatgagagagggcagagaaactaagttgctggggaaagttagaggaactgaaagtttgggaataggctgaccacatattatgccagtgaccagtatgacaggagatggggccctgctgccagtcatctccactgaataaagaataatgctcctctttcagggtaataaagtggggaaaaggaacgtcttctcaatgcaagaacataagctttctcgtatatacctgtatgctacagtttttcacatggaattccgttttctgaggtacagcacattttaggtaacagtatttaacttgaaattcatcatgggagtctgctgctataccaggcacaagataaaactccaaaatttctgtttacattgacctttacatttaaagctgttcatccatggtgcctccccaaatcataagaccaaagaccaccaaacgcagggtggactctgctcattattctttgacccagaaagactggagaaggtatgtgctttaagtgctgctctacctgaaaagaaatcctttaaattacctatggaagtgatgtcctcagataatcttaatgactattttggcatttataaatagaaatgattatggactttgatctgccatacggaggttcggaacctggagaacggctgtgataagtaggttttgattgagtgaaagcatgagcttgttcagagtgaggggcatagtgaaaaaggaacagccatgcctcaaaatcaaatcatttgcattcccacagcatcctgaataccgactacctcttcacttgctaaagcagctaaactgtgaagctctaagtggtttgggtttgttgtttaaccttagcgagatcctttaactgcagcaatattcaagccagatatttggaagcaaatgatatttcctcttgcagtgtccacaaatctgaatattaggggcatgaaattaggcttaccatctgatttgtaattacaattttggaattctctgttttagttgctgaggcctgagttttctggctcttaaagcatagatcatttcacctgatgtttttgaagcatcctaagtacagtagagtagaaaactgatttctttgttaattgtacactgaataatgccttttaaaaatcaaaataaaattaacaaataatggtg

SEQ ID NO: 22122 - DNA, 1082 bp, Homo sapiens
agcggaagaggctgcagggccgggaagcctctgtttggtccggccaggtcccgggatccgggccgccagctgcgatgccaagtccccgcttcgagcagcagcagcagccccggcagcccagcccatggcggcggtggcggcggcagcaggtttgagttccagtccctgctcagcagccgcgccacggccgtggaccccacctgcgcccggctccgtgcatcggagagcccagttcaccgccgcggctccttccccctggccgcggcgggcccctcgcagtcgcccgcgcctccgctgcccgaggaggaccgcatggacttgaacccgtccttcctgggcatcgccctgcgctccctgctggccatcgacctgtggctgtccaagaagctgggggtgtgcgcgggagagagctcgtcgtggggcagcgtgcgaccccttatgaagctgctggagatctcgggacacggcatcccctggctgctgggcaccctctactgcctgtgcaggagcgacagctgggccgggcgcgaggtgctgatgaacctgctcttcgccctgctgttggacctgctgctggtggccttgatcaaagggctggtccgcaggcgccgcccggcccacaaccagatggacatgtttgtcactctctcggtggacaagtactccttcccctcgggccatgccacaagggccgccctgatgtcgaggttcatcctgaaccacctggtgctggccattccactgagggtgctggtggttctgtgggccttcgtcttgggcctatccagggtcatgctggggcggcacaatgtcaccgacgtagcttttggcttttttctgggctacatgcagtacagcatcgtggactattgctggctctcaccccataatgctccggtcctctttttactgtggagtcaacgatgacaccatctcattgattatggcaccaggaagtctgaaggtttccacattcgatgatgtcaacctaaaccagcagccatcccgcttgtccctcttaggcatttcaggcttcctttgggatttcaggtgtcccatgatcttgatgtgctgctaggctg

SEQ ID NO: 22123 - DNA, 2041 bp, Homo sapiens
cgctggggcagccggggcagccggggcagcccggtcaccccgcccccaggcccacactaagggtgtccgcggcctgccctccaggcggaggagcccggactgcggaaggatggagctggccgccggaagcttctcggaggagcagttctgggaggcctgcgccgagctccagcagcccgctctggccggggccgactggcagctcctagtggagacctcgggcatcagcatctaccggctgctggacaagaagactggactttatgagtataaagtctttggtgttctggaggactgctcaccaactctactggcagacatctatatggactcagattacagaaaacaatgggaccagtatgttaaagaactctatgaacaagaatgcaacggagagactgtggtctactgggaagtgaagtacccttttcccatgtccaacagagactatgtctaccttcggcagcggcgagacctggacatggaagggaggaagatccatgtgatcctggcccggagcacctccatgcctcagcttggcgagaggtctggggtgatccgggtgaagcaatacaagcagagcctggcgatcgagagtgacggcaagaaggggagcaaagttttcatgtattacttcgataacccgggtggccaaattccgtcctggctcattaactgggccgccaagaatggagttcctaacttcttgaaagacatggcaagagcctgtcagaactacctcaagaaaacctaagaaagagaactgggaacattgcatccatgggttgatgtctctggaagtgcaaccacccaatgtctctggaagtgccacctggaagtgccacctggaagtgtctctggaagagcacccaccactgttcagccttcccctgctgtttctgtcttcagaggcctacacactaccacatcctttctaagcatgtttgcctgacatccagctcactcgtctgcttcctttctcgctccccccatcctgggctgggctgccttcttctacagttcaatatggggcagactagggaaacctttgcttgcttactattaggaggggaagtcttcagtagggaacacgatcattccattgtgcaattttacggggatgggtgggcggagggacacaacaaaatttaagaatgactatttgggcgggctggctcttttgcagcttgtgatttcttccagcttgggaggggctgctggaagtggcatttcgttcagagctgactttcagtgcacccaaactggatgacgtgccaatgtccatttgccttatgctttgtggagctgattaggctgggatttgaggtgataatccagtaagtctttcctcgttcctacttgtggaggatcagtagctgttatgatgccagaccatttggagaagtatcagaggcctgaccggacacataatatgacaaccacatttttcctcatcatccatgaggaaatggatgatttctcttttccatatgtcactgggggaaaggctgcctgtacctctcaagctttgcattttactggaaactgaggcgtcaagatggctgtggcagctagcaaaagcaaagatgctttgtgcatagccttgtgaaaaagtatctttctatgcaataagatgaattttcctcccagaatatttagaaatgtagaagggataacagttcacagccaggtaaaatttaactggtggcttaatgactctgcacctttttctcaggaattctgcctaagttgtctgccttttctaccaccaaaaagacttttagttttctatgctttctcctgaattttggtagggtaaggtatttctatgtcaaaggcacagccttgatgatctcagggaaaaattttaatcactgtgtataatgatactgaaccttgattaataacagaaattcaggatgtaaagccacagaatgggatttattaatgtgggatacctcagactgtttgttttctttctgggaagaaaagtgtgttctataatgaataaatatagagtggtttttacttgtcctgtgta

SEQ ID NO: 22124 - DNA, 1869 bp, Homo sapiens
ctagcgcaggggcggtgcctccaagtgactgccgtgcagatccaggggagttggaaggtcacaggagttcagcctcagaagactggactttatgagtataaagtctttggtgttctggaggactgctcaccaactctactggcagacatctatatggactcagattacagaaaacaatgggaccagtatgttaaagaactctatgaacaagaatgcaacggagagactgtggtctactgggaagtgaagtacccttttcccatgtccaacagagactatgtctaccttcggcagcggcgagacctggacatggaagggaggaagatccatgtgatcctggcccggagcacctccatgcctcagcttggcgagaggtctggggtgatccgggtgaagcaatacaagcagagcctggcgatcgagagtgacggcaagaaggggagcaaagttttcatgtattacttcgataacccgggtggccaaattccgtcctggctcattaactgggccgccaagaatggagttcctaacttcttgaaagacatggcaagagcctgtcagaactacctcaagaaaacctaagaaagagaactgggaacattgcatccatgggttgatgtctctggaagtgcaaccacccaatgtctctggaagtgccacctggaagtgccacctggaagtgtctctggaagagcacccaccactgttcagccttcccctgctgtttctgtcttcagaggcctacacactaccacatcctttctaagcatgtttgcctgacatccagctcactcgtctgcttcctttctcgctccccccatcctgggctgggctgccttcttctacagttcaatatggggcagactagggaaacctttgcttgcttactattaggaggggaagtcttcagtagggaacacgatcattccattgtgcaattttacggggatgggtgggcggagggacacaacaaaatttaagaatgactatttgggcgggctggctcttttgcagcttgtgatttcttccagcttgggaggggctgctggaagtggcatttcgttcagagctgactttcagtgcacccaaactggatgacgtgccaatgtccatttgccttatgctttgtggagctgattaggctgggatttgaggtgataatccagtaagtctttcctcgttcctacttgtggaggatcagtagctgttatgatgccagaccatttggagaagtatcagaggcctgaccggacacataatatgacaaccacatttttcctcatcatccatgaggaaatggatgatttctcttttccatatgtcactgggggaaaggctgcctgtacctctcaagctttgcattttactggaaactgaggcgtcaagatggctgtggcagctagcaaaagcaaagatgctttgtgcatagccttgtgaaaaagtatctttctatgcaataagatgaattttcctcccagaatatttagaaatgtagaagggataacagttcacagccaggtaaaatttaactggtggcttaatgactctgcacctttttctcaggaattctgcctaagttgtctgccttttctaccaccaaaaagacttttagttttctatgctttctcctgaattttggtagggtaaggtatttctatgtcaaaggcacagccttgatgatctcagggaaaaattttaatcactgtgtataatgatactgaaccttgattaataacagaaattcaggatgtaaagccacagaatgggatttattaatgtgggatacctcagactgtttgttttctttctgggaagaaaagtgtgttctataatgaataaatatagagtggtttttacttgtcctgtgta

SEQ ID NO: 22125 - DNA, 2273 bp, Homo sapiens
cgctggggcagccggggcagccggggcagcccggtcaccccgcccccaggcccacactaagggtgtccgcggcctgccctccaggcggaggagcccggactgcggaaggatggagctggccgccggaagcttctcggaggagcagttctgggaggcctgcgccgagctccagcagcccgctctggccggggccgactggcagctcctagtggagacctcgggcatcagcatctaccggctgctggacaaggtagcggccaacccgctggaggaccgcggggcctagaatgcgccggggtcgacctccccgcagggagtgcggggcggcagtcgcggaagggacaggggcgcgtcttctccggctcaggaaggagctccgcccggaccctgtctcaagctctggagctagcgcaggggcggtgcctccaagtgactgccgtgcagatccaggggagttggaaggtcacaggagttcagcctcagaagactggactttatgagtataaagtctttggtgttctggaggactgctcaccaactctactggcagacatctatatggactcagattacagaaaacaatgggaccagtatgttaaagaactctatgaacaagaatgcaacggagagactgtggtctactgggaagtgaagtacccttttcccatgtccaacagagactatgtctaccttcggcagcggcgagacctggacatggaagggaggaagatccatgtgatcctggcccggagcacctccatgcctcagcttggcgagaggtctggggtgatccgggtgaagcaatacaagcagagcctggcgatcgagagtgacggcaagaaggggagcaaagttttcatgtattacttcgataacccgggtggccaaattccgtcctggctcattaactgggccgccaagaatggagttcctaacttcttgaaagacatggcaagagcctgtcagaactacctcaagaaaacctaagaaagagaactgggaacattgcatccatgggttgatgtctctggaagtgcaaccacccaatgtctctggaagtgccacctggaagtgccacctggaagtgtctctggaagagcacccaccactgttcagccttcccctgctgtttctgtcttcagaggcctacacactaccacatcctttctaagcatgtttgcctgacatccagctcactcgtctgcttcctttctcgctccccccatcctgggctgggctgccttcttctacagttcaatatggggcagactagggaaacctttgcttgcttactattaggaggggaagtcttcagtagggaacacgatcattccattgtgcaattttacggggatgggtgggcggagggacacaacaaaatttaagaatgactatttgggcgggctggctcttttgcagcttgtgatttcttccagcttgggaggggctgctggaagtggcatttcgttcagagctgactttcagtgcacccaaactggatgacgtgccaatgtccatttgccttatgctttgtggagctgattaggctgggatttgaggtgataatccagtaagtctttcctcgttcctacttgtggaggatcagtagctgttatgatgccagaccatttggagaagtatcagaggcctgaccggacacataatatgacaaccacatttttcctcatcatccatgaggaaatggatgatttctcttttccatatgtcactgggggaaaggctgcctgtacctctcaagctttgcattttactggaaactgaggcgtcaagatggctgtggcagctagcaaaagcaaagatgctttgtgcatagccttgtgaaaaagtatctttctatgcaataagatgaattttcctcccagaatatttagaaatgtagaagggataacagttcacagccaggtaaaatttaactggtggcttaatgactctgcacctttttctcaggaattctgcctaagttgtctgccttttctaccaccaaaaagacttttagttttctatgctttctcctgaattttggtagggtaaggtatttctatgtcaaaggcacagccttgatgatctcagggaaaaattttaatcactgtgtataatgatactgaaccttgattaataacagaaattcaggatgtaaagccacagaatgggatttattaatgtgggatacctcagactgtttgttttctttctgggaagaaaagtgtgttctataatgaataaatatagagtggtttttacttgtcctgtgt

SEQ ID NO: 22126 - DNA, 1697 bp, Homo sapiens
tctctcttcggcgaacctattccagggcgcccttcattttcatttcttgaaacaacagccttgcaggccgagccgctgttcccgagaactcggcagccacagggagcaggttgcatggacccaggagcgcgagaggccctgctctgccagcttcggccaatcagaggccagggagcggtgggcgtgacgtggggcggtgcgcggggctgggcggcggctgaggcgcgtgctctcgcgtggtcgctgggtctgcgtcttcccgagccagtgtgctgagctctccgcgtcgcctctgtcgcccgcgcctggcctaccgcggcactcccggctgcacgctctgcttggcctcgccatgccggtggacctcagcaagtggtccgggcccttgagcctgcaagaagtggacgagcagccgcagcacccgctgcatgtcacctacgccggggcggcggtggacgagctgggcaaagtgctgacgcccacccaggttaagaatagacccaccagcatttcgtgggatggtcttgattcagggaagctctacaccttggtcctgacagacccggatgctcccagcaggaaggatcccaaatacagagaatggcatcatttcctggtggtcaacatgaagggcaatgacatcagcagtggcacagtcctctccgattatgtgggctcggggcctcccaagggcacaggcctccaccgctatgtctggctggtttacgagcaggacaggccgctaaagtgtgacgagcccatcctcagcaaccgatctggagaccaccgtggcaaattcaaggtggcgtccttccgtaaaaagtatgagctcagggccccggtggctggcacgtgttaccaggccgagtgggatgactatgtgcccaaactgtacgagcagctgtctgggaagtagggggttagcttggggacctgaactgtcctggaggccccaagccatgttccccagttcagtgttgcatgtataatagatttctcctcttcctgccccccttggcatgggtgagacctgaccagtcagatggtagttgagggtgacttttcctgctgcctggcctttataattttactcactcactctgatttatgttttgatcaaatttgaacttcattttggggggtattttggtactgtgatggggtcatcaaattattaatctgaaaatagcaacccagaatgtaaaaaagaaaaaactggggggaaaaagaccaggtctacagtgatagagcaaagcatcaaagaatctttaagggaggtttaaaaaaaaaaaaaaaaaaaaagattggttgcctctgcctttgtgatcctgagtccagaatggtacacaatgtgattttatggtgatgtcactcacctagacaaccagaggctggcattgaggctaacctccaacacagtgcatctcagatgcctcagtaggcatcagtatgtcactctggtccctttaaagagcaatcctggaagaagcaggagggagggtggctttgctgttgttgggacatggcaatctagaccggtagcagcgctcgctgacagcttgggaggaaacctgagatctgtgttttttaaattgatcgttcttcatgggggtaagaaaagctggtctggagttgctgaatgttgcattaattgtgctgtttgcttgtagttgaataaaaatagaaacctgaatgaa

SEQ ID NO: 22127 - DNA, 1122 bp, Homo sapiens
gtgtgctgagctctccgcgtcgcctctgtcgcccgcgcctggcctaccgcggcactcccggctgcacgctctgcttggcctcgccatgccggtggacctcagcaagtggtccgggcccttgagcctgcaagaagtggacgagcagccgcagcacccgctgcatgtcacctacgccggggcggcggtggacgagctgggcaaagtgctgacgcccacccaggttaagaatagacccaccagcatttcgtgggatggtcttgattcagggaagctctacaccttggtcctgacagacccggatgctcccagcaggaaggatcccaaatacagagaatggcatcatttcctggtggtcaacatgaagggcaatgacatcagcagtggcacagtcctctccgattatgtgggctcggggcctcccaagggcacaggcctccaccgctatgtctggctggtttacgagcaggacaggccgctaaagtgtgacttttcctgctgcctggcctttataattttactcactcactctgatttatgttttgatcaaatttgaacttcattttggggggtattttggtactgtgatggggtcatcaaattattaatctgaaaatagcaacccagaatgtaaaaaagaaaaaactggggggaaaaagaccaggtctacagtgatagagcaaagcatcaaagaatctttaagggaggtttaaaaaaaaaaaaaaaaaaaaagattggttgcctctgcctttgtgatcctgagtccagaatggtacacaatgtgattttatggtgatgtcactcacctagacaaccagaggctggcattgaggctaacctccaacacagtgcatctcagatgcctcagtaggcatcagtatgtcactctggtccctttaaagagcaatcctggaagaagcaggagggagggtggctttgctgttgttgggacatggcaatctagaccggtagcagcgctcgctgacagcttgggaggaaacctgagatctgtgttttttaaattgatcgttcttcatgggggtaagaaaagctggtctggagttgctgaatgttgcattaattgtgctgtttgcttgtagttgaataaaaatagaaacctgaatg

SEQ ID NO: 22128 - DNA, 6720 bp, Homo sapiens
gggcgctcgcgggccaggagcggggagccggcgggcagcgccgcggctcgtgaggtgatggcggcggccccggcccggggaggcggaggcggaggcggaggcggcggcggctgctccggctccggctccagcgcctcgcggggcttctatttcaacacggtcctgtcactggcccgctccctggcggtgcagagaccagcatccttggagaaggtccaaaagcttctttgcatgtgtccagtggatttccatgggatcttccagttagatgaaagacggagagatgcagtgattgcattgggcatttttctgattgaatctgatcttcagcacaaagattgtgtggttccttaccttcttcgacttctcaaaggtcttccaaaagtgtattgggtagaagaaagcacagctcggaaaggcagaggtgccctcccggttgcagagagcttcagcttctgcttggtaactctgctgtctgatgtggcctatagggatccttcacttagggatgagattttagaggtgcttttgcaggttttgcatgtcctcttggggatgtgccaggccttggagattcaagacaaagaatacctttgcaagtatgctatcccatgcctgataggaatctcgcgagcatttgggcgttacagcaacatggaagagtctctcctctcaaagctctttcccaaaatccctcctcattccctccgtgtcctggaagagcttgaaggtgttcgaaggcgttcctttaatgacttccgctccatcctccccagcaatctgctgactgtctgtcaggagggtaccctgaagaggaaaaccagcagtgtgtccagcatctctcaggtcagccctgaacgcggcatgccccctcccagttcccctggaggatctgcctttcactactttgaagcctcctgcttgcccgatgggactgccctagagcctgagtactacttttcaaccatcagctccagcttctcagtctctccccttttcaacggtgtcacatataaggagtttaacattccattggaaatgcttcgggaactcttaaacctggtgaagaagatcgttgaggaggctgttctcaaatctttggatgccattgtagccagtgtgatggaggccaaccccagtgctgatctctactacacttccttcagtgaccctctctacctgaccatgttcaagatgctgcgtgacactctgtactacatgaaggacctcccgacctcttttgtgaaggagatccatgattttgtgctggagcagttcaacacgagccagggggagctccagaagattctacatgacgcagaccggatccacaatgagctgagccccctcaaactgcgctgtcaggcgaatgctgcctgtgtggacctcatggtgtgggctgtgaaggacgagcagggtgcagaaaacctttgcatcaagctatctgagaagctgcagtccaagacgtccagcaaagtcattattgctcacttgcccctgctgatctgctgtctgcagggtttgggccgcctgtgcgagaggttcccggtggtggtgcactctgtgacaccgtccttgcgagacttcctggtcatcccgtccccagttctggtgaagctctacaagtaccacagtcagtaccacacagttgctggcaatgatataaaaatcagtgtgaccaatgagcattccgagtcaaccctgaacgtcatgtcgggtaagaagagccagccctccatgtacgagcagctccgagacatcgctattgacaacatctgcaggtgcctgaaggctggattgacggtggacccagtgattgtggaggcgttcttggccagcctgtccaaccggctctacatctctcaggagagcgacaaggacgctcacttgattcccgaccacacaatccgagccttgggacacattgcggtggccttgagggacaccccgaaggtcatggagcccattctgcagatcctacagcagaaattctgccagccaccctcccccctcgatgtgctgattattgaccagctgggctgcctggttatcaccggaaatcaatacatctatcaggaagtgtggaacctcttccagcagatcagtgtgaaggccagctccgttgtatactcagccaccaaagattacaaggaccacggctataggcattgctccctggcagtgattaatgccctggccaacatcgcggccaacatccaagacgagcacctggtggatgagctgctcatgaacctgttggagttgtttgtgcagctggggctggaggggaagcgagccagcgagagggcaagcgagaagggccctgccctaaaggcttctagcagtgcagggaacttgggagtactcattcctgtaatagctgtgctcacccgacgactgccacccatcaaagaagctaagcctcggttacagaagctcttccgagacttctggctgtattccgttctgatgggattcgctgtggagggctcaggactctggccagaagaatggtacgagggggtctgtgaaatagccactaagtcccccttgctcacctttcccagcaaggagccactgcggtccgtcctccagtataactcagccatgaagaatgacacggtcacccccgctgagctgagtgagctccgcagcactatcatcaacctgctggacccccctcccgaggtgtccgcactcatcaacaagctggacttcgccatgtccacctacctcctctctgtgtaccggctggagtacatgagggtactgcgttcaacagatcctgatcgcttccaggtaatgttctgctactttgaggataaagctattcagaaagacaaatctgggatgatgcagtgtgtgattgcagtcgcggacaaagtattcgatgccttcctgaacatgatggcggataaagccaagaccaaggagaacgaggaggagctggagcggcacgctcagttcctgttggtgaacttcaaccacatccacaagaggataaggagggtggcagacaagtatctatctggtctggtggataagtttccccacttgctctggagcgggactgtgctgaagaccatgctggacatcctgcagaccctgtcactgtcactgagcgctgatattcacaaggatcagccttactatgacatccccgacgccccctaccggatcacggttcctgacacgtacgaagcccgtgagagcattgtgaaggacttcgctgcacgctgtgggatgatcctccaggaggccatgaagtgggcacctaccgtcaccaagtcccacctgcaggaatatctgaacaaacatcagaactgggtatcgggactgtcccagcacacggggctggccatggccactgagagcatccttcactttgctggctacaacaagcagaacacaactcttggggcaactcagctgagcgagcgcccggcctgtgtgaagaaagactactccaacttcatggcatccctgaatctgcgcaaccgctacgcgggcgaggtgtatggaatgattcggttctcaggcaccacaggccagatgtctgacctgaacaaaatgatggtccaggatctacattcagctttagaccgcagtcatcctcagcactacacgcaggccatgttcaagctgaccgcaatgctcattagcagtaaagattgtgacccgcagctccttcatcatctgtgctggggtcccctccggatgttcaatgagcatggcatggagacggccctggcctgctgggagtggctgctggctggcaaggatggagtggaagtgccgttcatgcgggagatggcaggggcctggcacatgacggtggagcagaaatttggcctgttttctgctgagataaaggaagcagaccccctggctgcctcggaagcaagtcaacccaaaccctgtccccccgaagtgaccccccactacatctggatcgacttcctggtgcagcggtttgagatcgccaagtactgcagctctgaccaagtggagatcttctccagcctgctgcagcgctccatgtccctgaacatcggcggggccaaggggagcatgaaccggcacgtggcggccatcgggccccgcttcaagctgctgaccctggggctgtccctcctgcatgccgatgtggttccaaatgcaaccatccgcaatgtgcttcgcgagaagatctactccactgcctttgactacttcagctgtcccccaaagttccctactcaaggagagaagcggctgcgtgaagacataagcatcatgattaaattttggaccgccatgttctcagataagaagtacctgaccgccagccagcttgttcccccagataatcaggacacccggagcaacctggacataactgtcggctctcggcaacaagccacccaaggctggatcaacacataccccctgtccagcggcatgtccaccatctccaagaaatcaggcatgtctaagaaaaccaaccggggctcccagctgcacaaatactacatgaagcgcaggacgctgctgctgtccctgctggccactgagatcgagcgtctcatcacatggtacaacccgctgtcagccccggaactggaactagaccaggccggagagaacagcgtggccaactggagatctaagtacatcagcctgagtgagaagcagtggaaggacaacgtgaacctcgcctggagcatctctccctacctagccgtgcagctgcctgccaggtttaagaacacagaagccattgggaacgaagtgacccgtctcgttcggttggacccgggagccgttagtgatgtgcctgaagcaatcaagttcctggtcacctggcacaccatcgacgccgatgctccagagctcagccatgtgctgtgctgggcgcccacggacccacccacaggcctctcctacttctccagcatgtacccgccgcaccctctcacggcgcagtacggggtgaaagtcctgcggtccttccctccggacgccatcctcttctacatcccccagattgtgcaggccctcaggtacgacaagatgggctatgtgcgggagtatattctgtgggcagcgtctaaatcccagcttctggcacaccagttcatctggaacatgaagactaacatttatctagatgaagagggccaccagaaagaccctgacatcggcgacctcctggatcagttggtagaggagatcacaggctccttgtccggcccagcgaaggacttttaccagcgggagtttgatttctttaacaagatcaccaacgtgtcggctatcatcaagccctaccctaaaggcgacgagagaaagaaggcttgtctgtcggccctgtctgaagtgaaggtgcagccgggctgctacctgcccagcaaccctgaggccattgtgctggacatcgactacaagtctgggaccccgatgcagagtgctgcaaaagccccatatctggccaagttcaaggtgaagcgatgtggagttagtgaacttgaaaaagaaggtctgcggtgccgctcagactccgaggatgagtgcagcacgcaggaggccgacggccagaagatctcctggcaggcagccatcttcaaggtgggagacgactgccggcaggacatgctggccctgcagatcatcgacctcttcaagaacatcttccagctggtcggcctggacctctttgtttttccctaccgcgtggtggccactgcccctgggtgcggggtgatcgagtgcatccccgactgcacctcccgggaccagctgggccgccagacagacttcggcatgtacgactacttcacacgccagtacggggatgagtccactctggccttccagcaggcccgctacaacttcatccgaagcatggccgcctacagcctcctgctgttcctgctgcagatcaaggacagacacaacggcaacattatgctggacaagaagggtcatatcatccacatcgactttggcttcatgtttgaaagctcgccgggcggcaatctcggctgggaacccgacatcaagctgacggatgagatggtgatgatcatggggggcaagatggaggccacacccttcaagtggttcatggagatgtgtgtccgaggctacctggctgtgcggccctacatggacgcggtcgtctccctggtcactctcatgttggacacgggcctgccctgttttcgcggccagacaatcaagctcttgaagcacaggtttagccccaacatgactgagcgcgaggctgcaaatttcatcatgaaggtcatccagagctgcttcctcagcaacaggagccggacctacgacatgatccagtactatcagaatgacatcccctactgaggaggggaccttcgagggcctctgccccatgtgccctcaaagctgtcccacaatcatggagccctgcgacctccctgccctgccgccacatgcagtggaggagaggcctgtggcccaaagaacctggtagcgcctcctggggcagcacgtgggtggcgcagccttggtaacgccatggactgcagcgacaatcaatggatggtgctgtctatgcacaggtgtgagtcctctgtttgcactggacatattccctacctgtcttatttcataggtacatgaagtattgtgtataaaaaaagagataagatttaaccaacatcaacaaaataaaaacccaaaatagtgctgtgttgg

SEQ ID NO: 22129 - DNA, 4189 bp, Homo sapiens
cggccgcgagcgcagtggtgtggagcgcgccgggtcccggagccggctgtctgagggatggacgagacgagcccactagtgtcccccgagcgggcccaacccccggactacaccttcccgtcgggctcgggcgctcactttccgcaggtgcccgggggcgcggtccgagtggcggcggcggccggctcgggcccctctccgccgggctcgccgggccacgaccgcgagcggcagccactgttggatcgggcccggggcgcggcggcccagggccagacccaaaccgtggcggcgcaggcccaggctctggccgctcaggccgcggcggcagcccacgccgctcaggcccaccgcgagcggaacgagttcccggaggatcctgagttcgaggcggtggtgcggcaggccgagctggccatcgagcgctgcatctttcccgagcgcatctaccagggctccagcggaagctacttcgtcaaggaccctcaggggaggatcattgctgtcttcaaacccaagaatgaagagccctatgggcatcttaatcctaagtggaccaagtggctgcagaagctgtgctgtccttgctgctttggccgtgactgccttgtccttaaccagggctatctctcagaagcaggggccagcctggtggaccaaaaactggaactcaacattgttccccgtacaaaggtagtatacctggccagtgagaccttcaactatagtgccattgaccgagtgaagtccaggggcaagcggcttgcactagagaaagtgccaaaagttggacagcggtttaaccgcatcgggctaccaccaaaggttggttcattccagctctttgttgaaggctacaaagatgcagactattggctgcggcgttttgaagcagaacctcttcctgagaacactaaccggcaactactgctccagtttgagcggttggtggtgctggattacatcatccgcaacactgatcgaggcaatgacaactggctgattaaatatgactgtccaatggatagttctagctctcgggacacagactgggtggtggtgaaggagcctgttatcaaggtggctgccatagacaatgggctggccttcccactgaagcatcctgactcctggagggcatatcctttttactgggcctggttgccccaggcgaaagtcccattttctcaggagatcaaagatctgatccttccaaagatatcggaccctaacttcgtcaaggacttggaagaggacctatatgaactcttcaagaaagatcctggtttcgacaggggccagttccataagcagattgctgtcatgcggggccagatcttaaatctgacccaggccttgaaagacaacaagagtcccctgcacctcgtccagatgccacctgtgattgtcgagacggcccgttcccaccagcggtcttctagcgagtcctacacacagagctttcagagccggaagcccttcttttcatggtggtagctccagaggcaggcagaggaaatattgtcagagactggtgggaggaagcctggggagtggggtgcaggaaaagccagagaagccggtggagagcagcacctttaagagccctctctctctgcttgccaccctgctcagagctttccacccacagggagaagcacaatcaggaacagtgagtgctcctcgcccttctgatgtgggggaggctggagctccatgcacgtagtccagatgcctgggaaggaacatctcccttccagcatctgctggtagcaggctgggacagtcccttccttccctgaaaccctgctctattgcaattccctattatattctgcatcagaaaaacaaacaaaacaaaaacaactttaaatgcttgtagcagaaccccgggtcatctcatgtcagaaacctttaatccaggcctaaatttgcatagacctgacattcagctgccttgcagttgcttcctcccatgagccaaggtggtgtcagagggcaactggatgactcgcagtaccacagcactgggacagacagaagccacacctttcttttgggtttttgccaagcctcctccatctcccatcagtgctgtgggctggctgcaagcctcgaaacagttctcctggaagggaggtttttgctttacccccgccagcacttccgcacacaatcatagagaacctctctgctctctgctggcctacagcttgtctgtttctcaagcagaggcaggaagagctagtcttagcatttatattttaataggaagttgactcccagcatgtaaaagtgatccacgcagccggagtgtatgccgggagctaagtggtctatgggtgaacatatcccaccttgcttcctgagtccttggtcccaatcttctcatttgttcctctcgttttaaattttttccccccaactcttttgatgtaagagttcagtttgtcttcgggagtgggtctctgcaagggctctgggatgagtcttggcttccaagaggacaggctattaggttcttggacttttttctgtgctaccgctgctgcttggtggaagtaacaggacgtggattctgcctcataagtggcagtttcccttttctctctgacttgtcctaggccgatttctctatggcttccctgagaaaggtgaggcccaaaggagagaggccttcaaactgtcccaggtcctgcgcagctcagtgcgtatcttcttgcttccatgtgtcttttcccctgctgcctcactccccacccccacttgccaggtgtttgagccatttctacaccaaagcaaagtacggcctcaggagggagtaaaaagggtgccatctgtgtctggaggggcagctgtgttcatgccctgtgctactggacatttcacaattctggcaccttgcgattggtcagtcaacctcagaaagtaactatcttgaaggtttgaaaaacaaccaaagaaagggagtgaggactatggctgcatgtcctctgcttgcccggctgcagagcagagatgtgcagccctctggtcagctggtccaggctggtccccgccggtccccttccagtccagccaccaagagtccacttgtcccgggcttccacctggctgacaggaagaatttctgagagctggatgtgcatgccctgtggacgaaggtacagctcgcctgcctgccccaatcccagccccgacaatcacatgcagctgactcggacactggccttgggaacaatgttcgagagaacacttgccccttgactgtaggagccagaaggggacccaggtgtgcatagctctctgtagacatttttacccaaacctgttggtaaagtgcccatctggtgctcaagagagcctgggggtctaacagggagcccggctgcctcacctggccacagcctccacaccagatctccacattgtcttgatccagaccagctctgtgatcagaaggaaattgggtccagtgtaggagagagctggtcctgggcctggcaggcaagagtgtgggcatcctttcctggcctttctccactctccctcaagcctgtgctcaggttgccttgaatgtggactctggaagagccaggggcccagaatgccgggggaggcttctgagtggcactcatggaacaccgtccctctgccagccataggccctgcctccagtgtcagggaatggaggctgggctgcgagagtgttgctgccccctgtgtcattcttctaatccaatgtagaaattgtacgtaatgtatttaaatcaacgcaaatgtatgaataacaaatacagttctgaccttttttgtccagtttctttgggggaaggaagacaaagaaggtaggaacggaattttgagggcaaagaaacctgtgtttccatggaattgctgagacgtggctcctggggctatttctccctaataaaggatgatccaggtcctcatttccaaagtcccaatgctctgaaaaccaaaagtattttcataacccatttgaaaccaaacctgacctgaacttacactgataggaagctatgggtaattatgatgtgttccttttagtgtgattctttgttgcagaaatgtcaatatattttatgacatggttccctactagggattatacagtatttgctgactacttcctaagagccaaaaataaaaaatctgaattccaaaa

SEQ ID NO: 22130 - DNA, 1848 bp, Homo sapiens
gtgggaggagggcccagatcccactggagataccgaaggagatactctttagtattgggatcccagaaaccagtcctatatctggccagagggacactgggttgtggcatctctctagctgctacccagaaggaacagggccccctggggcctataggccttgcccctgaccctgggaacacccagctcaggcctgccccagtggccacaagtcagggaggccgcaaatttttaactagaaacattgatcattaatagggggttagaaagagttcaaactaagtctcactctgggacatagaccaattgtgcttcaggcctcctgcagagatgctgggtccccaagtctggtcttctgtgaggcaggggctaagcaggagcttgtccaggaatgtgggggtctgggcctcaggggaggggaagaaggtggacattgcgggtatctacccccctgtgaccacccccttcactgccactgcagaggtggactatgggaaactggaggagaatctgcacaaactgggcaccttccccttccgaggagctgtggggggcgtctgcgccctggccaatgtcctgggggctcaggtgtgccagctggagcgactgtgctgcacggggcaatgggaagatgcccagaaactgcagcaccgcctcattgagccaaacgctgcgaggatcattgctgtcttcaaacccaagaatgaagagccctatgggcatcttaatcctaagtggaccaagtggctgcagaagctgtgctgtccttgctgctttggccgtgactgccttgtccttaaccagggctatctctcagaagcaggggccagcctggtggaccaaaaactggaactcaacattgttccccgtacaaaggtagtatacctggccagtgagaccttcaactatagtgccattgaccgagtgaagtccaggggcaagcggcttgcactagagaaagtgccaaaagttggacagcggtttaaccgcatcgggctaccaccaaaggttggttcattccagctctttgttgaaggctacaaagatgcagactattggctgcggcgttttgaagcagaacctcttcctgagaacactaaccggcaactactgctccagtttgagcggttggtggtgctggattacatcatccgcaacactgatcgaggcaatgacaactggctgattaaatatgactgtccaatggatagttctagctctcgggacacagactgggtggtggtgaaggagcctgttatcaaggtggctgccatagacaatgggctggccttcccactgaagcatcctgactcctggagggcatatcctttttactgggcctggttgccccaggcgaaagtcccattttctcaggagatcaaagatctgatccttccaaagatatcggaccctaacttcgtcaaggacttggaagaggacctatatgaactcttcaagaaagatcctggtttcgacaggggccagttccataagcagattgctgtcatgcggggccagatcttaaatctgacccaggccttgaaagacaacaagagtcccctgcacctcgtccagatgccacctgtgattgtcgagacggcccgttcccaccagcggtcttctagcgagtcctacacacagagctttcagagccggaagcccttcttttcatggtggtagctccagaggcaggcagaggaaatattgtcagagactggtgggaggaagcctggggagtggggtgcaggaaaagccagagaagccggtggagagcagcacctttaagagccctctctctctgcttgccaccctgctcagagctttccacccacagggagaagcacaatc

SEQ ID NO: 22131 - DNA, 3540 bp, Homo sapiens
ggaggcgcgaggtggggcgcggccggcggcgaggcgggacaaccgctgggcgggcgccaagcgtgcccgtgcgctggtgaggtggcgtccgttctacccggtcgctcccgttccgcgccatgcagagcccagtctctggcacctggctgctctgatctggtctcagcgcggagggagcagagggagtccatggaggatccctccgagcccgaccggttggcgtccgcggacggcgggagcccggaggaggaggaggatggggagcgggagccgctgctaccgcggatcgcctgggcccacccgcggagaggcgccccaggcagcgccgtgaggctgctggacgctgccggggaggagggcgaggccggcgacgaggagctgcccctcccgcccggggacgtgggggtctcccggagttcgtccgccgagctggaccggagccgccccgcggtttcagtaactattggtacttcagagatgaatgcattcttggatgacccagaatttgccgatattatgctgagagcagagcaagcaatagaagttggaatttttccagaaagaatctctcaaggttcaagtggaagttactttgtgaaggatcctaagaggaaaattattggtgtgtttaaacccaaatcagaagagccttatggtcaactcaatccaaaatggaccaaatatgtccataaggtctgctgcccttgctgctttggccgaggctgcctgattcctaatcaggggtacctttccgaagcgggtgcctatcttgtggacaacaagcttcatctgagcattgtacctaaaacaaaggtggtttggcttgtcagtgagacatttaactataatgcgattgaccgtgcaaaatcaagaggcaaaaagtatgctttagaaaaagtgccaaaagtgggtagaaagtttcataggataggactccctcctaagattggttcctttcagttatttgttgaaggttacaaggaggctgaatattggcttaggaaatttgaagctgaccctttgcctgagaatattagaaaacaatttcagtcacaatttgaaagattagttattttggattacatcatcagaaatacagacaggggcaatgataattggttagtcagatacgaaaagcagaaatgtgaaaaggaaattgaccataaggaatcaaaatggattgatgatgaagaattccttattaaaatagctgcaattgataatggtctagcatttccttttaaacatcctgatgaatggagagcatatccatttcactgggcttggcttcctcaagcaaaagttcccttttctgaagaaataagaaatttgattctaccatatatttctgacatgaactttgtgcaagatttatgtgaagatctctatgaactttttaagactgacaaaggatttgacaaagccacttttgaaagtcagatgtctgtgatgaggggtcagatcttaaaccttactcaggcattgagagacgggaagagtcctttccagctagtacagataccttgtgtgattgtggaacgcagtcaaggtggaagtcagggtcggattgtccacctgagcaattcctttacccagactgtcaattgcaggaagccatttttttcctcctggtagtaaatgtcagagtaagagaaacaaactgtttagaattatcatgtttttaaaacatcatagtaatataaatctgctgttaggagctccagttgctaaaacctcaatttaagtctttaaaaggttgtattttgaatgtaaccaaaagtttacagttttttgtccaaatattaaatttctatttcagggaagaagtgctatatctcctatattgtatttttgtagaaaatttgtattttatgttgttgttagtttaaaaggtaattttacacatgctggaatgactgtaattactctagaattccaagtagaatacaataacttttaatattgagaagaatgttcatgctaattcttcttacattacaaaaggcctttgaggatgcctacgtctgaaattgctcttacgaactttaataaaatagttagctaatagaaaaacaggtaagaataaagcaatgttgccttaatttcaaaagctgctattttagaatttgaataagtactcctaaagtgaccattattagggaccagaaaattatatcttggctaagtaatagaggaccattttggtttttgtacttgagaatatttttggtgaattactttgttgtagtgaggaaaaaacctaagaaatttcccctttttttaaaaaatggaaatattcaattgagacttgaggggaataatagaaaattaaggtagatccccaatattttggaataccaaaattgccttaaaaattcccttctgtttcttacatgggatcaaatacttgagattagtacttcagagtactggccttgttcaatttagtacttcaattagtattaaacttcactaaaaagtaaaccatactccaaattgtatattggattgcattttggggtcctaggtcatacgttcttcaaaattattatgattgtactattgtacttgaaattacagatgttattataattacagtcaaatgtagactatcaggccaaattaaaggggagcatggcagataaccataaagtcatttatatttgattttgaaatgtatttttgtactttattttgaatatcatccatatgtctgacattattggaatttgtaacattgttaatgcactaagtgatttaaattcaattgatgaagatgtgattttacagaagcagaagtttcattttcttgaggcttaaaaccaatgtcaccacttgggcttaactgggtaatttgtggtctaggccttttgttttctaagcttactatcttgtgtttgtttatttgcttttaatgaagtattttgtgtagaaggttaaattaggatgcaaaacagatctgccattcctttttcccttatatcttccttttggtcttcatggacgagatgaatgaggattctgctgccctgagggagttcattggaaacctgcgttctcctacctcttccaaccctccattagctcaattttgagataatggaaaattgactggaaattcaaaactcaaactactatctttagatataaacactagtaattaaaatgtgccttttgaagatgttttctaagagaaaggaaatacgttgcagtgatgtgggtactgctttcataaaacagttttttcagtattttgagaattgccatattaatttttataatggaaaacttaataaattgctactgttttatatcataaaattaaaataccatggtaatatttgcaaaaggtctggccataccagaaaagtacagttgagatagttaagatataaccacaagtcagagtacattggttgtattttgtaaactttcatgaactgaattcttatttaaatagtatggttttttttcaataagtatatttatagtgacaaatgtggtagactaaaggtaataaaaatcattgtcttaagatta

SEQ ID NO: 22132 - DNA, 3388 bp, Homo sapiens
aagcgtgcccgtgcgctggtgaggtggcgtccgttctacccggtcgctcccgttccgcgccatgcagagcccagtctctggcacctggctgctctgatctggtctcagcgcggagggagcagagggagtccatggaggatccctccgagcccgaccggttggcgtccgcggacggcgggagcccggaggaggaggaggatggggagcgggagccgctgctaccgcggatcgcctgggcccacccgcggagaggcgccccaggcagcgccgtgaggctgctggaccggagccgccccgcggtttcagtaactattggtacttcagagatgaatgcattcttggatgacccagaatttgccgatattatgctgagagcagagcaagcaatagaagttggaatttttccagaaagaatctctcaaggttcaagtggaagttactttgtgaaggatcctaagaggaaaattattggtgtgtttaaacccaaatcagaagagccttatggtcaactcaatccaaaatggaccaaatatgtccataaggtctgctgcccttgctgctttggccgaggctgcctgattcctaatcaggggtacctttccgaagcgggtgcctatcttgtggacaacaagcttcatctgagcattgtacctaaaacaaaggtggtttggcttgtcagtgagacatttaactataatgcgattgaccgtgcaaaatcaagaggcaaaaagtatgctttagaaaaagtgccaaaagtgggtagaaagtttcataggataggactccctcctaagattggttcctttcagttatttgttgaaggttacaaggaggctgaatattggcttaggaaatttgaagctgaccctttgcctgagaatattagaaaacaatttcagtcacaatttgaaagattagttattttggattacatcatcagaaatacagacaggggcaatgataattggttagtcagatacgaaaagcagaaatgtgaaaaggaaattgaccataaggaatcaaaatggattgatgatgaagaattccttattaaaatagctgcaattgataatggtctagcatttccttttaaacatcctgatgaatggagagcatatccatttcactgggcttggcttcctcaagcaaaagttcccttttctgaagaaataagaaatttgattctaccatatatttctgacatgaactttgtgcaagatttatgtgaagatctctatgaactttttaagactgacaaaggatttgacaaagccacttttgaaagtcagatgtctgtgatgaggggtcagatcttaaaccttactcaggcattgagagacgggaagagtcctttccagctagtacagataccttgtgtgattgtggaacgcagtcaaggtggaagtcagggtcggattgtccacctgagcaattcctttacccagactgtcaattgcaggaagccatttttttcctcctggtagtaaatgtcagagtaagagaaacaaactgtttagaattatcatgtttttaaaacatcatagtaatataaatctgctgttaggagctccagttgctaaaacctcaatttaagtctttaaaaggttgtattttgaatgtaaccaaaagtttacagttttttgtccaaatattaaatttctatttcagggaagaagtgctatatctcctatattgtatttttgtagaaaatttgtattttatgttgttgttagtttaaaaggtaattttacacatgctggaatgactgtaattactctagaattccaagtagaatacaataacttttaatattgagaagaatgttcatgctaattcttcttacattacaaaaggcctttgaggatgcctacgtctgaaattgctcttacgaactttaataaaatagttagctaatagaaaaacaggtaagaataaagcaatgttgccttaatttcaaaagctgctattttagaatttgaataagtactcctaaagtgaccattattagggaccagaaaattatatcttggctaagtaatagaggaccattttggtttttgtacttgagaatatttttggtgaattactttgttgtagtgaggaaaaaacctaagaaatttcccctttttttaaaaaatggaaatattcaattgagacttgaggggaataatagaaaattaaggtagatccccaatattttggaataccaaaattgccttaaaaattcccttctgtttcttacatgggatcaaatacttgagattagtacttcagagtactggccttgttcaatttagtacttcaattagtattaaacttcactaaaaagtaaaccatactccaaattgtatattggattgcattttggggtcctaggtcatacgttcttcaaaattattatgattgtactattgtacttgaaattacagatgttattataattacagtcaaatgtagactatcaggccaaattaaaggggagcatggcagataaccataaagtcatttatatttgattttgaaatgtatttttgtactttattttgaatatcatccatatgtctgacattattggaatttgtaacattgttaatgcactaagtgatttaaattcaattgatgaagatgtgattttacagaagcagaagtttcattttcttgaggcttaaaaccaatgtcaccacttgggcttaactgggtaatttgtggtctaggccttttgttttctaagcttactatcttgtgtttgtttatttgcttttaatgaagtattttgtgtagaaggttaaattaggatgcaaaacagatctgccattcctttttcccttatatcttccttttggtcttcatggacgagatgaatgaggattctgctgccctgagggagttcattggaaacctgcgttctcctacctcttccaaccctccattagctcaattttgagataatggaaaattgactggaaattcaaaactcaaactactatctttagatataaacactagtaattaaaatgtgccttttgaagatgttttctaagagaaaggaaatacgttgcagtgatgtgggtactgctttcataaaacagttttttcagtattttgagaattgccatattaatttttataatggaaaacttaataaattgctactgttttatatcataaaattaaaataccatggtaatatttgcaaaaggtctggccataccagaaaagtacagttgagatagttaagatataaccacaagtcagagtacattggttgtattttgtaaactttcatgaactgaattcttatttaaatagtatggttttttttcaataagtatatttatagtgacaaatgtggtagactaaaggtaataaaaatcattgtcttaagatt

SEQ ID NO: 22133 - DNA, 6752 bp, Homo sapiens
cggatgcacctacgcctgcgccctgaggtcgggcgctcgcgggccaggagcggggagccggcgggcagcgccgcggctcgtgaggtgatggcggcggccccggcccggggaggcggaggcggaggcggaggcggcggcggctgctccggctccggctccagcgcctcgcggggcttctatttcaacacggtcctgtcactggcccgctccctggcggtgcagagaccagcatccttggagaaggtccaaaagcttctttgcatgtgtccagtggatttccatgggatcttccagttagatgaaagacggagagatgcagtgattgcattgggcatttttctgattgaatctgatcttcagcacaaagattgtgtggttccttaccttcttcgacttctcaaaggtcttccaaaagtgtattgggtagaagaaagcacagctcggaaaggcagaggtgccctcccggttgcagagagcttcagcttctgcttggtaactctgctgtctgatgtggcctatagggatccttcacttagggatgagattttagaggtgcttttgcaggttttgcatgtcctcttggggatgtgccaggccttggagattcaagacaaagaatacctttgcaagtatgctatcccatgcctgataggaatctcgcgagcatttgggcgttacagcaacatggaagagtctctcctctcaaagctctttcccaaaatccctcctcattccctccgtgtcctggaagagcttgaaggtgttcgaaggcgttcctttaatgacttccgctccatcctccccagcaatctgctgactgtctgtcaggagggtaccctgaagaggaaaaccagcagtgtgtccagcatctctcaggtcagccctgaacgcggcatgccccctcccagttcccctggaggatctgcctttcactactttgaagcctcctgcttgcccgatgggactgccctagagcctgagtactacttttcaaccatcagctccagcttctcagtctctccccttttcaacggtgtcacatataaggagtttaacattccattggaaatgcttcgggaactcttaaacctggtgaagaagatcgttgaggaggctgttctcaaatctttggatgccattgtagccagtgtgatggaggccaaccccagtgctgatctctactacacttccttcagtgaccctctctacctgaccatgttcaagatgctgcgtgacactctgtactacatgaaggacctcccgacctcttttgtgaaggagatccatgattttgtgctggagcagttcaacacgagccagggggagctccagaagattctacatgacgcagaccggatccacaatgagctgagccccctcaaactgcgctgtcaggcgaatgctgcctgtgtggacctcatggtgtgggctgtgaaggacgagcagggtgcagaaaacctttgcatcaagctatctgagaagctgcagtccaagacgtccagcaaagtcattattgctcacttgcccctgctgatctgctgtctgcagggtttgggccgcctgtgcgagaggttcccggtggtggtgcactctgtgacaccgtccttgcgagacttcctggtcatcccgtccccagttctggtgaagctctacaagtaccacagtcagtaccacacagttgctggcaatgatataaaaatcagtgtgaccaatgagcattccgagtcaaccctgaacgtcatgtcgggtaagaagagccagccctccatgtacgagcagctccgagacatcgctattgacaacatctgcaggtgcctgaaggctggattgacggtggacccagtgattgtggaggcgttcttggccagcctgtccaaccggctctacatctctcaggagagcgacaaggacgctcacttgattcccgaccacacaatccgagccttgggacacattgcggtggccttgagggacaccccgaaggtcatggagcccattctgcagatcctacagcagaaattctgccagccaccctcccccctcgatgtgctgattattgaccagctgggctgcctggttatcaccggaaatcaatacatctatcaggaagtgtggaacctcttccagcagatcagtgtgaaggccagctccgttgtatactcagccaccaaagattacaaggaccacggctataggcattgctccctggcagtgattaatgccctggccaacatcgcggccaacatccaagacgagcacctggtggatgagctgctcatgaacctgttggagttgtttgtgcagctggggctggaggggaagcgagccagcgagagggcaagcgagaagggccctgccctaaaggcttctagcagtgcagggaacttgggagtactcattcctgtaatagctgtgctcacccgacgactgccacccatcaaagaagctaagcctcggttacagaagctcttccgagacttctggctgtattccgttctgatgggattcgctgtggagggctcaggactctggccagaagaatggtacgagggggtctgtgaaatagccactaagtcccccttgctcacctttcccagcaaggagccactgcggtccgtcctccagtataactcagccatgaagaatgacacggtcacccccgctgagctgagtgagctccgcagcactatcatcaacctgctggacccccctcccgaggtgtccgcactcatcaacaagctggacttcgccatgtccacctacctcctctctgtgtaccggctggagtacatgagggtactgcgttcaacagatcctgatcgcttccaggtaatgttctgctactttgaggataaagctattcagaaagacaaatctgggatgatgcagtgtgtgattgcagtcgcggacaaagtattcgatgccttcctgaacatgatggcggataaagccaagaccaaggagaacgaggaggagctggagcggcacgctcagttcctgttggtgaacttcaaccacatccacaagaggataaggagggtggcagacaagtatctatctggtctggtggataagtttccccacttgctctggagcgggactgtgctgaagaccatgctggacatcctgcagaccctgtcactgtcactgagcgctgatattcacaaggatcagccttactatgacatccccgacgccccctaccggatcacggttcctgacacgtacgaagcccgtgagagcattgtgaaggacttcgctgcacgctgtgggatgatcctccaggaggccatgaagtgggcacctaccgtcaccaagtcccacctgcaggaatatctgaacaaacatcagaactgggtatcgggactgtcccagcacacggggctggccatggccactgagagcatccttcactttgctggctacaacaagcagaacacaactcttggggcaactcagctgagcgagcgcccggcctgtgtgaagaaagactactccaacttcatggcatccctgaatctgcgcaaccgctacgcgggcgaggtgtatggaatgattcggttctcaggcaccacaggccagatgtctgacctgaacaaaatgatggtccaggatctacattcagctttagaccgcagtcatcctcagcactacacgcaggccatgttcaagctgaccgcaatgctcattagcagtaaagattgtgacccgcagctccttcatcatctgtgctggggtcccctccggatgttcaatgagcatggcatggagacggccctggcctgctgggagtggctgctggctggcaaggatggagtggaagtgccgttcatgcgggagatggcaggggcctggcacatgacggtggagcagaaatttggcctgttttctgctgagataaaggaagcagaccccctggctgcctcggaagcaagtcaacccaaaccctgtccccccgaagtgaccccccactacatctggatcgacttcctggtgcagcggtttgagatcgccaagtactgcagctctgaccaagtggagatcttctccagcctgctgcagcgctccatgtccctgaacatcggcggggccaaggggagcatgaaccggcacgtggcggccatcgggccccgcttcaagctgctgaccctggggctgtccctcctgcatgccgatgtggttccaaatgcaaccatccgcaatgtgcttcgcgagaagatctactccactgcctttgactacttcagctgtcccccaaagttccctactcaaggagagaagcggctgcgtgaagacataagcatcatgattaaattttggaccgccatgttctcagataagaagtacctgaccgccagccagcttgttcccccagataatcaggacacccggagcaacctggacataactgtcggctctcggcaacaagccacccaaggctggatcaacacataccccctgtccagcggcatgtccaccatctccaagaaatcaggcatgtctaagaaaaccaaccggggctcccagctgcacaaatactacatgaagcgcaggacgctgctgctgtccctgctggccactgagatcgagcgtctcatcacatggtacaacccgctgtcagccccggaactggaactagaccaggccggagagaacagcgtggccaactggagatctaagtacatcagcctgagtgagaagcagtggaaggacaacgtgaacctcgcctggagcatctctccctacctagccgtgcagctgcctgccaggtttaagaacacagaagccattgggaacgaagtgacccgtctcgttcggttggacccgggagccgttagtgatgtgcctgaagcaatcaagttcctggtcacctggcacaccatcgacgccgatgctccagagctcagccatgtgctgtgctgggcgcccacggacccacccacaggcctctcctacttctccagcatgtacccgccgcaccctctcacggcgcagtacggggtgaaagtcctgcggtccttccctccggacgccatcctcttctacatcccccagattgtgcaggccctcaggtacgacaagatgggctatgtgcgggagtatattctgtgggcagcgtctaaatcccagcttctggcacaccagttcatctggaacatgaagactaacatttatctagatgaagagggccaccagaaagaccctgacatcggcgacctcctggatcagttggtagaggagatcacaggctccttgtccggcccagcgaaggacttttaccagcgggagtttgatttctttaacaagatcaccaacgtgtcggctatcatcaagccctaccctaaaggcgacgagagaaagaaggcttgtctgtcggccctgtctgaagtgaaggtgcagccgggctgctacctgcccagcaaccctgaggccattgtgctggacatcgactacaagtctgggaccccgatgcagagtgctgcaaaagccccatatctggccaagttcaaggtgaagcgatgtggagttagtgaacttgaaaaagaaggtctgcggtgccgctcagactccgaggatgagtgcagcacgcaggaggccgacggccagaagatctcctggcaggcagccatcttcaaggtgggagacgactgccggcaggacatgctggccctgcagatcatcgacctcttcaagaacatcttccagctggtcggcctggacctctttgtttttccctaccgcgtggtggccactgcccctgggtgcggggtgatcgagtgcatccccgactgcacctcccgggaccagctgggccgccagacagacttcggcatgtacgactacttcacacgccagtacggggatgagtccactctggccttccagcaggcccgctacaacttcatccgaagcatggccgcctacagcctcctgctgttcctgctgcagatcaaggacagacacaacggcaacattatgctggacaagaagggtcatatcatccacatcgactttggcttcatgtttgaaagctcgccgggcggcaatctcggctgggaacccgacatcaagctgacggatgagatggtgatgatcatggggggcaagatggaggccacacccttcaagtggttcatggagatgtgtgtccgaggctacctggctgtgcggccctacatggacgcggtcgtctccctggtcactctcatgttggacacgggcctgccctgttttcgcggccagacaatcaagctcttgaagcacaggtttagccccaacatgactgagcgcgaggctgcaaatttcatcatgaaggtcatccagagctgcttcctcagcaacaggagccggacctacgacatgatccagtactatcagaatgacatcccctactgaggaggggaccttcgagggcctctgccccatgtgccctcaaagctgtcccacaatcatggagccctgcgacctccctgccctgccgccacatgcagtggaggagaggcctgtggcccaaagaacctggtagcgcctcctggggcagcacgtgggtggcgcagccttggtaacgccatggactgcagcgacaatcaatggatggtgctgtctatgcacaggtgtgagtcctctgtttgcactggacatattccctacctgtcttatttcataggtacatgaagtattgtgtataaaaaaagagataagatttaaccaacatcaacaaaataaaaacccaaaatagtgctgtgttggaa

SEQ ID NO: 22134 - DNA, 3036 bp, Homo sapiens
tggtttctaaatcttattcagtgagcacgtgttcctttttttaattagagaaaacttgacagtagcccctttttgtgtttcacagaggagctaacattccttctgtacctgtagttcatgcgggagatggcaggggcctggcacatgacggtggagcagaaatttggcctgttttctgctgagataaaggaagcagaccccctggctgcctcggaagcaagtcaacccaaaccctgtccccccgaagtgaccccccactacatctggatcgacttcctggtgcagcggtttgagatcgccaagtactgcagctctgaccaagtggagatcttctccagcctgctgcagcgctccatgtccctgaacatcggcggggccaaggggagcatgaaccggcacgtggcggccatcgggccccgcttcaagctgctgaccctggggctgtccctcctgcatgccgatgtggttccaaatgcaaccatccgcaatgtgcttcgcgagaagatctactccactgcctttgactacttcagctgtcccccaaagttccctactcaaggagagaagcggctgcgtgaagacataagcatcatgattaaattttggaccgccatgttctcagataagaagtacctgaccgccagccagcttgttcccccagataatcaggacacccggagcaacctggacataactgtcggctctcggcaacaagccacccaaggctggatcaacacataccccctgtccagcggcatgtccaccatctccaagaaatcaggcatgtctaagaaaaccaaccggggctcccagctgcacaaatactacatgaagcgcaggacgctgctgctgtccctgctggccactgagatcgagcgtctcatcacatggtacaacccgctgtcagccccggaactggaactagaccaggccggagagaacagcgtggccaactggagatctaagtacatcagcctgagtgagaagcagtggaaggacaacgtgaacctcgcctggagcatctctccctacctagccgtgcagctgcctgccaggtttaagaacacagaagccattgggaacgaagtgacccgtctcgttcggttggacccgggagccgttagtgatgtgcctgaagcaatcaagttcctggtcacctggcacaccatcgacgccgatgctccagagctcagccatgtgctgtgctgggcgcccacggacccacccacaggcctctcctacttctccagcatgtacccgccgcaccctctcacggcgcagtacggggtgaaagtcctgcggtccttccctccggacgccatcctcttctacatcccccagattgtgcaggccctcaggtacgacaagatgggctatgtgcgggagtatattctgtgggcagcgtctaaatcccagcttctggcacaccagttcatctggaacatgaagactaacatttatctagatgaagagggccaccagaaagaccctgacatcggcgacctcctggatcagttggtagaggagatcacaggctccttgtccggcccagcgaaggacttttaccagcgggagtttgatttctttaacaagatcaccaacgtgtcggctatcatcaagccctaccctaaaggcgacgagagaaagaaggcttgtctgtcggccctgtctgaagtgaaggtgcagccgggctgctacctgcccagcaaccctgaggccattgtgctggacatcgactacaagtctgggaccccgatgcagagtgctgcaaaagccccatatctggccaagttcaaggtgaagcgatgtggagttagtgaacttgaaaaagaaggtctgcggtgccgctcagactccgaggatgagtgcagcacgcaggaggccgacggccagaagatctcctggcaggcagccatcttcaaggtgggagacgactgccggcaggacatgctggccctgcagatcatcgacctcttcaagaacatcttccagctggtcggcctggacctctttgtttttccctaccgcgtggtggccactgcccctgggtgcggggtgatcgagtgcatccccgactgcacctcccgggaccagctgggccgccagacagacttcggcatgtacgactacttcacacgccagtacggggatgagtccactctggccttccagcaggcccgctacaacttcatccgaagcatggccgcctacagcctcctgctgttcctgctgcagatcaaggacagacacaacggcaacattatgctggacaagaagggtcatatcatccacatcgactttggcttcatgtttgaaagctcgccgggcggcaatctcggctgggaacccgacatcaagctgacggatgagatggtgatgatcatggggggcaagatggaggccacacccttcaagtggttcatggagatgtgtgtccgaggctacctggctgtgcggccctacatggacgcggtcgtctccctggtcactctcatgttggacacgggcctgccctgttttcgcggccagacaatcaagctcttgaagcacaggtttagccccaacatgactgagcgcgaggctgcaaatttcatcatgaaggtcatccagagctgcttcctcagcaacaggagccggacctacgacatgatccagtactatcagaatgacatcccctactgaggaggggaccttcgagggcctctgccccatgtgccctcaaagctgtcccacaatcatggagccctgcgacctccctgccctgccgccacatgcagtggaggagaggcctgtggcccaaagaacctggtagcgcctcctggggcagcacgtgggtggcgcagccttggtaacgccatggactgcagcgacaatcaatggatggtgctgtctatgcacaggtgtgagtcctctgtttgcactggacatattccctacctgtcttatttcataggtacatgaagtattgtgtataaaaaaagagataagatttaaccaacatcaacaaaataaaaacccaaaatagtgctgtgttgg

SEQ ID NO: 22135 - DNA, 574 bp, Homo sapiens
aaaacatttctcgtctccgtttgacagcacagagaccggcgagtccacaccagccctgccccaggctcacctcggaagaggcgaccccaaccttctcggactcgtacatgagggccagggacctgctggtgctggcggccgtggcctcagccctgcggaggacctcctgccgcaagtactgctgcctgtccgcgggcgcgtcgggcccgtcggggaggtctcgggcgtccctccaaggggccggccgggcgccttcgtcctccccgtcgtcgtcgaacggattgtagcttttagggtccaaaagcttctttgcatgtgtccagtggatttccatgggatcttccagttagatgaaagacggagagatgcagtgattgcattgggcatttttctgattgaatctgatcttcagcacaaagattgtgtggttccttaccttcttcgacttctcaaaggtcttccaaaagtgtattgggtagaagaaagcacagctcggaaaggcagaggtgccctcccggttgcagagagcttcagcttctgcttggtaactctgctgtctgatgtggcctatagg

SEQ ID NO: 22136 - DNA, 2340 bp, Homo sapiens
gcgcggccccgaaccgcgccccaggccggcaggcggggaaggagccggtgggggtagggggtgcggtggggggtggggaccctccggctcttgggggtcccagtccccgccggctgctgagcgggtggggtggtggaggagctgcagagatgtccggccagagcctgacggaccgaatcactgccgcccagcacagtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaaccaatgcaaagaaggtcttgacatctataagaagttcctaactaggatgacaagaatctcagagttcctcaaagttgcagagcaagttggaattgacagaggtgatataccagacctttcacaggcccctagcagtcttcttgatgctttggaacaacatttagcttccttggaaggaaagaaaatcaaagattctacagctgcaagcagggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggagatcctttctctgctactgtagatgctgttgatgatgccattccaagcttaaatcctttcctcacaaaaagtagtggtgatgttcacctttccatttcttcagatgtatctacttttactactaggacacctactcatgaaatgtttgttggattcactccttctccagttgcacagccacacccttcagctggccttaatgttgactttgaatctgtgtttggaaataaatctacaaatgttattgtagattctgggggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgctgcaacaatggcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatc

SEQ ID NO: 22137 - DNA, 2618 bp, Homo sapiens
gaggaggagcctggcgccgccattttcctgcagctgcctgttcctcttaccctgcccggctccagctgacccgggaaggggtgggctgaactgaggcgggggcaagggtggggaccctccggctcttgggggtcccagtccccgccggctgctgagcgggtggggtggtggaggagctgcagagatgtccggccagagcctgacggaccgaatcactgccgcccagcacagtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaaccaatgcaaagaaggtcttgacatctataagaagttcctaactaggatgacaagaatctcagagttcctcaaagttgcagagcaagttggaattgacagaggtgatataccagacctttcacaggcccctagcagtcttcttgatgctttggaacaacatttagcttccttggaaggaaagaaaatcaaagattctacagctgcaagcagggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggagatcctttctctgctactgtagatgctgttgatgatgccattccaagcttaaatcctttcctcacaaaaagtagtggtgatgttcacctttccatttcttcagatgtatctacttttactactaggacacctactcatgaaatgtttgttggattcactccttctccagttgcacagccacacccttcagctggccttaatgttgactttgaatctgtgtttggaaataaatctacaaatgttattgtagattctgggggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgctgcaacaatggcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactg

SEQ ID NO: 22138 - DNA, 3613 bp, Homo sapiens
ggagcctggcgccgccattttcctgcagctgcctgttcctcttaccctgcccggctccagctgacccgggaaggggtgggctgaactgaggcgggggcaagggagtgcccgacatcttgtccgactccgcgggtgacacgagccggttctctctggactggtggcagcgcgcggccccgaaccgcgccccaggccggcaggcggggaaggagccggtgggggtagggggtgcggtggggggtggggaccctccggctcttgggggtcccagtccccgccggctgctgagcgggtggggtggtggaggagctgcagagatgtccggccagagcctgacggaccgaatcactgccgcccagcacagtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaaccaatgcaaagaaggtcttgacatctataagaagttcctaactaggatgacaagaatctcagagttcctcaaagttgcagagcaagttggaattgacagaggtgatataccagacctttcacaggcccctagcagtcttcttgatgctttggaacaacatttagcttccttggaaggaaagaaaatcaaagattctacagctgcaagcagggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggagatgctgttgatgatgccattccaagcttaaatcctttcctcacaaaaagtagtggtgatgttcacctttccatttcttcagatgtatctacttttactactaggacacctactcatgaaatgtttgttggattcactccttctccagttgcacagccacacccttcagctggccttaatgttgactttgaatctgtgtttggaaataaatctacaaatgttattgtagattctgggggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgctgcaacaatggcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactgaaattaacttttctttttttaaaaaaaattatattcagtttgcagtagacattccttaagtatttgtatttatttatgattatcaattttacataacattaatattgtatcagacctccttatgaaaatgagtatggatgtgcacagtatgtttgatttttatccacaagaatgaatctgattcagaatgcttttctcagctgacatacagagcactaaatattttaaggcaagtccataggtctgaatctcttaagaattctcggcctctgtgggatttagggaagcattataaatgcattaatccttatagtcaattctgtgcctaggattttgccagggaacagttcactgactaggaaaagcactacattttaaattcagcattagtgcattgggaaggatctttactgctttgtgcttggcatgtcattattttccatttgacattagggcctttccaaaatgaatgtgaggaattgctttcacttcaagactttccttcttttcactaaaactctagaaggtgttacaagggggagggaaggggggcaaagtccttgaacattttctttggctcgtgccatgttatgatcatataccttttaaataaggggaaatagtatctttaaagttaatgtctagccaagagtttagtaaacgaagaattaaactgcactgttgatcggtgctttgtgtaaatacatctttaacatttgggtggagaggggccttaagaaggacagttcattgtaggaaagcaattctgtacatgagtttaagcattcttgttgcattgtctctgcagattctatttttgtttacaatattaaaatgtatgttagcaaaatgggtggattttcaaataaaatgcagcttccac

SEQ ID NO: 22139 - DNA, 3474 bp, Homo sapiens
ctcttaccctgcccggctccagctgacccgggaaggggtgggctgaactgaggcgggggcaagggagtgcccgacatcttgtccgactccgcgggtgacacgagccggttctctctggactggtggcagcgcgcggccccgaaccgcgccccaggccggcaggcggggaaggagccggtgggggtagggggtgcggtggggggtggggaccctccggctcttgggggtcccagtccccgccggctgctgagcgggtggggtggtggaggagctgcagagatgtccggccagagcctgacggaccgaatcactgccgcccagcacagtgtcaccggctctgccgtatccaagacagtatgcaaggccacgacccacgagatcatggggcccaagaaaaagcacctggactacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaaccaatgcaaagaaggtcttgacatctataagaagttcctaactaggatgacaagaatctcagagttcctcaaagttgcagagcaagttggaattgacagaggtgatataccagacctttcacaggcccctagcagtcttcttgatgctttggaacaacatttagcttccttggaaggaaagaaaatcaaagattctacagctgcaagcagggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggaggattcactccttctccagttgcacagccacacccttcagctggccttaatgttgactttgaatctgtgtttggaaataaatctacaaatgttattgtagattctgggggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgctgcaacaatgaatggcatgcattttccacaatacgcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactgaaattaacttttctttttttaaaaaaaattatattcagtttgcagtagacattccttaagtatttgtatttatttatgattatcaattttacataacattaatattgtatcagacctccttatgaaaatgagtatggatgtgcacagtatgtttgatttttatccacaagaatgaatctgattcagaatgcttttctcagctgacatacagagcactaaatattttaaggcaagtccataggtctgaatctcttaagaattctcggcctctgtgggatttagggaagcattataaatgcattaatccttatagtcaattctgtgcctaggattttgccagggaacagttcactgactaggaaaagcactacattttaaattcagcattagtgcattgggaaggatctttactgctttgtgcttggcatgtcattattttccatttgacattagggcctttccaaaatgaatgtgaggaattgctttcacttcaagactttccttcttttcactaaaactctagaaggtgttacaagggggagggaaggggggcaaagtccttgaacattttctttggctcgtgccatgttatgatcatataccttttaaataaggggaaatagtatctttaaagttaatgtctagccaagagtttagtaaacgaagaattaaactgcactgttgatcggtgctttgtgtaaatacatctttaacatttgggtggagaggggccttaagaaggacagttcattgtaggaaagcaattctgtacatgagtttaagcattcttgttgcattgtctctgcagattctatttttgtttacaatattaaaatgtatgttagcaaaatgggtggattttcaaataaaatgcagcttccacaaaa

SEQ ID NO: 22140 - DNA, 2049 bp, Homo sapiens
tatgtgtttcctgtcctattccacaccctagagaatgaataccggccagctagtatctaaatttagaatggcagcaacgtgtcgggttttcggagtagagataaacaaaaccaggtgacatttccaagcctctcaaggaaaggggggaaaaaacctttctgggacttaattcagtgcacaaatgagatgaatgtgaacatcccacagttggcagacagtttatttgaaagaactactaatagtagttgggtggtggtcttcaaatctctcattacaactcatcatttgatggtgtatggaaatgagcgttttattcagtatttggcttcaagaaacacgttgtttaacttaagcaattttttggataaaagtggattgcaaggatatgacatgtctacatttattaggcggtatagtagatatttaaatgagaaagcagtttcatacagacaagttgcatttgatttcacaaaagtgaagagaggggctgatggagttatgagaacaatgaacacagaaaaactcctaaaaactgtaccaattattcagaatcagatggatgcacttcttgattttaatgttaatagcaatgaacttacaaatggggtaataaatgctgccttcatgctcctgttcaaagatgccattagactgtttgcagcatacaatgaaggaattattaatttgttggaaaaatattttgatatgaaaaagaaccaatgcaaagaaggtcttgacatctataagaagttcctaactaggatgacaagaatctcagagttcctcaaagttgcagagcaagttggaattgacagaggtgatataccagacctttcacaggcccctagcagtcttcttgatgctttggaacaacatttagcttccttggaaggaaagaaaatcaaagattctacagctgcaagcagggcaactacactttccaatgcagtgtcttccctggcaagcactggtctatctctgaccaaagtggatgaaagggaaaagcaggcagcattagaggaagaacaggcacgtttgaaagctttaaaggaacagcgcctaaaagaacttgcaaagaaacctcatacctctttaacaactgcagcctctcctgtatccacctcagcaggagggataatgactgcaccagccattgacatattttctacccctagttcttctaacagcacatcaaagctgcccaatgatctgcttgatttgcagcagccaacttttcacccatctgtacatcctatgtcaactgcttctcaggtagcaagtacatggggaggattcactccttctccagttgcacagccacacccttcagctggccttaatgttgactttgaatctgtgtttggaaataaatctacaaatgttattgtagattctgggggctttgatgaactaggtggacttctcaaaccaacagtggcctctcagaaccagaaccttcctgttgccaaactcccacctagcaagttagtatctgatgacttggattcatctttagccaaccttgtgggcaatcttggcatcggaaatggaaccactaagaatgatgtaaattggagtcaaccaggtgaaaagaagttaactgggggatctaactggcaaccaaaggttgcaccaacaaccgcttggaatgctgcaacaatggcaccccctgtaatggcctatcctgctactacaccaacaggcatgataggatatggaattcctccacaaatgggaagtgttcctgtaatgacgcaaccaaccttaatatacagccagcctgtcatgagacctccaaacccctttggccctgtatcaggagcacagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaaga

SEQ ID NO: 22141 - DNA, 3590 bp, Homo sapiens
actggcggccatggaactcaccggtaatagaggacacatctcttaactgggttgctctaagaactgatgtctaaaccgtctcagcatggcctgtagaggaggagctgggaatggccaccgtgcctcagctacactctctcgggttagccctggaagtctttacacatgtagaacccgtacccataatatatgcatggtatctgactttttctacccaaatatgggaggcgtggaaagccacatttaccagctctctcagtgcctgattgaaagagggcataaggttataattgtcacccatgcttatggaaatcgaaaaggcatccgttacctcaccagtggcctcaaagtctattacttgcctctgaaagtcatgtacaaccagtctacagccacgaccctctttcacagtctgccattgctcaggtacatatttgttcgggagagagtcacgataatccattcacatagttctttttctgctatggcccatgatgctctcttccacgccaagacaatggggcttcagacagtcttcacggaccattccctttttggatttgctgatgtcagctcggtgcttacaaacaagcttctaaccgtgtctctttgtgatacaaaccacatcatttgtgtgtcttatactagtaaggaaaatactgtactaagagcagcactgaatcctgaaatagtgtccgtcattcctaatgctgtagatcctactgacttcactccagacccatttagaaggcatgatagtataactattgttgttgtcagcagacttgtttacagaaaagggatcgatttgcttagtggtataatacctgaactctgtcagaaatatccagatttaaatttcataattggaggagagggaccaaagagaatcattttggaagaagttcgggaaagataccagctgcatgacagggtgcgtcttttgggagctttagaacacaaggatgttagaaatgtcttagttcaaggacatatttttctgaatacctcccttactgaagcattctgcatggcgatcgtggaagcagccagttgtggtttacaggttgtaagtaccagagttggtggaattcctgaggtgcttccagaaaaccttattattttatgtgagccttcagtaaaatctttgtgtgaaggattggaaaaggctattttccaactgaagtcagggacattgccagctccagaaaacatccataacatagtaaagactttctacacctggaggaatgttgcagaaagaactgaaaaggtatatgaccgggtatcagtggaagctgtgttgccaatggacaaacgactggacagacttatttctcactgcggcccagtaacaggctacatctttgctttgttggcagttttcaacttcctcttcctcattttcttgagatggatgactccagattctatcattgatgttgcaatagatgccactgggccacggggtgcctggactaataactattctcacagtaaaagagggggtgagaataatgagatatctgaaaccaggtagaaggaagcctagattgtaagattttaaacatttgtaatagttctataaagactatggaaaataaccttgcttttggggggtttttgtttttttagagttaatttagtaagttatgctacctctatatcattcaatattttctgttgaggaaagataaaaatgtatgcaattcctgagtgtagaaacttcttgcacttatttaaaatttaggagagaacatttaagccactcaggtatgcaatttttcagactactgaaatccctgtagcagagatgttttaacattatattttgagagctttgggtgctgaagggccaaacgttttctgggcattttttggccagtttttaatgtaacaccattagacactcaccagatgtttacaagttttctttaggggaactacaacaattatatgaactgttttatatcatgttcatatacatttattaggaatctaaatcatgtctttgaacatttattaggttcactcagtaggtgttacatgtaattaacaggttccttgagtaagatagtccatcagttaccagcacattttgaacccctgctctgtgtagaatgttgaactagatgcttcccgccattaaggaccaggggtgcattcactctttgtttaccattcaaatggcttacttcatcataattgtggttgatatgagatcaatatccaacatgccaaaaatgctcatgccagttaatgccaggaaaaaaatcaccgacacactactagtactttgttcctgttgtatgcattctcctaggtagagcctccatcttcagttgtgtttgtgaaggtattttttgctttttaaatactggggaccgatatcactgttgatagtgcagagaaaccctccacatttttcagtgcataattgagttttctataaatgccttcgtgttttctgagcagaatgtacgaggtgtgccatcccaaaaccagctgctaccctgtccttttaatgtaagtcactccccttcactgtggcctcgctgatgtctgataagtattgtcagtgtgcaaaaggctttacttcagaatggtttatttatagcaaactaagttgaaaattttagaaacagtctttgtgggtggatgttattaactgtcattgttgttgcccagagccatgggttttttaaccccaaattatccacatggtgtgtattatgaattctttgaactcttaaggtttttgtgagaaaaggactgtgaattcaaaacaataaggcacttgtgggtgcactacatagattctgacagtgttgtgattctgtataggatttttaaaaatgacaacattcacaaaatttattactttttaaaaaataacatgcctattaactggttgcactgatataaaagaaatatatttgtgttttgtttgtactaaaatgcaaaagcaagagtgcaatttttaaaatctagaagttaggggttttgttggagaaaaatggactgatctttaaactattcagtcttactgggatttttatgcatagaaactcacatataaacatgaaataaacagtgccagtattcataggaaagtgagaaactgtaatatttggccattattctattcaacaggttttagaggcatgccaccattttttccttatatttttgcttaatttttttaaattgtcatttaattcttaaactgtcatttatttgagatggaaataagatctaaagttagttgcctttgcctgtaaaacatgtgatttgcaaattattatttttcttttttttaacaaatggaagtaaatttgtttcacgtaaatcttaattttcaacctttctggataccttaattgtaactgtcagtttgcactggtcggtatatggaaacacattgctctaccctgctacttagttgattttaaagtgaatttacagtgatgagaaatttgtgaaaaatatattgtatttcttttgatgtttcaaaaggttgcctatgaaaaactgatttgttaaaacatgctacatgtccaaaaataaagaccagaatgacattttgataa

SEQ ID NO: 22142 - DNA, 2943 bp, Homo sapiens
gcgggaggtccggacactggcggccatggaactcaccggtaatagaggacacatctcttaactgggttgctctaagaactgatgtctaaaccgtctcagcatggcctgtagaggaggagctgggaatggccaccgtgcctcagctacactctctcggggatcgatttgcttagtggtataatacctgaactctgtcagaaatatccagatttaaatttcataattggaggagagggaccaaagagaatcattttggaagaagttcgggaaagataccagctgcatgacagggtgcgtcttttgggagctttagaacacaaggatgttagaaatgtcttagttcaaggacatatttttctgaatacctcccttactgaagcattctgcatggcgatcgtggaagcagccagttgtggtttacaggttgtaagtaccagagttggtggaattcctgaggtgcttccagaaaaccttattattttatgtgagccttcagtaaaatctttgtgtgaaggattggaaaaggctattttccaactgaagtcagggacattgccagctccagaaaacatccataacatagtaaagactttctacacctggaggaatgttgcagaaagaactgaaaaggtatatgaccgggtatcagtggaagctgtgttgccaatggacaaacgactggacagacttatttctcactgcggcccagtaacaggctacatctttgctttgttggcagttttcaacttcctcttcctcattttcttgagatggatgactccagattctatcattgatgttgcaatagatgccactgggccacggggtgcctggactaataactattctcacagtaaaagagggggtgagaataatgagatatctgaaaccaggtagaaggaagcctagattgtaagattttaaacatttgtaatagttctataaagactatggaaaataaccttgcttttggggggtttttgtttttttagagttaatttagtaagttatgctacctctatatcattcaatattttctgttgaggaaagataaaaatgtatgcaattcctgagtgtagaaacttcttgcacttatttaaaatttaggagagaacatttaagccactcaggtatgcaatttttcagactactgaaatccctgtagcagagatgttttaacattatattttgagagctttgggtgctgaagggccaaacgttttctgggcattttttggccagtttttaatgtaacaccattagacactcaccagatgtttacaagttttctttaggggaactacaacaattatatgaactgttttatatcatgttcatatacatttattaggaatctaaatcatgtctttgaacatttattaggttcactcagtaggtgttacatgtaattaacaggttccttgagtaagatagtccatcagttaccagcacattttgaacccctgctctgtgtagaatgttgaactagatgcttcccgccattaaggaccaggggtgcattcactctttgtttaccattcaaatggcttacttcatcataattgtggttgatatgagatcaatatccaacatgccaaaaatgctcatgccagttaatgccaggaaaaaaatcaccgacacactactagtactttgttcctgttgtatgcattctcctaggtagagcctccatcttcagttgtgtttgtgaaggtattttttgctttttaaatactggggaccgatatcactgttgatagtgcagagaaaccctccacatttttcagtgcataattgagttttctataaatgccttcgtgttttctgagcagaatgtacgaggtgtgccatcccaaaaccagctgctaccctgtccttttaatgtaagtcactccccttcactgtggcctcgctgatgtctgataagtattgtcagtgtgcaaaaggctttacttcagaatggtttatttatagcaaactaagttgaaaattttagaaacagtctttgtgggtggatgttattaactgtcattgttgttgcccagagccatgggttttttaaccccaaattatccacatggtgtgtattatgaattctttgaactcttaaggtttttgtgagaaaaggactgtgaattcaaaacaataaggcacttgtgggtgcactacatagattctgacagtgttgtgattctgtataggatttttaaaaatgacaacattcacaaaatttattactttttaaaaaataacatgcctattaactggttgcactgatataaaagaaatatatttgtgttttgtttgtactaaaatgcaaaagcaagagtgcaatttttaaaatctagaagttaggggttttgttggagaaaaatggactgatctttaaactattcagtcttactgggatttttatgcatagaaactcacatataaacatgaaataaacagtgccagtattcataggaaagtgagaaactgtaatatttggccattattctattcaacaggttttagaggcatgccaccattttttccttatatttttgcttaatttttttaaattgtcatttaattcttaaactgtcatttatttgagatggaaataagatctaaagttagttgcctttgcctgtaaaacatgtgatttgcaaattattatttttcttttttttaacaaatggaagtaaatttgtttcacgtaaatcttaattttcaacctttctggataccttaattgtaactgtcagtttgcactggtcggtatatggaaacacattgctctaccctgctacttagttgattttaaagtgaatttacagtgatgagaaatttgtgaaaaatatattgtatttcttttgatgtttcaaaaggttgcctatgaaaaactgatttgttaaaacatgctacatgtccaaaaataaagaccagaatgacattttg

SEQ ID NO: 22143 - DNA, 2849 bp, Homo sapiens
gactccggctgcagccgcgggaggtccggacactggcggccatggaactcaccgggatcgatttgcttagtggtataatacctgaactctgtcagaaatatccagatttaaatttcataattggaggagagggaccaaagagaatcattttggaagaagttcgggaaagataccagctgcatgacagggtgcgtcttttgggagctttagaacacaaggatgttagaaatgtcttagttcaaggacatatttttctgaatacctcccttactgaagcattctgcatggcgatcgtggaagcagccagttgtggtttacaggttgtaagtaccagagttggtggaattcctgaggtgcttccagaaaaccttattattttatgtgagccttcagtaaaatctttgtgtgaaggattggaaaaggctattttccaactgaagtcagggacattgccagctccagaaaacatccataacatagtaaagactttctacacctggaggaatgttgcagaaagaactgaaaaggtatatgaccgggtatcagtggaagctgtgttgccaatggacaaacgactggacagacttatttctcactgcggcccagtaacaggctacatctttgctttgttggcagttttcaacttcctcttcctcattttcttgagatggatgactccagattctatcattgatgttgcaatagatgccactgggccacggggtgcctggactaataactattctcacagtaaaagagggggtgagaataatgagatatctgaaaccaggtagaaggaagcctagattgtaagattttaaacatttgtaatagttctataaagactatggaaaataaccttgcttttggggggtttttgtttttttagagttaatttagtaagttatgctacctctatatcattcaatattttctgttgaggaaagataaaaatgtatgcaattcctgagtgtagaaacttcttgcacttatttaaaatttaggagagaacatttaagccactcaggtatgcaatttttcagactactgaaatccctgtagcagagatgttttaacattatattttgagagctttgggtgctgaagggccaaacgttttctgggcattttttggccagtttttaatgtaacaccattagacactcaccagatgtttacaagttttctttaggggaactacaacaattatatgaactgttttatatcatgttcatatacatttattaggaatctaaatcatgtctttgaacatttattaggttcactcagtaggtgttacatgtaattaacaggttccttgagtaagatagtccatcagttaccagcacattttgaacccctgctctgtgtagaatgttgaactagatgcttcccgccattaaggaccaggggtgcattcactctttgtttaccattcaaatggcttacttcatcataattgtggttgatatgagatcaatatccaacatgccaaaaatgctcatgccagttaatgccaggaaaaaaatcaccgacacactactagtactttgttcctgttgtatgcattctcctaggtagagcctccatcttcagttgtgtttgtgaaggtattttttgctttttaaatactggggaccgatatcactgttgatagtgcagagaaaccctccacatttttcagtgcataattgagttttctataaatgccttcgtgttttctgagcagaatgtacgaggtgtgccatcccaaaaccagctgctaccctgtccttttaatgtaagtcactccccttcactgtggcctcgctgatgtctgataagtattgtcagtgtgcaaaaggctttacttcagaatggtttatttatagcaaactaagttgaaaattttagaaacagtctttgtgggtggatgttattaactgtcattgttgttgcccagagccatgggttttttaaccccaaattatccacatggtgtgtattatgaattctttgaactcttaaggtttttgtgagaaaaggactgtgaattcaaaacaataaggcacttgtgggtgcactacatagattctgacagtgttgtgattctgtataggatttttaaaaatgacaacattcacaaaatttattactttttaaaaaataacatgcctattaactggttgcactgatataaaagaaatatatttgtgttttgtttgtactaaaatgcaaaagcaagagtgcaatttttaaaatctagaagttaggggttttgttggagaaaaatggactgatctttaaactattcagtcttactgggatttttatgcatagaaactcacatataaacatgaaataaacagtgccagtattcataggaaagtgagaaactgtaatatttggccattattctattcaacaggttttagaggcatgccaccattttttccttatatttttgcttaatttttttaaattgtcatttaattcttaaactgtcatttatttgagatggaaataagatctaaagttagttgcctttgcctgtaaaacatgtgatttgcaaattattatttttcttttttttaacaaatggaagtaaatttgtttcacgtaaatcttaattttcaacctttctggataccttaattgtaactgtcagtttgcactggtcggtatatggaaacacattgctctaccctgctacttagttgattttaaagtgaatttacagtgatgagaaatttgtgaaaaatatattgtatttcttttgatgtttcaaaaggttgcctatgaaaaactgatttgttaaaacatgctacatgtccaaaaataaagaccagaatgacattttgataattttc

SEQ ID NO: 22144 - DNA, 2196 bp, Homo sapiens
gactgttctgcgcctgctccacgtcactaaactcgctaccgcctgctcccctccagagaccgggggccttccagcagttttcggacccccgagcacagagaccgccaagccaaaggcgagtagcaatccctcggttcggaaacggcgaaaggaaaccgcaaggaggccaccacgtcgggtgggagctacgaagttgcccgttcccggttacttccgggcttgcgagcgacgactgctctcaaaggccaaacttaatggatggacgagcagcgcgctactgcagctttcttccgccttaggaaggtggcggccagggatgaggaggcccctaagcaagtgcggaatggagccggggggcggagatgccagcctcactttgcatggtctccagaaccgctcccacggcaagataaagctgcgaaagagaaagtctaccttgtacttcaacacccaggagaagagcgccaggcgccgcggggatcttcttggagaaaatatttatctgctcttgtttaccatagctttacgaatattaaactgctttttagtgcagacaagttttgttccagatgaatactggcagtctcttgaagtttcacatcacatggttttcaattatggttatttgacttgggaatggacagagagactgaggagttacacttatcccttaatctttgcaagcatttacaagattcttcatcttttagggaaagatagtgttcagttgctgatttggattcctagacttgcccaagcacttctgtctgctgtagcagatgtgagactttactcattaatgaagcaactagaaaatcaggaagtggcaagatgggtgtttttttgccagttgtgctcctggttcacatggtattgctgtaccagaacccttacaaacaccatggaaactgttctcactataattgctcttttctactatcctttggaaggttcaaagtctatgaacagtgtcaaatactcatccctggtggcacttgccttcataattcgtcccacagctgtcattctgtggacacctttgctcttcagacatttctgtcaagaaccaagaaagcttgatcttattctacatcattttttacctgtaggctttgttactttgagtttgtctctgatgattgatcgtattttttttggccaatggactctggttcaatttaattttttgaaatttaacgtgctgcagaactggggaacattttatggttctcatccatggcactggtacttcagtcaaggatttccagttatcttgggtactcacttacccttctttattcatggctgctatctagcaccaaagagataccggatacttttggtgactgtgctgtggacactgcttgtttatagcatgttgagccacaaagaattcaggtttatttatccagttttaccattctgtatggtgttctgtggatactcattaacccacctgaaaacatggaagaaaccagctctaagtttcctgtttttatcaaatttgttcctcgccctttatactggtttagttcatcaacgaggtactcttgatgtcatgagtcatattcaaaaagtttgttacaacaatcccaataaatcttcagcttcaatatttataatgatgccttgccactctactccttattacagccatgttcactgcccacttcccatgagatttctccagtgcccgccagacctgactggaaaaagtcattatcttgatgaagcagatgtattttacctaaatcccttaaactggttacatagagagtttcatgatgatgcatcattgcctactcacttgatcaccttcagcattttggaagaggaaataagcgctttcctaatttcaagcaattataaaagaactgctgttttcttccacactcacttgccagagggtcgaattggaagtcacatatatgtctatgaacggaagttaaaagggaaattcaacatgaagatgaaattctgaactttcctagataaattaacattgctgggtggaaatattcagatgctgcttaaatacttcggtaaacactgggtaagattcatggaacttagaaaaaagctgtatgaactgctttaccaaatatcactactgaggaaatgtataaaataccacatagtataaaattacatgttaatacaatgccagattttaaataaagacctttagttttcctc

SEQ ID NO: 22145 - DNA, 1812 bp, Homo sapiens
actaaactcgctaccgcctgctcccctccagagaccgggggccttccagcagttttcggacccccgagcacagagaccgccaagccaaaggcgagtagcaatccctcggttcggaaacggcgaaaggaaaccgcaaggaggccaccacgtcgggtgggagctacgaagttgcccgttcccggttacttccgggcttgcgagcgacgactgctctcaaaggccaaacttaatggatggacgagcagcgcgctactgcagctttcttccgccttaggaaggtggcggccagggatgaggaggcccctaagcaagtgcggaatggagccggggggcggagatgccagcctcactttgcatggtctccagaaccgctcccacggcaagataaagctgcgaaagagaaagtctaccttgtacttcaacacccaggagaagagcgccaggcgccgcggggtttttttgccagttgtgctcctggttcacatggtattgctgtaccagaacccttacaaacaccatggaaactgttctcactataattgctcttttctactatcctttggaaggttcaaagtctatgaacagtgtcaaatactcatccctggtggcacttgccttcataattcgtcccacagctgtcattctgtggacacctttgctcttcagacatttctgtcaagaaccaagaaagcttgatcttattctacatcattttttacctgtaggctttgttactttgagtttgtctctgatgattgatcgtattttttttggccaatggactctggttcaatttaattttttgaaatttaacgtgctgcagaactggggaacattttatggttctcatccatggcactggtacttcagtcaaggatttccagttatcttgggtactcacttacccttctttattcatggctgctatctagcaccaaagagataccggatacttttggtgactgtgctgtggacactgcttgtttatagcatgttgagccacaaagaattcaggtttatttatccagttttaccattctgtatggtgttctgtggatactcattaacccacctgaaaacatggaagaaaccagctctaagtttcctgtttttatcaaatttgttcctcgccctttatactggtttagttcatcaacgaggtactcttgatgtcatgagtcatattcaaaaagtttgttacaacaatcccaataaatcttcagcttcaatatttataatgatgccttgccactctactccttattacagccatgttcactgcccacttcccatgagatttctccagtgcccgccagacctgactggaaaaagtcattatcttgatgaagcagatgtattttacctaaatcccttaaactggttacatagagagtttcatgatgatgcatcattgcctactcacttgatcaccttcagcattttggaagaggaaataagcgctttcctaatttcaagcaattataaaagaactgctgttttcttccacactcacttgccagagggtcgaattggaagtcacatatatgtctatgaacggaagttaaaagggaaattcaacatgaagatgaaattctgaactttcctagataaattaacattgctgggtggaaatattcagatgctgcttaaatacttcggtaaacactgggtaagattcatggaacttagaaaaaagctgtatgaactgctttaccaaatatcactactgaggaaatgtataaaataccacatagtataaaattacatgttaatacaatgccagattttaaataaagacctttagttttcctc

SEQ ID NO: 22146 - DNA, 1499 bp, Homo sapiens
cggacccggaagtgcttggccacagtcgcagccccggcgccccgaagcgggaaaaaggctgggtgccgccgtcccccagctgcgcaaccctaggaactctcgggttcacagtctctctttttctaggaacttggctgtgttgtcctgcctcagagacaaattcatctattgtaggcctagcccctgcctttgaaaacaaggaaaggttggtagaacatcaacacagcatggaatttccagggaggtctcatttcaaaacttcataaagaacaagaaccacctggacttctgtgagggcgatgattaaactggcctgagtttgaatgaaaggataatgtatgctcaacctgtgactaacaccaaggaggtcaagtggcagaaggtcttgtatgagcgacagccctttcctgataactatgtggaccggcgattcctggaagagctccggaaaaacatccatgctcggaaataccaatattgggctgtggtatttgagtccagtgtggtgatccagcagctgtgcagtgtttgtgtttttgtggttatctggtggtatatggatgagggtcttctggccccccattggcttttagggactggtctggcttcttcactgattgggtatgttttgtttgatctcattgatggaggtgaagggcggaagaagagtgggcagacccggtgggctgacctgaagagtgccctagtcttcattactttcacttatgggttttcaccagtgctgaagacccttacagagtctgtcagcactgacaccatctatgccatgtcagtcttcatgctgttaggccatctcatcttttttgactatggtgccaatgctgccattgtatccagcacactatccttgaacatggccatctttgcttctgtatgcttggcatcacgtcttccccggtccctgcatgccttcatcatggtgacatttgccattcagatttttgccctgtggcccatgttgcagaagaaactaaaggcatgtactccccggagctatgtgggggtcacactgctttttgcattttcagccgtgggaggcctactgtccattagtgctgtgggagccgtactctttgcccttctgctgatgtctatctcatgtctgtgtccattctacctcattcgcttgcagctttttaaagaaaacattcatgggccttgggatgaagctgaaatcaaggaagacttgtccaggttcctcagttaaattaggacatccattacattattaaagcaagctgatagattagcctcctaactagtatagaacttaaagacagagttccattctggaagcagcatgtcattgtggtaagagaatagagatcaaaaccaaaaaaaatgaaccaaaggcttgggtggtgagggtgcttatcctttctgttattttgtagatgaaaaaactttctggggacctcttgaattacatgctgtaacatatgaagtgatgtggtttctattaaaaaaataacacatcc
